United States Patent 8,781,750 (CELL-TYPE-SPECIFIC PATTERNS OF GENE EXPRESSION) - sequence listing, part 2

SEQ ID NO: 35581 - DNA, 768043 bp, Homo sapiens
  misc_feature (106202)..(206201): n is a, c, g, or t
  misc_feature (390258)..(490257): n is a, c, g, or t
accctcctctccaaccctcgtaccctcagaccctcggctcagacccacagatcctcttctacaccctcagagcctccgctcacaccctcagactctcccttcagaccctcaatcttcctctcagacccaacgaccctcctcccagaccctcagaccgcccccctcagaccctcagaccctgagacccttccctcagaccctcccaagacacccgcagaccctcccctcagatgctcccctcagacccttggacgctcctctcagacccacagaccgtcccctcagacacacagagcctcccctcagacgcagagaccctcctctcagaccccccaacccttccctcagaccctcagaccttcttctcagaccctcagtctgtcctctcagaccctcccctcagaccctcagaccgtcccctcacactttcccctcagaccctcatactcaggtgggcagagcttctgccagtgtagatcatggtgccgtcttcccgcgcggcactgctgtcgtcctggtcttccgagggcgtctttctgtccgtggctttccggcagggccctcacctcttccggtgcgcactgctcagcccttcgcggctcaggcctgactgaaagcacccgtggtccctgagcctcgtgtgcgcttgtcagcagagcctgttttgtcctcagtctgtctggtctgagctggcgtggacatttgctctctgggtgcatcacagagacctgcagggccctggcgctcagaagccagcgtgaggttctaggtctggggccggggcgggcgacagcggggctcggagccaccgccacagccctgcccgacgtaggtaattcacccctttaataaccagaagacggaaagaaggaaaaggtgcaggccagagggaacccgaattccctgttgagtgcgactttctttctttttgcggtccggtttctggtcagtgtcctgaggacattatgccatgcagggcggttccgaattgcctgggcccagcctggtgttgccacggtccccaccccactctgcagccctgtctgatcctgacccagttttcttgcccacccctgaggctcaaacactgtgatttgagctcagacaaggtgagtctcaggttttgagtgagaatgtttcttttaaacgttggtttgataattttctataaaaggctgaaccctgaattgtttctttttcagcctgtaccaaaacgtcaggtggtctcctccggccgtgcctatcaccaccagcctgtgtctccctgtgaaatatggtctggttccatcatggatttattttcccgcctcccagtaggacagatctcagctctttaggccgacaacccctgacagcaactcagccacctcctgccctcacccttggagccctgtctactgatggctcacttggagcctggcttggggtgacctctgtgccagggtgtgcggtcatttccctggattcttgttagagtcctcatctgcccaaggagatgatgaccctgagctactaagaacaggcttccttcatgtcaggacacagagacaaacatgcgcaccacgtaagggaagggaagatggtaaagagaaattggtgaacaaatgccgcggccaggcaggtggcgcgaatgagctgagtgtggcatcagaggggtgggaacttggtgccgctcagccttggcaggcagctgctaagtaggaatgcacaaacactggccagatcatctgatttttaaaaagccagaaatatggacttctgtataaaattttgtgatttttaaatgttggcaatgttctttgctttttttctttttaatcctgggtagggtaaaccaccagtttccgacttctgtactaaaacatgttctctagattttttttttttttttttttttgagacggagtcttgctctgtcgcccaggctggagtgcagtggtgcgatcgcggctcactgcaagctccgcctcctgggttgacgccattctcctgcctcagcctctggagtagctgggactacaggcgcccgccaagacgcccggctaattttttgtatttttagtagtgacggggtttcaccgtgttagccaggatggtctcgatctcctgacctcgtgatccgcctgcctcagcctcccaaagtgctgggattacaggcgtgagccactgtgcctggccccatgttctctagatttttaaaactaagattttgttttatatatttatatggaaatacagaaaaatgccagaaaaagtgcctataattttcactgttaacaaaattatataaagtaagaagtaaaagtagctgtaagatccccttcacttctccggtttgctgacgtgtggtagaggagaggccatacaggtgaaggtctgtatgcggcggtcaggtgagccctggaagtgggcaggatttggaaggactgacaatgaggagagcttgccctcaggtaggaagacagggttgatccttatctttgtttcagtggcagctgcactcttgcatgcatggtccagttctatctcctgtcttatatgtccatggaacataacaaatcctagtgtaaccacagccctacccaagaacatgatgagacacaactccctaagttttccccccgaaagtaaccaaagaactactctgactttgacacttgttatcctttctagcttgtctcttttcttatatacatacatatatacataaatatatatatatatatatatatatattatgcatacatgagttttgtctttttgtttttaaactttataagaaggatatgatatatgtgggcgttagggacattttacttcattcattctcacttgttaccctattgtgggaatactcctcactttgcttatctggtgtcctacagttgaacatttgagctgccttctgcttttttgttagcgtaaacattgatgctgagcatgatccctgggacaggtcctgaatgtggaattgttgggtagcagggtgtgcaaatattcaacctaataggattgtgccaaattattttcaaaagtggctgtatcaactcacactcctactggccatgtgtaagagatgtaattggcccacagccttcccagtatttgctattgtcagacttcttaaagtttgcctgtcatatgggcataaaatgatttctgattgtggtcttgatctgtagctccctgataattaatgagaccaagaatcttttcatgtgtatacatattggcccatcgacaacactgactcttctgagccgtgaacagcatatacctttatgtatttagttcttctgtctttcagttgtattttatagtattgtgttgtacgcatttttcattagagttgttccttgtatttcatattttgttctattgttaaattggatattggtttgatttcttttggattggtttcttactgtttattgctgtattgtatatgtatagaaaggtgcaaatatcacaagtttacagcttgatgaattttcattggactcacctatttaacctagacccagatgaataaaacacagcttccccagcaccctaagaccccctgtgttctcttccatttatttccactcctactcccaccttccaaccagcagcctctgtcccaactagattcattttgcttgtttggtactttataatcatggatccacacaaaatgtagtcttttgtgtcttgctactcttgctgaaaacagtatttatgaggaactttaccccattactgcctgtagttgtggacagttcattccattgtgtgattctatcggaatttgtcctgttgtcagggagcactgtgacaggtcccagtttggaacaattacacacagtgctgcctatagacactctagaagatgtcttttgatagacaaatgcattgatttctcttggatatattcctgggagtggaattgctggaccatggagtagttgtatgtttgacttcgttagggaatgtaagtcagtttttcaaaagaattttaacatttaacactcccaccaccaatatatgacagttccacttatgtcacgttctttgccaacacttgatgttgtcaatcccttaccttttagccattcagataggtatgaaatggtatttgcctatgtttttaatttgtattttctgattactaaagaggctgagaacattttcacatgtttcttggccatttggatttcttctttactatagctcaagtctttttgacaatcttataactgagttatttttcttttatttattaacttgtagttcttaattgttctggatatttctttgttagatatttgcgttgtaaatatttccctagtctattaatattttttaaacttgcttttgatgagcaagagttttaaatcttgaaaaagtccaagttatacattttttcttttatacttggtgctatttttgctctgtttaaaaaattcttgcctatcctaaggtcctgttttcttcaaaatatctaatttttgctttcataaagctaaaattaatgtaatgtcatacagtttaatttggggggtttggtgtgaggtagagatcaaagttcattttttttttttccatatgagatccagctgatccagcaccatttattgaaaagacttttcttttcccatgaatggtattgatgcctttgttgaaaatcaagtaaatataatatgtgagtctattttgggattttctattctgtgtcattggtctctttagctatatttatttatctgtatgccatcactacactgtcttaatgtggcattgaaatctggtagtataaatccttcaacattattgttcttcaagattgtcttggaattactgggtctgttggtattctacataaaatttcaagttgggttgtcactggaaaatcccagactacttgttgattaaacaacacgcttgtagataagacatgggcctgagtagaatttcaagagaaatttaaaaatctttcattgacctaaatgaaaatgaaaatacaacttatcaaaatttgtggggtgcagcaaaagcagtgcttaaaggagaacttatggcattgactgcatatattagaaaaggatatctaaaatcaatggtctaagcctccactttagtgaactagaaaagtatgagcaaattaaattcaaagtaagcagaaaaaagaaataataagaattagagcagaaaccaatgaaatgaaaacaggaagacaatagcaaaaagcaataaaaccgaaagatggttttttgaaaagattaataaaatccataaacttctagccaggctaaggaaaaaacagagaagacagaaattgccaatatccaaaatgaaagaggggccattagacctcatatagaactcatggacattaaaggggtaataaaggcatatgacgaacaactctgtgcctgcaaatttggtatcctagatgaaatgaaccaattccttggaagacacaatctgccaaaactcacacaaaaatagacaatttaaatagacctaaatctattaaagaaattgaatcaataatgaataacagaaagcaccaggctcagataggttcagtggtaaattttactaaacatttaaggaataaattataccacttctctacaatcttttccagaagataaaagcagaggaatatgttttaatttattctgtgaggccagcattaacataataccaaaactagacaaagacattacaagaaaagaaaactacagactcgtctctcttatgaacatagatgcaacagtcttcaataaaatactagcaaatcagactggatgtagtggctcgcgcctgtaatcccagcattttgggaggccgagacaggtggatcacctgaggtcaggtgtttgagaccggcctggccaatgtggtgaaaccccatttctactaaaaatacaaaaattagccaggcgtggtggtgggcacctgtaatcccagctacttgggagagtgaggcaggagaatcacttgaacccgggaggcagatattgcagtgagccaagattgcaccattgcactctagcctgggagacaagagtgaaacactgtctcaaaaacaaaacaaaacaaaacaaacaaacaaaaatacaaaaaaaaaccaaaactagcaaatcaaatccagcaatgtataaaaataattatacaccatgaacaagtggaatttataaccatgaccaagtggtatctatccaggtctgcaagattggttcaacatttaaaaatcaattcgcacagtcacattacattaggagaaaaatcacacgatcatatcaatagatgtagaaaaagcatctgacaaaatccaacaattatttatgatttaggaaaaaagactcagtaaactaagaatagagggaaagttcttcacttggtaaagatatctacagaaaacctacagctaacatcacacataatatttagaaactagatctttcctgctaagatcaggatcaaggcaaggatgttccttctcaccaatccttttcaacattgtactagaagttctagcaagtccaagaagacaataaaaggaaataaaatgtatacagattgggaaggagaaaacaaagcttccttagttaccagactgcctgattgtgtatgtagaaaatccaaaagaattgtcaaaaactcctgcaactaataagcaattatagcaagattgtaggatataacaaaaataaattgcttttctatatgccagtaaaaaacaagtggaacttcaaatttaaaacacactactatctacagtaacactaaaaaagaatgaagtacttaggtttaaatctaacgaaatacatacaagatctttatgaggaaaaccacaaaactctggtgaaagaactcaaagaaaagctacataaatgagagacatcccatgttcatggatagaaagacttaatattttcagaatgtcagttcttcccaacttcatctctagtatagattgaatgcaatcaatctataaactcaacagtaagaaaatgaacaatttgattaagaaatgggcaactgggcccggtggctcacgcctataatcccagcactttgggaggccgaggtgggcggatcacgaggtcaagagatcaagaccatcctggccaacatggtgaaaccccatctctacaaaaagtacaaaaattagctgggcatggtggtgcacgcctgtagtcccagctacttgggaggctgagacaggagaatcacttgaacctgagaggtggagattgcagtgagccaagatcctgatcttgccactgcattccagcctggtgacacagtgagactccatctcaaaaaaaaaaaaaaaaaagaaaaaagaaaagaaaaaaagagaaagaaatgggcaaaccagcatggtggctcatgcctgtaacctcagcactttgggaggccgaagcaggcagatcacctgaggttgggagtttgagaccagcctggcctggttaaactccatctctactgaaaactcaaaaattagctgggtgtggtggcatgcacctatactcgggaggctgaggcaggagaatcacttgaatctaggaggcagaggttgcagtgagctgagattgtgccactgcattccagcctgggcaacagagcaagactccatcttaaaaaaaatatgaaagaaagaaatgggcaaaatacctgagcagacacctcaccaaagaagctatacagacggcaaagaagatgagcatgtgacaagatgcttcatatcatatgtcatcagggaagtactaattaaaacagcaaggagataccaccacacacctattagactggcagacaaccaagttgctgacaccaccaaacgctggtaatgatgtgaatcagcaggaactgtcattcattgctggtgagaatataaaatagcataaccactttggaagacagtttggagtttctgacaaaactaacagctgggcacggtggctcatgcctgtaatcccagcactttgggaggccgacgcaggcggattacctgaggtcaggagttcaagaccagcctgatctacatggagaaaccccgtctctattaaaatacaaaaaaattagccaggcgtggtggcgcatgcctataatcccagctacttgagaggctgaggcaggagaatcacttgaacccgggaggtggaggttgcgatgagccgagattgcgccattgcactccggcctgggcaacaagagtgaaactccgtcccaaaaaataaaaaataaaaaaataaaaaaaactaaacatacacttaccatgtgatccagcaattgtgctccttggtatttaccaaaatgagtcaaaaacttatgtccgcacaaaattctacacatggatgtttatagcagctttatttataattgccaaaagttggaagcaaccaagatgtccttcaataagtgagtggataaacaaactgtgatacatccagataacggaatattattcagtactaaaaagaaatgagctatcaggctatggaaacacatggagaaactttaagtgcatattactaagtaaaagaagccactgctgggggcagtggctcatacctgtaatcctagcactttgggaggccaaggcaggtggatcacctgaggtcaggagtttgagaccagcctggccaacatggtgaaaccccgtctctactaaaaatacaaaaattagccaacgtggtggcacgcacctgaaatcccagctattcgggaggctgagacaggaggctaacttgaacccaggagatggaggttgcagtaagctgagattgcgccactgcaccccagcctgggtgacagagcgagactctgtctcaaaaaaaaaaaaagaagctaatctaaaaaggttacaactatatgattccaactctatgacattctagaaaaggcaaaacaatggagacagttaaaagatcagtggttgccaggaattagaagggagggagggataaaatgacagagcacagaagatttttagggcagtgcaactattttccatgatactataattgtggacacgtcattatacattcgtccaaatcatagaatgtacaacaccaagaatgaactctaatgtaaactatgaactatggatgatgatgatgtgtcagtgtaggttaattgattgtaacaaatgcaccactctggaaggatgttgaggcgtctgtgggtagggggagagaaagaaggtatgtaaggactctctgtactttctgctcagttttgctgtgaacttaataatgctcttaataaagtccgttttttgaaaaatgaattgtcaacttctactgaaaaaaaataaaaaaagctgagattctgattgggattgcattggatccataggttagtttggggagaagggctatcttaacactattgcgtcttctaatccacagatatgttgtatctccaatatttttggtctactttagatttgtaaagcaatattttgtattttttcaaaataacttttacacatctaaattaattcctaattagttgctatttttcatgccatcataaatattcttaaatgacatgaaaatatttttaaaatatattgtccaatagtttgctggtatatagaaatgtaagtgatgttattttgcattgaacttgtatttagagagtcttgtaactttactgattaactttgagtccttggtgctccagatctgcaatcatcatctgagaataaaaagaattttacctcttcctattcaatatttgtgcctttttatttctttttcttgtcttgttgcactggttaggactttctgtttcatttgaatagaaatgggatttttctcttaattatattgcgaatttcaaaacacagagagattgaacaaatagtaaaatacacaatcatacattaagcagtttttaaaaatcattttgccatattcgttctctctcttccccttctgtctctctctcccatatgaaagtacatacacaaaaatacacacttttatctgaaccacttacaaataaatagtcaaaataatgacacttagtatctaaattcatcactgtgcaccttttctaagaataaaaataatctcccaaactaccaaaatgccattatcacatttagcaaaataataattttttccttcttttacctaatatttggactatgtaaggtctttccccattgtcctcaaaatatcctttatagcttttttagaaatagttttattgagataaaatttacatactatgcaattcacccacttacagtacatgatggtatctttgtatattattaattttttaaattaaattaataatttaaaaattcagaaccagttcactgttctgaactggggtatattaataattttttaaaactatggtgtgtatatatatatatatatgtgtgtgtgtatgtatatcttgccattttaaccatttcaagtgtaaaattcagtggtattaattacattcacagtgttactaattacttccaacatttttcatcacccctaacagtgctttgtaatcattgaggagtaaccacctacccacagtcactggtaactgctaatttactttttgtctctatgaatttacctattctggatatttcatataagtggaatcacaccatatttgtccttttgtgtctgacttactttacttagcatgatgttttaatggttcacccatgttacagcatatatcagaatttcattcctttatatggctgaataataatccattactggcacatgctatgttttgtttatccatttgtctgttgatgggcacttagggtctttccatcttttgactattgtgattaatgctgcagtgaacattggcataccatgtcaaacatacatgcttgtgtgtgtatatgtgtatatagttgttccttagtatccatgagggattggttccaggatcctctgtgataccaaaatccatggatgctaaagtccctttttaaaaatggcatagtatttgcatataacccaaacacaccctcctgtgtattttaaatcatctgtagattacttataatacataatgtaatgtaaatgctataaaaatagttattagactgtatttagggaataatgacaagaagaaaaagtctgtacatgttcagtacagaggcaacctttgtaggtctaaataaatttttaatacaaggttggttgaatccatggatgtggaatccgcagatacaaagggccgactgcatattgttctattaatgtgatgtgttacattgattatcttatgttgaaccatctttgcattcatggaataaatctcacttggtcattgtgtgtaacaagatgaaagatacaagtctacaaatccaagaagttcatgaacttcaggtaggataaactcaaagaaacccacaccaagatacataatcaaactcaaaagacaaagagaattttgaaaacagcaggcgaagtgatttgtcacttataatggattttcagtaagattaatagccaatttctcattagaaatcatggaagtccactgcctagtggaatgatacatttaaagtgaagggggaaaaaaaaaacaaacactgcaaaaaaagccaaaccctgccaatctgtaaattctatagctggaaaaactacccttcaaaaacgagggaaatattaagacatcccccagaaaaacaaaagctgaggagttcattaccactagacctgccctgcaggaaatgctaaaggacagatccttcaaggttgaaatggaaggacaccagatagtaactatatgaagaaataaatgtctttggtaaatacatggtaagtacatgggcaagtagaaaagccactattattatatttttggtttataactccactcttttatttcctacatgatttaaaagacaaatacacaaaaataattttaaatctatgttactgggcagaaaatgtataaagatgtaaatggattaaactcctcagtcaaaagttatagactggcaaaatgaataaaaaaacacattttatatgctgtccacaaaagactcactttagatctaaggacactcataggttgaaagtgaaaggataaaacaagatattcatgcaaatagtaatcaaaagagaggaagagtggctatattaatatcagcatagattttgagtcaaaaactgtcatgagtaacaaagaaggatatatataaaagggacaacttttgaaaaggtcaattcaccaagaagatacaacaatcataaatatatatgtactaaatatcagagcttctaaatatacaaagcaaacattgacagaatttaagggagaaacagacaactctataataatagtaggagacttcagtgcccaactgtagatgttggatagaacaaccagacaggagatcaataaaaaaaaaaggacttaaacaacactatagagcacctggacctaacaggcatacatagaacatgccactaacaaacggcaggatacaattttttctcaagtgcacctggaacattctccagggtacagtccctggagacatttcctataccttgtgagatagcagtgcattaaagaataagtcttactcggagtttatttattgccatgcttcctagttactcatcaacccagtaagcaggtcaatccattgaagaattttttaagcaagaagcagcatgacctaatttatttatttctctctctctctccctcctttctttcctcccttccttccttccctccttccttccttctttccttccttccttccctccctccttccttctttccttccttcctctctttctctttctttcctctctccctccctttcttccttccaagtcccactgtgtcactcaggctagagtgcagtggtgtgatcactggtctcaaacaatcctcctgcttcagtcttccaagtacctgggactacaagtatgtgccaccacacttggctaattttttttttttttgagatggggtctcgctctgttgcccaggctggagtgcagtggtacgatctcggctcactgcaagctctgcctcctgggttcatgccattctcctgcttcagcctccccagtagctgggactacccagagttgtgtctggcacttagcccaccaccatgcctggctaattttttttgtatttttagtagagatggggtttcaccatgttggccaggatggtctagatctcctgacctcgtgatccgcctgcctcagcctcccaaagtgctgggattataggcatgagccaccgcgcctggcccatgcttagctaatttataaaaaattttttgtagagacaaagtcttgctacattacccagcctggtctcagactcttggcctcaagcaatcttcttgccttggccttccaaagtcctgggattacaggcatgagccaccatgcccggcctaatctccaattttaaaatatcactctgctgaatagataacagattagattatacaagattggatgaagggagtgatttttatagtcctcaatggagaggatgctatctcggccagggttgtagcagaggaggtagaaaaacagaggaattaaagacatgtcaagttggtaagtggttggagtgagggcaaatgaagtatttggcttctaggtttctgtatgaaggactgggtggatgtcttagtctgtttgggctgcttataaaccactgaaatttatgtctgatgagggtcttgcttgctggttcatggacagccatctttctgcagcatcctcccatactggaaggggcacaatggttcttcttgagcctcttttatcaggcttgcgcattgccggctgttgccctccaggcagctcctcgtgtttagaaaatgcacctaaacacggtgggaggcaggtgccccctgccccctcccaccgttgaagatgcactattactttgctgccatccagagtgggaaagctaggggctggaggacgcacagcccttggaaagctcccaggcaggacgtgagtctggagcacagggctctgatgagatctggcgcagagtcattctagcatctgttcagtgtcctggttctgtctggactggctgcttggttcttgcttgcattgctttttttttttttttttaatccttttgagaaggagtcttgctctgtcacccaggctggagtgcagtggcgcgatctcggctcactgcaacctccacctcccaggttcaaacaattctcttgccttaacctcccgaatagctgggattacaggtgcctaccaccaggcccagctaattttttttgtatttttagtagagacagggttttaccatgttggccagctggtctcgaaaagagaccttgtctctcaaagtgctgagattacaggcgtgagccactgcacccggcctgctgcgtcgtttctgagctagcaccttgattagcactgatcctgcagtggcctgctttcagctcatgctggccttggtttgtttgcatcaggacccttggttcttcatcttctgactgatgtcctatctcagatgtctttctccaaccgatcctcctcacctctctgaaacatgagtctcttcatcaatcggaagaaactgccaattgtctcccaatatctgttctccacgttattcttttgtagatctttaaatgcttaggcagtcatatggcccagggtaatgactctatttccagcatcttctaggtcaatgtggccatgagctaagttctggataatgggacaaactgctaagagcattttccaaaactgatctgtttctgtttgtgcacacacacacacacacactcagacacacctgtgtactcagctggtcatagtctctctcaattgtcaccttctccatgaagtgttgccaactgtgtgcacggagaaatcattgttctgtgcttccataccccccttcccaatcgtgaatatgagcttgtcccaccaggtcacatccattataattgcaggtgcatctgtctctccagtttgactctgggcagtctcttattaatctgcgtaatatcagcacccagagttgtgtctggcacttagtaggagctcagaaatgcttgcggagggaggaatgcagggaaggcaagggtttcgaaactgtggtttcgtcttcttattaacaaactatatttttatccacgtatttctcagttaaaggaacgtgcccatcacagaggctaagatcacttatccacagtgatgtggtgccccatcatctcagcattggtgtcagtggatgctaagatccttctgtgaatccgtaagaggagtgggcaggcagcacaaaaatgcccaaaggcactcaattgcatgtgaggccacatttctcaaacaaaattactctgtaggctcctggtgctggcttcaccttgggctgaggacaaatgggtgctatggggaaaggagatgacgccaggagaacacagatctttcaacctgaaatcatgggactccacaggacatcacctgacatcatcttagccagagcgaagcaagccgcagggcaggcacacttcaggagaatctcggagtcaatggccaaggtaccaaggggtctctcatcacaaaagccagaaaagaatccagatcaaagcaagggaacatgtctaaggagtaggcaaaattggttgattcgggtaaattcaacttttataaatctggtgatatgatcctctagaatttgtcagatccaaggggtgattttgaaagaactgtggtttcagactataaatgaatgcgacagtctttaagacagaaataatattatagcatgctaatgtggcaggatcacaactgactttccttccaagagggagaacttgggatttgaccgggaattttaaaaaggagcaataacgcagtaggagagagacaaaaaatgtctttgtgtctgggggtggtggggggacttaggagtgttgatctgtgagagcaaaggagagccacacgggacagacctggaggttgggaaagcgcacagattttcctgtgttttatgatacactcaaatacacagagcaaagttttctagagatgcctttattgacattttactaaagatcaagaaaatgccatttacgcatatccaggaatattattttttaactttccccataaattccatgagtccctgcctcctgcttgtcctcccactgaaggcctcttgccatagtgatggaagaaggcagaaaataggagatggttggagaaaagaccaatgtcatcgaggagggaaacaaaagacaatctggatatgtaatcagcagatttagaattaaaacagggttagaaaattctctctctctgaaagagaggacagtttaatgggggtgtggaattggtggggagagtttgcaccatgcctggagactctggagcagacacacacacagcttttgcgagatgaagacttttcctgggaaggacacgttcacttctagtaaaacacagcacaggccatttccatgtaatatttgggacggtagctgaatctggtgcccacatgcacaaaacaagacagtatctggccccaaccatagggctgaacccagcctctggcatgtggtgcaagtcaacacctgaacgagtgcatcattcaaagaaccctatctcctaaacagcccaggctccagagatacagggaggccaaaggcttagataaattccgagggttatgggcttatttaggaagtttgcatttcagcaacccaatcgagagactgcaaggcaaggcagtggctaaaaatatttggatcatcaaccaaaattttagagggaattctgttaacttttgttaagagaaacgagggctttctgtggaacatgtggctatggagaggaaaaagggagtaactttttgcccttttcctaagccacacagagcaccgtgagcattcattgccgcagtgcctcgtgcgcgttcggagtatctcagtacagtgatttttgtgcagaaacttctttgaataatattagttatcagccatataaacattgttgaattatcagaatcctgaatttgtggggaagacgtttaagaccccaattttggaccctacgtgtgtatcctcctaactggagcccccaggtctcagggagaagtccccagaggctgggagggtgtcactgttgccatcagggctcaaatactgacatttaggaacacataaagaatccctgtgaaacagaaggaacggacctaggaagatagggccatttgaggaacatcagtgttctctaagtatctatttgtgtgaaccagctcgcagaaagtgagcgtttctggtagtcttcaaagaagaaacgggtgctaacttgtaagcagtttaagccaagtgaccagagctttagggggtgcggcgttgcctgaggggcaggagtggccaaaatcagcataaaacgtgcaaagtgggctgtcatgtaataatacaccgcacaggcagagaggcctttggtcagctcctcaagtcctctgtagatgttccttaccctcggcgcgcaccagcctctgccgcctgctgtggccctgaacttcggactcttctctggcctagcccgcccttggctggggtgctcgggcctggccctagcggcggggccctccagggtggattaagtctccaagactccgggaccaccaggctcaccatgcaatgaaactgtttctggagttttcctgtccctgctttccctcccgagtcccgggccaggctgcgtccggtgggcaccgaggacgcccagaattgttgggaatctgggcggaggcccgtcgtgggcttggaggccaccgggtccagcagaggcagaggcctctgtgccacgcacgcacacacacctgctctcctccgtgtgtccacatacacacgtctatgcacacacctgctctccatacatgcacagccccacacacagtcggccctttatgtgcacacacactcgtgcacacaagcggccccctctcctccgtgcatacaggcgcacacacagctggctctcctctttgagcacacacactcaagcacacacccggccccgctcttccaagtgcacacacactcctgcacacactagtccctgctcccccccccacactcgcgcacacagccggcactctctgctccctgcacacaaacacacatcctgacatacccggccccctacctgctgccccatgtgcacacacactagtgcacacaccagtccccgctccctcacatgcacacacactagtgcacacaccagtccccgctccctcacatgcacacacactagtgcacacaccagtccccgctccctcacatgcacacacacgagtgcacacaccagtccccgctccctcacatgcacacactagtgcacacaccagtccccgctccctcacatgcacacactagtgcacacaccagtccccgctccctcacatgcacacactagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacactagtgcacacaccagtccccgctccctcacgtgcacatgcactagtgcacacactagtccctgctcccccacgtgcacacacactcttgcacacagccggccccgctcccccacgtgcacacaccagctcccgctcccccacatgcacacacactcgtgcacatagccggccccgctcccccatgtgcacacacactcttgcacacagccggccacctctctctccggacacacacagtcagaggcgcgcacaaacacagtcccttggccgccgagcgcacgccgcgcgcgcgcactgcccgtcccggcgcaggccccagctacatctccgcacgcgcacgcgcacacacggacacgcgcgcacagcccctccccgctctcccagggcgcgcagcactggcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccaggtgcgggtgggcaggggatgccgcgggagccgcgggcgggagccgggggtgcgggcgggacccccggccaccccatcccttgccccggccgcgtgtaggcgccgcgcggccccgacccgcgccctcccgcgccctgcgcgctcctgtgcctcggggaccccgcgcgctcggcgctggtaggggctccccaggtgaccgcggggcgggggtcccgggcccggccctcccggccgacagcagcgtccgcgccccacgctggaggtggggccggggccggggccggggctggggccagggtcggccggagcgcgcagggcgggggaggggaggccgccccacggcggcccgcggggacccggttccggcgcgcgcgggaggcgcctcgtgcggaggcggcccgaggcctagtgacaggcgcgcggcgcggaccccggaagcccacctgtcagagttaccggtcagccgggcgggcgccgccggggtctggggtggacgccgcgagcctgcacgttgcgccgggaccccggggctgtgcccaggtgggtggtggggcacccccctgcagcggcgggagggaggcgctgcgccctggctcctggggctcggccccaccctcggccgctgggcgggccgtcggggacctgggggtagtggtggtgaccctgcgggcccgcgggccacttttccgcagggggcatttccgtctggcgaggcgactgaaaatcctgagtgtgggagtcggtttggccagctccgctctcaggatggagggtgcctttgggaaggaaggtccgcgtttcctttgagatgtgttattttttaaacttcgtttttcattcttacttatttcttgtttttccttacttttttttttttttttaccagaaaaatcatttttcttctctgggaaggtgaacatttgtagcattgatttcccggatctggtaacatggcaaaagatgtaagtatgtttgcttcatgctgcacacgaatgtttgcctcgcactaaattctttgtagttctctgcctttatttcagaatgacaacacataagctacagtagtgtttattttcagacttttaaagcgtctgaagcgggatgaaggtgaaagatggaaggatctgatctctgaagctgcggtcaccacccacaagttgtggccttggataccacactgcagttgggtggtgatggggtggtgccttctgactttttccttatctttaccgactgtgttaattgataattttaaataaacgccttaattaaattgaggtggagggtgttgcagcaccgcagcgaatcctgcatttcttggggggcttccacatgagacgctggacgggggccaggctcagggctcaggctgtagccacctgctggcacctgtcttcctacagaggaagttaattccacttgggtggaccaagagctaaggacttgttttggccactttttttctcagaaggatgagatttcctgatttatgaaatctggtaaaaaatgctacttagcctgctttgcagttgtcatgaaactatagaatattttgaaaattttttaaagccagaaatttagtctattttattggtgtgcggttctttaccgtgcttggttatgtcagtcactgaaacaccagctggattctttagtgtttcccaccgtgcatcgttttgtaactgagtgaaaggtgctgttgatgtgtttacctacttaccgcacagagttggaaagagtccgcacatgctgcctctgcctgagatacatctgtagcgaaaatgcgtccagagtgtggagccctctccgttggcgcagaggtttcagtggtccctgcgaggccttttggggtgtctgccctccctgacctgcgaccaggcatgtcacacggcatccctgccttcaagcactggggtcccctttagagagggtgtgtgagcacccaggtggacccagtgtgagtttttgaagtcatatctggctgtgctgcgagactacttttatcctctccactgtgcttgtccgtaccatgccctgacctcgtgcgggcatgcactcagaatgccagatgtgggcatgtgctcagcgcgcaagccatgttcattacatctcctcatggtgaggagctggacccagggcctcggttagagcacgcttctggtgttgtgtggtttcctgtgtggtttcctcagatggttctcaaacacgctttgatacataatggatggtgttttcggggccctctttcattcccccgtgatttcactggcactgtctgtgagcagcatgtagtgtgaggctgggggtggggggcgtgtggaaaggtggtccggctctgcaggaccctgaatgctccatccagtgtgggcacctgagacgcagcatttgtcaggaactgcataggcacaggggctgggggctcaccttgcactcaggggttgtgatctgagttgggggttggcgctgggaggagagtaggattctgcagctggtgaggccttccctgctcaaagcctgggagtggtcaggagtgctgggtctggatggaaagtgaggttgtgaacaagtcaaggaatttgatgttttcgctagctcttttttttttttttttttttgagacagagtctcactctgtctcccaagctggagtgcagtgacgcgatcttggctcactgcaacctctgtctcctgggtttaagcaatcctctcgcctcagcctcccgagaagctaggattacaggcatgtgccaccatgcctggcaaatttttttgtatttttagtagagatggggtttcaccatgttgcccaggctgggctcgagctcctgacctcaacaatccacccgccttacaggcgtgagccaccgcgcccggcctagctaactcttttaagtagaggtgtgacatttgagttttgaaaagatgatgttggcagcttttgcagaagggaacatcgataaccagttaggtgttttgtttttgttttttgagacggagttttgcttgttgcccaggctagagtgcaatggcgcgacctcagctcactgtgaccttggcctcctgggttcaagcagttcttctcctcagcctcccaaatagctgggattacaggcgcgccaccacacccagctaattttttgttagtagacacggggtttcaccatgttggccaggcttgtcttgaactcctgacctcaggggatccacccacctcggcctcccaaagtgctgggattacaggcgtgagccgctgtgcccagcccaccagttaggtttttaaaagcactggtactgcagtaaaaccacaggtgtatgtcaaaagcctttatgctgggggaaagctgtgccacttgggttgaaggaggcaggcctccagcttctaagtgccctggggcctctgtagagggccatgaggggccacaggatgcagggagctggagctaggccctggtagtcaccatggaggaggagaaacaaggacatccaagacctgaggctggaaggttctggagagaacacaagagaaaaacaactccggagcttccaacctcaagtagggcacagggagacaagcgggtgggaaaaggccacaaatggctccatgtgagtgaggggcagaaagaagaggatgaggtcagtcctctgggggtgtcatctttgaacagcagttgacaggcagtgggtgtgaaggtctatatggcaaggagctacacacgagggaggagagaggtactctgaaaagtttgcagagtgggtaggaaatgactgtggagcagtgaggagagtgatcagtgatggtgtagtagttagagagtgagtggtggtggacttgatggagagtgagtggtggtgctggagtggtggagagtgagtggtgatggtagattggacggagagtgagtgtggtagactcggggacagtgagtggtgatggtagattggatggagagtgagtggtggtaggactgggggagagagagtggtgatggtggtgtaggtggagagtgagtggtgatggtggagttggtagagtgagtgtggtgatggtgttgtgggtggagagtgagtgatggtagtgttgtgggtggacagtgagtggtgatggtggtagactggaggagagtgagtgtggtgatggtgttgtgggtggagagtgagtggcggtgctggagtgggtgatgtagggtcacagaaggaggaaacagcctagaaggtggctgcctttgatggtccttgagtgggcccagctggagaaatggtgagaaggattaggtttctgttgtcttgctcagggactttttattttattgcacttatttgaattaaaatggtaaattcaaatggaatatttgtgtttatactctgttaagtgggagaatgtggagaacaggagtcagctgccatacggccacctggctggctccgggaacctgaggcctggtcttgcccagcaggagcgctggcatagcatggatcacttacagaaatttatgatcaagattatgggctgctcctggcaatatggggaggatttccttgctgtggggactgtctgtttccatgcctggcccacccggtctgtgatagcctcaggtgcagtcctgtcttaagtttggagacaccctgggaggtccgtacagactctttgagtttctgaactgtcctcgaaacatctcaggccctccgcctcagggcctagggaggctgtcctctggttcctgaacagggtggctctgacccgcagatctgtgggctcccgttgcaggtaccggtggtgctcggaaccgtcctcagattcagtcttggaaggtgctttggcacctccttagagtcggacagacccttgtcacgagtcagtccagctgcaggggctcaagttgttctagagctgggctggcagggcccttgggtgagggagtgtggcttggcactggcatctcagcctgcggccaagtttcctgcctgcccaggcagcatgacccttggtgggatcaggcagagctctgcctctcccctccctacctcggaacatcctgtcgtcacacacgattgtccagtgtcatgaaagtttgtaagtgggaaggcaggcagatgatgaattcatcaaacattacagggatgcttttgctgtaagacttcgggatgtagcccgtgtggggctgtttctggggtcccgttcgcctctccaagctcctcctgccattggtaaagatgcagggcatctgaactcgctcttgggctgtgcgggcacttggacctggtcagctccctgtgcagagaacgtggctgtggacgtcactgcccggtattcacgtgccttggttgtgaaagccgttctgtggtgcctgtttgtgtcctgtgagtttatggggaaatcctgaaattgagagctggggaccaagagaactgtgtgcgtcccaccatggaggcgtttgagtgatgctgtcacgaggctctgctaatgccaagaggggaccaatgagctcctctaagggtctaccaccaggtgtccttttacagacctggatggtgaagttcaggcctgaagaggtgaacctgatgcagcaacaaactgctgtttccttcagtgcttgaaggagtgagttctgggaacaggattcagcgactcaggccttcttttgtcctcataaagaaacaactttacatttgaggttaagaaggttgtcagtttagccccctcaggtttaagtgttgaagaaatctatgatgacgtgcttgtttttacaagagtcttttcatatttcaggattttttttttctacataggatgaggttagagaaactctgaagggatattaaaaattagaaaattataggttgggccgggcgcagtggctcacgcctgtaatcccagcactttgggaggccgaggcaggtggatcacaaggtcaggagattgagaccatcctggctaagagggtgaaaccccttctccactaaaaatacaaaaaattagccaggcatggtggtgggcgcctgtagtcccagctactggggaggctgagttaggagaatggcgtgaactcgggaggcggagcttgcagtgagcagagatcacgccactgcactccagcctgggcgacagagcgagactctgtctcaaaaaaaaaaaaaaaaaaaaagaaaaagaaaattataggttaattaaaagttttgcccctgctgggcacggtggctcatgcctgtaatcccggaggccaaggcgggtggatcacctgaggtcaggagttcgagaccagtctggccaacatggcaaaaccctgtctctactaaacatacagaaattagctgggcgtggtggcgggcgcctgtaatcccagctactctcgaggctgagaaggagaatcgcttgaacccgggaggcggaggttgcagtgagccgagatcacgccattgcactccagcctgggtgacaagagcaagacttcatctcaaaaaaaaaaaaaaagaaaaaagttttgcccctaaaacatgctttaaaagaggtattataggaacatctggtataaaattcaaagaataaaaaaggacatcttttttcttacataatcagctctttgttagctctttacttttggtatttggaagaaatctctggagttcgttgtgtaagaattggaaacctcacctttggtgcacagctcgatttgcagtagaagtatcaggtgctctttaggggatgttaaaaacttttcactcttggtatttacattaaaaaatactttgttgtagaacaattagaaaatccagatttgcagttgatatttagcttgacttacagtgtggctttctgctgtttgtcataagagactagatttgtcaagttttgcttagagaggaggactggtagcagcaggtggcttagactacgtgtggggatggatctgcgaggggaagggcagatgtcagcgttggctgaattagaggctgaattaggtgacccctcatcccccaggtgtcttactcagatgattctggttgttcgggtactggccatgcactgctctctgtatctttgtgtgtagcccaagcctggaaaagcatccgccctttgtacctttttcccgactggctgagattcccgcagcatcccgactccgcttcagggctcctgtgaggacagggactatggcttttaagttgtcgcacaggtcatgggcactattcacatgtgctgcaggtaattttgagactcaaggatgaagagttatatctgcctcttcccgttagtcttttatgtgaatcctgtttgtttgtttgtttcgagacggagtttcgttcttgttgcccaggctggagtgcaatggcacgatcttggctcaccacaacctctgtctcccgggttcaagcgattctctgacctcagcctcccaagtagctgggattacaggcatgcgccaccataccctgctaattttttgtatttttagtagagacggggtttcttcatgttgctcaggctggtcttgaactcccgacctcaggtgatccgcccgccttggcctcccagagtgctgggattccaggcgtgagccaccgcgcctggccatgaatcctgtttttctatggtccagtttctaagggattctggtctgatgaatgaaaaccttgtgtgtcccctgtggctttgggatacagtatcttttaacacaggtgcttgccctgtgcaccctggtcttctgttcattaacatcgcgtcactggggtctgaggaaaagagacagtgtgatccgctccagtgaatggggaagcaggagagggtcagaaacctgaatgggtcagcccagaatccagcattgccaacacatccctggccctcccctcctgcccaggtgacaggtgtggcatatgctggtcctcagccctgcccaggagacagttgtggtgtctgtgggtcttcagccctgcccaggtgacaggtgtggtgtgtgctggtcttcagctgtgcccaagagacagttgtggtgtgcacgggtcctcagccctgcccaggtgacaggtgtgctgtgtgctggtcctcagccctgcccaggtgacaggcgtgctgtgtgctggttctcagccctgcccaggtgacaggtgtgctgtgcacgcgtcctcagctatacacaggtgtcaggcgtgatgcgtgtgggtcctcagccctgcccaggtgacaggtgtggtgtgcgcgggtcctcagccctgcccaggtgacaggtgtgctgtgtgtgggtcctcagccctgcccaggtgacaggtgtgctgtgtgtgggtcctcaccctgcccaggtgacaggtgtgctgtgtgctgatcctcagccctgtccaggtgacaggtgtgctgtgcacgcgtcctcagctatacacaggtgtcaggcgtgatgcgtgtgggtcctcagccctgtccaggtgacaggtgtggtgtgcgcaggtcctcagccctgcccaggtgacaggtgtgctgtgtgtgggtcctcaccctgcccaggtgacaggtgtgtgtgcgggtcctcagccctgcccaggtgacaggtgtgctgtgtgctgatcctcagccctgtccaggtgacaggtgtggtgtgcgcgggtcctcagccgtgcccaggtgacaggtgtgctgtgtgtgggtcctcaccctgcccaggtgacaggtgtggtgtgtgcgggtcctcagccgtgcccaggtgacaggtgtgctgtgtgtgggtcctcaccctgcccaggtgacagttgtgctgtgtgcaggtcctcacccacccaggtgacaggtgtggtgtacacgggtcctcagctgtgcccaggtgacaggtgtggtgtacgtgggtcctcagccctgcccaggtgataggtgtggtgtgcgcgggtcctcagccgtgcccaggtgacaggtgtgctgtgcacgcgtcctcagctatacacaggtgtcaggcgtgatgcgtgtgggtcctcagccctgcccaggtgacaggtgtgctgtgtgctgatcctcagccctgtccaggtgacaggtgtggtgtgtgcgggtcctcagccgtgcccaggtgacaggtgtgctgtgtgtgggtcctcaccctgcccaggtgacagttgtgctgtgtgtgggtcctcaccctgcccaggtgacagttgtgctgtgtgcaggtcctcacccacccaggtgacaggtgtggtgtacacgggtcctcagccgtgcccaggtgacaggtgtggtgtacgtgggtcctcagccctgcccaggtgataggtgtggtgtgcgcgggtcctcagccgtgcccaggtgacaggtgtgctgtgtgcaggtcctcacccagccaggtgacaggtgtggtgtacacgggtcctcagccgtgcccaggtgacaggtgtggtgtacgtgggtcctcagccctgtccaggtggcaggtgtcctgtgtgtgggtcctcaccctgcccaggtgacaggtgtgctgtgcacgcgtcctcagctatacacaggtgtcaggcgtgatgcgtgtgggtcctcagccctgcccaggtgacaggtgtgctgtgtgctgatcctcagccctgcccaggtgacaggtgtgctgtgtgctgatcctcagccctgtccaggtgacaggtatggtgtgcgcgggtcctcagccctgcccaggtgacaggtgtgctgtgtgtgggtcctctgccctgcccaggtgataggtgtggtgtgcatgagtcctcagccctgcccaggtgacaggtgtcccgtgtgctggtcctcagctgtgcccaggcttgggctgtgggtgccgcccgttcccagtggacatggaatccttgtgttactgagtgacctgcgtgtgctggttgctgcaccagcgggcttttctgtcgcagttgctttttaattgtatccattaagtagactttccacaagaaaataatatgacttactaaaaaaagttcaagtaatatttcttctgattataagagtaatcttagttgcagaaaatttggaaaaattctaggaaagcaaaaagaagaaaatgaagtcacgttcatatgtgagctgaattgttagggtttcatagcatatgcctgttggatttctatttagccgtgtgtaataaaggcagcttttccaagatgggaatgtgctgtaccttctgtttctaatcttttcacctcagtatattgtcagtgttttctctggtcagttatttttttctaccatgttttcagcagctgtatgtttttggtacgttggggagtcgtagatggtcagttactgaaaaagtgggttaacgtgggagataattaaaaaaaagacgctgtacctaaacacttcattttacattcaaacaaatgtgcatctggtccccaaatctcttggctctggactgaacgccccttcttggagagtgggccaccccttcaagccacgcccaccatactgggttttgatttctgtagactgaatggagaacataaaagacatctcaggacacggagtgcagcctcctgggttgtttgcagttttcccaggatgctgctaacagtgccactggtatagaggggtgtctggaatgagcaaggctgagtctgagacatgtggatctgtccgagagagtcctgtcagcctggtgctttacaggaaaggcggtggagttaggagcgctcttcctgctgcatggatgtgtctcagtaattacccactcccctgtggttggggattctagtggtttccagttaaatcttcccaaatttgcacaaatccaggatgagtcttaggatgaattcctggaggtgaaattgcctgtgcgcgtgcatgtctgtgagtgcagatgctggtcttttcaggtcgctttcagcacagtgtgaggtatagccgtcaggctttttagctgctgtgtagtcatttacttcctctccttgaaagtattaatggcggccgggtgcggtggctcacgcctgtaatcccagcactttgggaggctgaggcgggcggatcacaaggtcaggatatcgagaccatcctggctaacatggtgaaaccccgtctctactaaaaatacaaaaagttagctgggcgtggtggcgggcacctgtagtcccagctacttgggaggctgaggcaggagaatggtgtgaacccaggaggcggagcttgcagtgagccaagatggcgccgctgcactcccgcctgggcgacagagtgagactccgtctcaaaaaaaaaaagtattaatggctcggagtaacttgtatgggacttattttaggctccactatttcttttgcctttaagaaaaatcaaggcttgaatgaaaatatttcgtgtcaccactattgatagaacccaaattatattttgcagggaagcaggatgaagagggagatgaccgtggtgggagttcagcctctgactttgttttcatgcctgagtttgaggtcatatgtcttacccagttattgactcttggaggccattcctgctttagggcatcctttgactccgggagtcgtttttaagctgaggggccttatctggaacgatgcagcatggaggacagatgtctgcctcggtgtcatcccggtagcccgagttgagctggctgtggatgaggggttcctcttgcttcaggagaccctgggtgtcccctccccagcacggccaggttggggaggaggagtcacacatttgacagctcacggggtgtgcagccacagaactggaagcctggtctgtaggctccgtgtctgggagctcttcaggccagcggtggagtcggctagccacgatgacttttgcccggacttaacctcttttttctctaacaaatggaaaagcagttcccattggagtggccagaccaaatcctattctggggtggaaggggatgaaggtggtcagcatcgaggttgatcttgatgccagtccccatcccaggctgtggttccagtggcatttatcacatgtggatgctgatcctggaagccctgcttcgtgtttttgggcatttgttccctggagccctgtttttgctcactgttgagacagaaaggctgcgcgtcccctcgccccagcctgtcctgagcttgcctcactgtgcatccttgtgggtgggcgtcaaaccccgcacctgagtctgctgcggctctggtgcctgcccggcgccattgtcagggtgggtgtcctgggccctctggataccccctgtctggccggggttgccgctccgttctgaccccaggccaccctggaggagggtttctgagagtgccggtggctcactctgtccttggatgacttgatttttgttaaaatggaaatggaaattctttctaaaagggaaaagagtataatgtaaaaacttttccagaagagaaattagattaacatattgttatttttaaagttagctgctatgataaataaatagatgaatggagatggtctccacctcccacaggctggcggtatactcgggcgagggctatggggcggctcttccctgaggccccaggcctggaccccgtcgcgctgtctggcagcgtgtgctgcatttccctctggaggattttcccaccggaacctgtgtgatgtgttgtggaggaagctgtgtgaggcaggggtcccggggcctgaacggctggaccttgctagccctgcgacctcaggtggggactcctggcctctgtgtgctcgcctgtcccacgtgggcggccagctgccctccctacagggcagtgagggagaaaggagggcgtcagctgcttgccacgtcctggctgaacttggatggattcaaaagagtgaacataaggctttgacgaaattaggagcacctcacaggcctgggcgctgtgtaagacctcctcccagccacgaggggctgatctgatcagagctggagggacggccattgccgtgtgtccaatgtgagggctctgagctcaggagccagcatccagacacgctggggactctgcggcctctgtctttgccccagtgttgcacagaggggccctggctttccctgggcactgtttagaatgattgagggggtggcaggtggccagaaacgggagaggtggagtctccgaggcagcaggcctcccctgcaggctgctgcttccaggagggctgcaggcacgaggtgttcaaatgcagcagtgacttcataagaaaagggagtggagccgccgacatttcaggtgagttgtcatcaagagtgcagaatccaactgtgttgggagccacttgctggtgcctggccaagttcccgtctggtccctctactccccaccaccccagccctggaaaaccgtgcctgccaggttcataccacacaacccggtgcagcccaccccaaagacagcgggaggcaggatgcaagcacctttttaacggctgtggaactgatgtatgggttttccaggcagttttgcatttgtgcctgttgtagactagagcatcatttggtgtttttctgctggaaaagcaggctttagagtggtggctgaaagtctcattatagattatatagattagagcagcctctcctgggagagggatgctgggtgcctgccttccaagtgtctgctcatgagtggatgggccccaccctctgtgcctgctggggcttcagaatccactggtttcctgaaggttctggtgcccccgaagcacagccccacctccctaacctgccctcctgtgactcccattgtgtatgaacttacctcctcgctcttcagcttcccctgcctgatggctccaggctgtcccctgaggacctggggttcgtgttgccctcctgggtggagtctgcgtccccctttcctggtcatttaagttgcgtggggccgggaggaggcgttctctgcccctacgtggctcacactgtggttctgtggccgccgtccctctgtccgctcggggtagccagcttcctctgactctttcttagggtgatgttgggcaccaccctcgcctgcagctcatcacctctggatggatcttgttaggtgtgtggcttttcccttagtttagaaaatgaaatcgccttattgctttgttcggttatgaaaatggaaagtttatttaaaaacgtagggtgcagaaaggtgtcagaaagtaagcagtcatctgaaatgacagtcaacggggctctgctgttaaggctttttggtgattgtttctggggatgccctagatgtgtgtgtttaaatacacatgtacagtacggaattctaaataaatgaactcacatgttttgttcactgctatgttttactcaacagtttgtcctaggtttttttttttcacatcaataaatataagcagagataattctaaaaaatttgtggaacgtttcagacacacacaaaggagagagattgtgctggtgcctcgtccctgtcacggacctgggtgactccctgccgggccagggtgatcattaagtagttattaaatattctgacatgtgtctctcagagatagtcattcactcttattgtcacataggcagcatttacatttctcaagttgtctcaaatttggaaagtttgtttgcattggagcctcgccccctccaggctgctggagtctggtctcgctgatgcgccctcacgtactccaccctgttgatgggctgccctggctgaatgttcatccttcgaaaccctcaaaggtgttgggtgttggggcctttgggagtgactagaattgagtgagggcacgcgggtgtagtcccccctgccctgttggatcagtgtcctgatagccagtccccacggcgagcctgcccttttcccaccttgcgaggcccaaggaggaggtagtaggtgcagcctggaagctggctctgccctgacctcccgcttccacatccaggaccgtgagagagaatccttgcacttagggctccaggactacgagagagaacccaggaccgtgagagagaacccaggaccatgagaaagaacccaggaccgtgaaagagaacccttgtgcttagggcttcaggactgccagagagaatccttgtatgtagggctccagaaccgtgagagagaacccaggactgtgataaagaatccttgcacgtagggctccaggaccatgagagagagcccaggaccgtgagagagaatccttgtatgtagggctccagaaccgtgagagagaacccaggactgtgagagagaatccttgcacgtagggctccaggaccatgagagagaacccaggaccgtgagagagaatccttgtatgtagggctccagagccgtgagagagaacccaggaccgtgagagagaatccttgcacgtagggctccaggaccgtgagagagaaccctcgtgcttagggctccaggaccatgagagagaaccctcacacatagggctccaggaccgcgatagagaactcaggaccgtgagagagaacccttgcacgtagggctccaggaccatgagagagaaccctcacacatagggctccaggaccgcgatagagaacccaggaccgtaagcgagaatccttgcacttagggctccaggactgtgagagagaacccttgcacatagggctccaggactgcaagagagaacccagaaccatgagagagaatccttgtacgtagggctccaggaccatgagacagaaccctcacgtggggatccaggaccgcgatagagaactcaggactgcaagagagaacccaggacccaggaccgtgagagagaatcctcgcacgtggggctccaggaccataagagagaacccttacacgtagagctccaggaccgtgatagagaactcaggatggtgagagagaatccttgcatgtagggctccaggaccatgagagagaaccctcacgtagggctccaggaccgcgatagagaacccaggaccgtgagagagaatccttgcacgtagggctacaggaccgtgagagacaaccctcacacgtagaactccaggaccgtgatagagaactcaggactgcaagagagaacccaggacccagaaccgtgagagagaatcctcgcacgtggggctccaggaccatgagacagaagccttgcacgtagggctccaggaccacgagagagaaccctcctgctcttcccacttgatgcttttgctcactcggagcgtgtttgtgagatgagccttcacgctgtcctggatcttctccagatgcgaggttcttttctgctgcatccctcctctgtggtggcaccatctcctcttgcctgaggtggggaggtgttggcctccgtagctgagaagggctgggcctggcggtcacccagcgtctcctgcctggacttagcaacttgaaccagcagcgtctgtcacctcctagtgcctgttaggagcccaggtccccgttcagcctgtcccgggcggccctggcctgtggtgccctgagttggtctgggcaggaccactttcaaattaactcacccggctgctggtgggatcccgctccttgtgggctgttggtgggggtgtgttcttgcactttgccttgtgggcccctgcgtagggcagctcgctggtggcttcctcagggtgagccagcaaggtcagagtcggtctcttgaggccaccctcaccctcaccaggctctggtgcttggtgggagcagggcagggcagcccacttgggggcccctgcagggccagggcactggaagggatggctagggccaccggaggtcgtccctgagctctggggttgtgtttgttcccaggtgtgctctccagggtccaggaggactcgtgggagctcgaggctggggtcccaggcccggccccagaggaagggcctgtggccaggtgcgcggaaggtgctggctatttgtggtgggcaacccaacagccaaaagggaggagcagagagagttctccgcaggagttgatgggggagcagacagagttacccgcaggagttgagggaggagcggatggagttacctgcaggagtcgagggaggagcggagagagctactccctctgtagctctgagaggaggacagagctactccctctgtagctctgagaggaggacagagctactccctctgtagccctgtagcggacagaggagggacggagctacccgcaggagtcgagggaggagcggacagagttacctgaaggagttcagggaggagtggatggagttacccacagcagtcgagggagaagcggatggagttacccgcaggagtcgagggaggagtggacagagttacccgcaggagttgagggaggagtggacggagttacccacaggagtcgagggaggagtggacggagttacccgcaggagctgagggaggagcggacggagttacctgcaggagtcgagggaggagtggactgagttacctgcaggagtcgagggaggagtggacagagttacccgcaggagttgagggaggagtggatggagttacctgcaggagtcgagaggggagcggatggagttctccgcacgagtcaaaggaggagcggagagagttctgtgcaggagtcccgtgctggggccaggagggtcctggtagcaggcggggcccatcccagctgctgtttatagagtggcctcttccccaggtctcttcattcattatgcagtttaatgtgcagtgcaagtgttttctgccctggggtctggcgcaggccactccagtcctcagggggatccctcagtgcagctgggtcactttcttctcagctctgcttacttttgaaattaagattgttccttgacacttttatggctgttgcgtaggcagagttgagtggctgtgacagagactgggtgaccctcaagcctgaatcatttgcagggtcccccctgagaagtgtgcggccctggcgtccctctctccagccctgccctgggcctggcttgtgaacctgtgatgtcgggactgcagggcccctgctgggccgttttcttaccaggcaaaattcctgcttcacagagttgatgccaggggtgtcaaatcttttgttttccctgggccacattggaagaagaattgtcttgggccacataaaatagaataacactaacaatagttgagctaaaaaaaaaaaaaaaacgtataatttacaaatttgtgttgggctgcatgcagaggtgtcctggaccacatgcagcctgcaggacacaggtcggataagcctggtttatactctagtggggagctgttagcaatggaaatggtcagttgttcagtagattagaaagtgcagagaagagcagggcagagaagggtgagacagcgtggggtccaggtgtatgccccacctggctgctgtgtgttgcttgctgaccccctcatgggccttcgagtgtaagggagagtcctcttcatgccctcgcaccctcctgggtctctagggcttgtgtgtccccaggggaggagccccctggacacaccctggcgggtgctggctggcaaagagggaggcgttgagggcccgggcagcgcctccatcctggccaggcaagtgcagcttcaggttgtgagaaccgtggtcacctgtgtgttttaaagatgacggcagtgataggtccccttttgggcctggcatggaaattagtcacattcgtagaccctgtcacagagtgggcactggtgatgtcatcttttatagttcttattttcaattgattcagctttttctagcagcatggcgtgttttacgaacgtgtgttttgctgttactgctgctactcatagtatggttttgtctaatgtaagacagaagagaataatctactgttatctccatgaagtacaaacacaaatacagttgaatatagtttttctaatagaaattaaggttagttttagccaaggagcacctttgctgttggcttatatgttaatgtgtttagcaccttgaggtgtccttactggcaggtagggttgcatcttgagtgtaaagatttaacaggaaaataagtccagtgcacatgtcttaaaattaatagcaatttcagcaatatgttaaaaacacgaagctaggccaggcgtggtagcttacacctgcttgagcccaggagttcgagaccagcctgggcagcgtaatgagacctcgtctctactacaaataaaaaaaaattagccaggcatggggtgcatgcctgtcccagctactttggaggctgaggtgaaaggatggcttgaaccgggaaggtcaaggctgcagtgagctgagatcttaccactgcaccctagcatgggtgacagagtaacagcctgtctcaaaaaaaaaaaaaaaaaaggcaaattaaactatttgtgttttggtggtgcttgttactgagttcctgtgggtcacagcccacaagaaatgcaaggaggacccacatgagggtctttcctacagctccttacatgctcaagctggtaattgtggtctagtagtagctactgaatatcaacccataagaatgacttcatattaaaaaaccacagaggctataattgggtctgtcttagtaagttctaaagtgtcagtagagacccagactcacacccacactcctaagggcaggacacaggggaggctgtggccttggatcctgtgtggctgaaatggggttgcctattcaggtgctgagtttgagatgggagctggcccctggcctggagagtggggacttgtgccgaggccactttgctgttgcccagcaggccagcgtgcaccccttgcgcatcctgttgacacgagcactgagcggacagacctcggctgtcctgttaacaggtcccacttagcagcctccgtttacagccagcccgggacctgcctggcaggacccctggtagttctgtgtcataggagcccctctttgttccaggccaaccaggacaggcggtcaccccacatacagggttctgaacgttctgacgttacagcgggggtctggtgctgttgtctcaggcaggaatggaggctgagggtctgcacgtttactgctgtgtgcaggccccgtcccaggagcgaggtggagcccatgtgaggaggttgtggtctttgtaaaggtgagcagcagcgagtcatgaactgcaagctcttggtaggttttggacgggacgtggctggctgagcttcctcttggctgtgtggagcctcagcagggcgttgtgtttgacggcaaatgggaattaaatcatggcatcgtcactgtcttttttagggacgatgctgcacttagttcttgcgactcttcctgttgtcagttggggcgggggggcgtcataacattctttcctgtccttgggggtcaccttccaggaaaggggtgggtgtcagagagtgagtgtggctttgaaaggctggtgttgagtgggatctcgtttttcaggtgatggtgccagtgatctttccgtgcggaactaagtttatgcagggttcaagatccattcaaagataaattcagtgacgacctggttgatgaaaagaaccacttttttttaatgttctagagaaaactctttaactgctgtattacttatctattgctgtgaaacagacaaatgtagtggcttaaaacaacaataagctgtcttctcccacacagcggctgtgggtcaggagtttgggagtggctcaattgggtgctgctgtcctggattctcatgcagttgcagttgagatgttgcccagctctgcaggcctcaaggccagggtctgggagtctgcttccaagatgtctcaccctcgcagcagtagcaggaggagccctcagcaccaggaccacctcagggccgcttgagtatcctcacaccgtggcaccagctttcgccagagggcagggagtgacctagcttcagaagttgccccttatttccatcctcctgggggtcacagaagtcagttcagggaggagaaggtggcacggtggtgagtgtctgcaggggatcctgtgggaaagcagcgcagtggtgagtgtccgcaggggatcctgtgggaaggcggtgcggtgatgagtgtccaaggcggcgcggtgatgagtgtccataggggatcctgtgggaaggcggcgcggtggtgagtgtccgcaggggatcctgtgggaaggcggcgtggtggtgagtgtccgcaggggatcctgtgggaaggcggcgcggtgatgagtgtccgcaggggatcctgtgggaaggcggtgcggtgatgagtgtccataggggatcctgtgggaaggcggcgtggtggtgagtgtctgcaggggatcctgtgggaaggcggcgcggtgatgagtgtccgcaggggatcctgtgggaaggcggtgcggtggttgagtgtccgcaggggagcctgttggaaggccgcgtggtggtgagtgtccgcaggggagcctgttctggttgcttgggctgctgtcacaagaatgccatgaccatgaactgggcagcttgtaaacaacaggaatccaccgctcacagctcgggagcctgggagtccaccatcaaggccctggtaggtttggtgtccagtgagaaccacttcttggctggtaaatagcgtcttcttgccgtgccctctcctggtggaagggccagggagcccctttatcagggcacatactccatccaggaggctgtgccttcatggcccagtcacttccaaataccgtcccaagcaggattaggaggaccacatgtgaagacgccgcacagccttcctggaggctgtgtgccccagccctgccatcagctgcctgctcccgctcacgtctccccagttcacctgcctccagtgctggtttatagaacatttgtgtgacttcttcagatgatctgtaaacagaggcagtctaggtggtgttttgttttctaatttcctttatggaaaggagagtttgcatttcccttgtgattttgacacacattgtattatgaaatattttcagtgtttgtcaaactcggtgtggggtaagcgcatcccaccaagataggcgcttacaggcagccaaggaacccaccgtgtggtttccttttaggttggatttcctgtcttacagcctcatgttcctagttggaaattaaggttgagactgtagccaggtgtgcatttattcatccgccagctctggagaggtctgctttagaggccctgcggccccagaagtcatgcctctgagtccgtggttcttagctgagggtggctttgcagtgtccggagatgattctggttgtcccacccagggtgaatgaaggctgaagatgccgccaaacaccctgcagggaggctggcccctgacagagccgtgcaggcggcagcggcagcactgttgctgcggctgagacagcgcagggcgtcattcatccccctgcctcctgagcccagagcttctccaggagaaagctgaggaaaggggccagccgtgagctgcgggtgcttgccagggatctggtgacacctgggcatgtggctggtggaaccagcaggccaaggctgtggattttgaagtgctgtctgccatttccactttcagaagcatgagttgcataaggaaggggaatgaaagggtttttcctggagcaaaatgatgcttgtggcagacacagttggaaccacagacgatgccacgcttgtgtcagcagtgcgacactggcccacgtgtcgtccttgttctctcctcattgctgccgtcactgtgtgctgcgcatgccctgcagttaccccagagctttatgtcacaacattgaggctggcggagaaagaccggccccttcaccccaccttagacttcctggaagggccgcccgggtccacaacctggcccgttaactccctgggcagctgctggggaggaagaagcactgcccgcaaggaggggctgtgccagtgggtggcggtgacgggggccagtggtttcctggacctgggtttcctgggtgtgggctactcagggattgctgagttcccatcccagccggagctgaccaccaagtcgacggggcagagtgagaaacatccaggccacctgtgccgcagcccccatggctgccgaggtctcccctgggcaggggcagttggtgttctcgcagggcctgtgttggtgcatatgaggagtgttttctgtgagcagcggtggaacatttacagacacgagcgtcacagtggctgggcaaggcccgtggctgagtgcacggtggccctgggcggggctcctctgttggggcctgacttgctggcatttcatggaggccgcaggcagccgctcttcctgggggtcttccacatgccctgcaggcatggggaggagcagcccccactctgtctctgcccatcaggctgcccccgccaacagaaaaaaggcactgtgccacccggggcagtgcgttcccagtgccagtccctggccctgtactttttagcaggcgctcatgctcatcctggtgagggagggcgatagacagggacagcggtgcaaaatggcttcagagcctgaaccacggttgccacaggctggggctggagtgcagacaccatacaggggaactgggcagagccctggctgtgcaggcgggagggcagtcatcctccacagctgggacttgctccgtcagacccccagcagggcttcctccagctccacgcacacggggctggagcatgctgcactcccacacagatgctcgagctgggcccaagcctgaccagccctggccgaggcccttgactcctggcctcacccaccacgccttaacctcctggctgtaacttcctggccttacccttctggccttacgcacctggctgttctctcctggctgacccaccttgtgtttaacttctcggtcttacccagtgtgcttgctttcacctccttggtcatagtcacctgaccttaacctactttgctgtagtgtcttggccttcatctcctgtgggttctagcccaccatagccacttggccgtgtgtacctggctcagccacctgtccagacccactcgcctttttctaactggccgtaccctcctgccctttctctcccaggcttaacgtctcggccttaccaacctggcctggatggtagtgccctcatggtgaccaggacatctagcgtctcacacctgtaacacactaatgggtgccagcacagagccacgcatgccggccttcaggcaccatcgttgaccgcacgtcatgcttttcctggtgtcgtatgtttgtgccagcgtagccctctgcggggcctgtgccggtgctgtgtcaggtgtggtggcctcagagcgcctcctgggtgcagtcaggttcttgctccacggctcttttccttgatattgcgtcacacgccgtctgtgggcccctgggggtggtggagccttgatcccagccccttggtgtggccagtgggatgcagcccccctgcacatcctacctcacctggctctgtgtgcaggtggtcaatgggacatccacccacctcccagcaagtcccacagccagggctgggacggtgcctgctggacagctagactcagaaagtgcagttggacccggttggaacggcagtagtgactgtcttttttttttagcgtcctaggatgtgaacttgccgtggtcctcgggcttacgggcagccctggctttcctcatcttctgtggggaagtggagttgtgaagatgcccaggaaattgcccagtggtcttgcagtggtcgtcttgctgggctttgagtcttggctgcctcccctgtgtcccctgactgttacctgggtggcaccagggggtcttggcgtctccttgttcccatggtgtgtcccctgactgttacctgggtggcaccagggggttgtggcgtctccttgttcccatggtgttatctacggaagggtgcattcgggtgcctttaccctcagcgaaggcagcaaccctcatcgctgccccccagccccactgcctgaggtgcgtggcctcctgggaccctgggtactcaagcatgctgccgtgtgtgtgctcacactcaggctgccacgcctgtgctgccagcacgccactcccagaggccgcccctccaaggcctcctcttgggatggcttttccttcgcagagcccggcctctggggactgacattttgttgggactaggaagagaataaaagatttccatggctttctggagaagcaggatgaggttgacagttctgataggagtcccccttaatgtgtcttgccgtgtggctgtaccattacgcgtgtgctcttgccgtgtggctgtactgtcatgtgtgtgcccctgctgtgtggctatactgtcatgtgtgtgcccctgctgtgtggctgtaccgttatgcgtgtgtgtcctgtgtggctgtagcatcactcatgtgcctctgccatgtggctgtaccatcacgtttgtgtgtgcttgctgtgtggctgtactgtcacgtgtgtgccctgacgtgtgactgtactgtcatgcgtgtgcccccaccgtgtgctgtaccatcacacgtgtgaccccgctgtgtggttgtgccatcatacgtgcccccactttgtggctgtgccatcacacatgtgcccccgctgtgtggctgtgccatcacgtgtgcccccgctgtgtggttgtgccatcacgtgtgcccccgctgtgtggttgtgccatcatacgtgcccctgctttgtggctgtgccatcacacatgtgcccccgctgtgtggctgtgccgtcacgtgtgtacccctgctttgtggctgtgccgtcacacgtgtgtccttgctgtgtggctgtactcttacctgtgccacacttaaatagaatgtgtttaacattctattgtgaacattttcctcatcattacaatcttgatttttcaagactgtgtggattctgtaagtcatggctaattcctggtggacggtgctgttttggccctgtaggtgccatggtgatagtgacattccttctccggacctggcgttctcctggttgttcctggagttgcttgcttaactgtggtccttctgcctttttatgacgttatttgatagaacccttgagggtggttttaaacacccctagtttcgtagcccttttagctgtcatatttattattgttttgttgctttccgcaggccggtctaattgaagccaacggagaactcaaggtcttcatagaccagaaccttagtcccgggaaaggtaagggcacctgttctggacacactcttgtgttgatgaatgcatgaagcttcacatgtttatgaagctgttgacgctgaagcctcttgctaatgatggcatctcctgcatgggcacctttgtgctccgggaacccaggagggtgggcgtaggagccttctagcatttagaacacagcctgcacacacaccagtagctttgtggattttgaattctaaggtatgtatactatttgcaaaagtttagaaaaggtagaatattgtaaagaagaaataaagatagtttgttttctctccacccaaagataatgacgtttcagctgtggtgtgggctcttccagaggccggcctcacctgtgctgtttgaggaaagatgggcctaccatggtgcatgccttctgcgaagcaggcacttgccacctttaacgcttcgcgtgtgtattttactagctcttgaggaagagccgtttttcttgtcttggggaatccaggggaggaagtcagctggagaggttgaagccacctcttccagggtcccacggttggtagtttccattttacacctcggagtggtgctgtggtttacgttcgtgaaggtgtgtgtgctcacctggttacttcctgggtaaactccttacctgtgctgggtcagggcacgccatttagaagctttgatgtgcgatgcttggcccctcgtgagaggctgtgctgtgtggatctgggattgcgtgcagggtagttcgttgtggtttgttgcgatattcctgggagacaagcttgtggaagagcttgctttgtcccaagacctgtctgcctgcagagcctagtgggtccactgagtgccctggtcgcaacatccacgtggtcgcatcagcccagggaggagcccagaggcctggatgtgtttccgttttgggttcctaaaaggaaccttaagatttttctaattattcccatatataaaattagctttttttactcttaacattgtgacccttgtaagtgacctctcagtgcttgccatggctctggggcgtgggagtgtggtgaccaggcccccacctctctgctgaggcttggccttgccacccgtccctttctgtccagtgctggtgcgggcgcccatggtgccatctgcctccaacccctacatgctgtggatccaggtgtctccttggggcctgtccctaggtcctgctctggtctcttccttgagagaacttggctttgtgacctgagccagcctgcagcctccccagcctcctgctgtccccgggccctgtcagagggaggtggtgggactggccctgctcttctgctgaagcaggtccttccctgccgcttttctaggaatagggaccaaatctacgcagcccttttgggattatttatgagctttttgtcttgatcatttgaggattcacagattgcttgagagaaatatcgttttagtgtaactaattgaacacttaaaagtggacaagttgcaggcgtgacattttctgttcaagtggtgaagcagaaataacaataaaaaagttcaccattttatttgcttggaaatgatgaagtctgttactatggtgttgaatttgaatttctcttgttaggttacatgcagtaggctttcttaccacatgtgggctgtctccttttccattcttactcacaaatctgtgcttgaatctgtaacaagtttaattgagctgaagagttgaattgcagggattaggaaggaacatattctgcattcatgacatagctgaaaatgttctggttttgagccggcccagcagggccgtgcatttcccctcagctcgccccgcgtgccccggcccccagatccctcccacatgagccttgggacggtcagttctttccctggatcgccggcagcagctcctggacctcccctgccctcacctggtgttgattccaccgcacagacggtggtttttgttgttgttgttttggagatggagtctcactctgtcgcccaggctggagtgcagtggcgccgtctcggctcactgcaacctctgcctcccggattcaagcgattctcctgcctcagcctccagagtagctgggattagaggtgcccaccaccatatccagctaattttgtatttttagtagagatggggtttcaccatgttggtcagactggtttcgaactcctgacatcatgatccgcccaccttggcctcccaaagtgctgggattacaggcgggagccactgcacccggccacacgtggttattttaaatttgcttttgaatcagtgacacgttcatgtttttaaattttgaagtatgaaaaggtgcagagaggtttccttttttcctcttctgtccatgcaggtgagcaccaatgttcacttccggtgttcgttccagagaattctgtttaacaaatagaatggtttgttggtgtttgcatgtgtctgtgtcaatatgtgtgcatgagtgtgtgtgaggaatgtgtgtgtcactgagtgtgcatacgagtgtgtgtgtgcatgagtgtgtgtgtgtatgcgtgaatgcgtgggtatgtgaggagtgtgtgtgcatgtgtgtctgcgtgaatgcgtgggtatgagtgtgtgtgtgcatgagtgtgtgtgtgtatgcgtgaatgcgtgggtatgtgaggagtgtgtgcatgagtgtgtctgtgtgtatgcgtgaatgcgtgggtgtgtgaggagtgcttatcagtgcattgtgcgtgtggagtgtctgtgcgtgtctgttcatgggttgcatatgtgttgagtgtgcatgtgtgttgagtgtgcatgagttgtgtgagtggatgtgagtgtacctgtgagtttgcgtgtgtgtgcatgcgtgtgagttgtgtgcgtgtgtgtgcatgtgaattgtgaggagtgcatatggagtgcatgtgttgtgagtgtgcatgagttcacgtgagttgtgtcagttgtgtgcgtgcgtttgtgagttgtgtgtgagatgtgtgttgtgtgcatgagttgtgtgcatgagatgtatgtgagttgtgtgcatatgcacgtgtgagttgagttgtgtgcatggagtgttatgtgcgtgtgcatgtgtgtgtgttgtgtgcatgagttgaatgagttgtatgtgtgtgttgtgtgcgagttgagtatgatgtgtgtgcgtgtgtgagttgagtgtgagttctgattgtgcgtgtgtgtgagttgtgtgtgtgtaagcgtgcagtcctcgcctccccaacagacacctgtcttcactagtgggccccccttgcctctagttgggagtggggtggtccaggcagggtcctcggcgcccttagatggagccgttgcagctgctttttgagttgccctcggcggtgccagtgagcaaggctctgccttcctccgtttgtgccctgggagcccagggcatggtcggtagcactttgagggctgtagaggcctcccttgagtcagaccttgaggaaggacaggagctgtccaggtgagagtggatcaggggaaggtagaggggaccagcccagccgaggctcctcatgggcccctggccctggtcctggtcctcccagctccactccacgtcacagcctcccggggccactgtgtctcttcctgctgctgctgtggggggcctgtgtccagttccccactgtgtcagcgttctctaaagtagcagccagtgagcgacgggaacctgggtggggactcactacaggacccacctagccatagtggggccgtcagggcggaacctgcagggtggttggtggtgaattccttttctgggaaaatgcaggtgttgctctgaaagccttcagtgggttagacgaggcccacctgcatcgagcacagtctcctttgcttaacggctcctctttgaggagctccgcggcaagttctcggctggcctttggctgaataatggatagagcaccgtcaggttgacacgtaaaactgactgtcacacccttcgaggcttagaaggctgctttccacccagagaaatgcaccaaactcgagacattttgcatccacaggctccccaaggatgggagtcccaatgtggaggtttggcaatacatcttacgtgggccattttagttgtggctgtttgggttgcctctgattgtttcctgagagcaaaatgctggtgtgaacatttgcacacacactttgtgtgtctggcagttccacttcctcaccagcatttggtagtggtgggtttttaggctttctgtgtcacaggtgggctcttactcatatcatgcctacggccccgcagtgctgataggagcttttcctctcgctttgcctggtccaccctgcccctgtctgagggtgacctggccccatggctgcctgcactctcctccctgatgtgtgcaatcctgcccggcctgtgcctcgtcctcagggaggccatccgggaggccacagctggcctggaagtgtgcttgtctgtctctacctcagggctgcttgtgcacctcctgtacctagaggtgatccaggctcactgagaatctgcccacactgttccacacgtttaggccaggtgcaggggctcacaccagaaatcccggtgctttgggagactgcagtgggaggattgcttgaggccaggagttcaagaccagtctgggcaacaacgggagaccccatctctataaaaaattttaaaaaaaagtagccaagcatggtggcgcatgtctatagatagtcccagctacttgggaggctggggcaggaggatcgcttgagcctgggaggtcgaggctgcagtgagttgtgattgtgccactgcactccagcctgagtgacagagccagaccctgtctcaaaatgagtaggctgggcatggtggctcaagcctgtatcccagcactttgggaggccgaggcaggtgtatcacctgaggtcaggagctcaagaccagcctagccaacatgatgaaaccacctctccactaaaaatataaaaattagtggggcgctgtggtacacgcctgtaatcccagctactcaggaggctgaggcaggagaatcacttgaaccctgtaggcggaggttgcagtgagctgagattgctccactgcactctagcctgggtgacagagtgagactctgtctccaaaaaaaaaaaaaaaaagagtaagtgtgtaagtgtacatttgagcgtgcactttcgcagctggtgcgtggagtgtctgtcctctccatgccgtgtggtggctcctgtctgtagtcactgggacccttccagtcacggtttcggtggctgcgttttgctaccttttgttatttgctgccgttttctcgtagagtgctcatgatttttaacatagtaaatccgtggagagcgctcaggtacagatcatggctgtgtgcagtgcaggctcaccgtctgcggcgccaggccgggtccctcgtttgctgctcatctgggagtgcccagcacatgtggccattgattatacatatcctcttagcccagaatgactgcttactaaagagcatctccctttgttgtgtctttactttcctcctgcttcaatctcatatctgtcggctttagggttctaagtggaggaggaaatttagcaatgatgtgtggtcagaagcttagtgttgcttacgtaattcctcactcgtgaccgtcgcctgtgaactaactgtgccccttgccccccgacacacgcactggtctttgtagagctgttaggaagggggttataggaagggagggtataagttttggttggcctcttcaaactgccagcctcctacaaaactgtcaggagaggccatcagctttttctctctttgtatttctctgtttttaacccgaaggatgttaaaagcccagcctctgtttttagcccagtcatgacatttctgtggccgtaacccttgttccaggtgtgagatggtgactcttggatgcagggtagcctcccagagctttgtgtgtttgtatagagaggtttgtgggagtgacttgagccgtgctgtgaacttggactagcacccgtgtgttctcaggagcgggtcctgctggaggcccagccacgtcaggcacagtaggtgtgtgatttgtgcaacggaggcctctgataactgccagagtagatagcttttgtgtgggagctgcctcagcctgcattccaggagctcaggtttcctgagtctgaatggagtctggagagagcaatgtctccatggagcgggtgcctggctgtggtcgcttaggcaggagcttcctcctcagtgctgacaacagagaagaacattctgttgtggccagtcaagtgtgcacaaatgctgcttgcgagccagtcacagaggcactcacatgcagagccgctcacctgcagagccgctcacctgcagaaccgttcacctgcagagcccttcacctgcagaaccgttcacctgcagagcccttcacctgcagaaccattcacctgcagagccgctcacctgcagaacccttcacctgcagagccgctcacctgcagagcccttcacctgcagaacccttcacctgcagagccgctcacctgcagagccgctcacctgcagagccgctcacctgcagagccgctcacctgcagagctgctcacctgcagaggggttgtgcttggccagataagcaaacaaaacatctccagcatggtgggcaaaatagtaactcttagacatctggctctgacaacgtaaagatgttaaaattgtttttcagaaaatacaaaactgtatggtttcataatttatcttaagccctatagatattaatagaataggattagtaatgataaaaacgtgaatactatatttagactcctttttctgttaatggattatagcaactgagaccatatatattcttaactagttttcttcccaagaaaggaattctccatttaaaatgctgtatataaaatgtttttaattagttcatttgaaaaacgctgtgtagtgccttttacagttgaaacaatattatttctattgagttggcttgtgggccatgtcttcatgtgactcagcttgtccctgaaatgttagccctcctccctcccatgcatagattgtgtggcagtcttatcaagaaaatgtgtggaacactctactctacttatattgccagattaaaactaaatgattggctgggcgtggtggctcacacctgtagtcccagcactttgagaggccaaggcgggtggatcgcttgaactcaggagttcaagaccagtctgggtgatgtggcgaaactctgtctctacaaaaaatacaaaaattagccgggtatggttgtgcgagcctgtagtaccagctacttgggaggctgaggtgggaggatcccttgaaccgggaggtggaggttgcagtgagctgagattctacaactgcactccagcctgggtgacagagtgagaccctgtctcaaaaacaacaactactactactaattgaaataacattctatcctgaggtggacaaaaaaagtggtggggagcggcagcctggctgccactggtgcgtctggcctggaatgaccacttggggagctgggtggactctgggacagcggccgctgggacccgggcttccctggtggcaggtgtgccgaggaaaacacacagcatgtggttcagtaataacaaacagcattttcatatgacatctgtgttcatatgaccactttattataatggcatagcataacagcatttaaggaaatcagcctgacggctctatgtatgggtaaatctgaaacacaatgttggcagaattgcagaatgcgagccatataatatttgtctgtgtttcagacgcacacaaaaacaatcatttatagccttaggttcagcacatcctggaaaagtatgaaaaataaagtgagtacgtccctgcaggccctgggagttgcacacagggcagactcggggggaggctgaggatcctggggactgtaattttatttctgctctttatgtctctatgaaacttgaagcaagtatgatgataacagtgaattttaagtgtactggaataaaattgtcatgttattgtttgtatttgaaaagtttctcagtgaatagaaacaagaagcccggctgggcgtagtggctaacacctgtaatcccagcactttgggaggccgaggcaggcggatcaccagaggtcaggcgttcaagaccagcctggccaacatggtgaaacccttctctactaaaaatacaaaagttagccagtgtggtggcaggtgcctgtagtcccagctactcaggaggctgaggcaggggaatcgctggaacgcgggaggcggagcttgcagtgagccgagatcatgtcactgccctccagcctgggcgacacagtgagactccatctcaaaaaaaaaacaaaaaaaaaaaaaaaaaaagaagaagcccacccacccaggtctggccccagaagccactgccactgccctttccagcctgtacgtctgggtgtgggtctgagatgtattcagggaggggccttgctgctcgctgtggtcgggtggctgtgcaagctcagcccctatctccaggcccttctgaagtgctgctcggggccggacagggggtattcaccctcagcctcaggatttctttcttctccctgttactgatgtacgtaccctgccctctgtcccgtagagactcagctggtgacccaggggtgctgctgggttggtgtggtgtgccactcagaggtcctctgttggtttgtgtctaggctgggaggggccctctgtgcttggcaaggccttgggctccgaaaccctttacctgcagctggtgtgggggctcagactccaggtggacagcaggagtgagtggggaagctcaggggccctggatgtctgcctgcattcactcatcctgccctgggtaccagaggagggaccctcttccctctgtgtgtttgtctcccccttcctaattgtgaaaacccttagcgacccaccccagcctcacggtgctggcctctggcccagagggagagacctggttggaaggacagatggtgtaggcaggccagccggccggcctgtgggtggagcagatggagggcaggccggatgccccgagggtctcagctacactgctgtcccacagccccaccaccacctgaatccctgagtcctacccacactccctgatggggcaggaaaggggagccccagactgggatgcctgagtgtatgctacctgtggtgctggtggacgggcgccgtggcctggctgttcaggacggaaagagccgcctgggctgctgatggagagtgacagtgccactggcttttgtgaactcagaggtctgtttctttcttcacatttattgaaattagagactcgtttgcaaattttaaaagatgttatctttgtaatgaatcaactacatattcttgaaaactgagtgtttactcatctgtatgtgaatctgaaaagtgtttaattgcgtactttaaatcattccctgcatagtagaatattatttttgcttttaaaatgcctttccctggtaagtattacaccgtgtatatgtgcatccaatcatcactggtacatttcgaatatgtacaatctttacttttcaattgaatattctgaaaatacctttcacatatataaaacaataaaaaagtaaatatttgcttttcttaggatgcacacctttatttttggaagaaaatttcccaaagcagatcatcttattttagttccagaagagaattttaaatatgtgctgacattggttggtaaaaatactaatatttaacccagttgaatcaaaaggcaaatgtctttttaatcacttcctaatgatctgtcttggccaacttaggttattaagagaaattactaagtgtccttatgtagcacaaaattcattgtttaatatattttaaagaaatgcataaaaagcagtagatgttttaaaaatgcatgggttgtaaagggccccaaaatgaaacttcagatcgcaaaggcaatgtattcgaaagtctcaccgatgattcatgagtcattttggtgctaactggtgggaatgaagggagatgcctgtggggaggtccagggtcctgcagctctgcggatgggcggccgtccggggaggcccaaggtgtggcgagatcggggagttcttctttcctgatgttgttgtgacccgaaagtctgtgttttcttcacctgagagtatcatgtattttcaaatggggggctatccgctcagctcccccagccgtggggtggggtgtgggtggcaagccacccaggtgccgaggcaagagaccgaggacacgagctgttccagtataataaaatataaaacaagaatggttattccagatatagatcttagatatgattatatatgaatatcattaatcattagtttgtagcaattactctttattccaatattacaataatcctcactctacaatcataacccaggaaaaaccaggccatacagagataggagctgaggggacatagtgaggagtgaccagaagacgagtgcgagccttctgttatgcccggacagggccaccagagggctccttggtctagcggtaacgccagcgtctgggaagatgtccgttgccaggtggactgtggtctagcggtagcctcagtgtcacggaaaaacagcggctacttagcagaccgggaaagggagtttagagaagactctgttcctccacctcttgtggagggcctgacatgagtcaggctcgcctgcagttatctggaggcctaaccgtctccctgtgatgctgtgcttcagtggtcacgctcctagtccaccttcatgttccatcctgtacacctggctctgccttctagatagcagtagtaaattagtgaaagtactaaaagtctctgatatgcagaaataatggcgtaagctgtctttctctttgcctcctctctctctctgcctcggctgccaggcagggaagggccccctgtccagtggacgcgtgacccacatggccttacctgtgattggagatggcttactctccttatctttcccttttgtcttgtatccaataaatatcagtgcagcctggcattcggggccactaccggtctctgcgacttggtggtagtggtcccccgggcccagctgccttttcttttatctctttgtcttgtgtctttacttctacactctctcgtctccgcacacggggagaaacccaccgaccctgtggggccggtccctacagtggggcactgcgagccccttgctgcctctgtgtggccgcccacccttccagtgttgccctgacgcccctcccgggctgtgctgaccacccaggcctcccaacttgtttcccagggtgctcgctaccacctggtttacggtttctttgtttagttctctctgcccgctgatgccagtttttgaactttatcattactacttctgtttatgtgtaaatgttccaggacttttatccaccgccctgtccctaggaccttttgcataccgctgttggaagacagaggcttcacatctcctgcagaggggtctcccgcttgcttcaccagtgttctgagggcacctgcatgtttagagccgcagcctctgtggaaggcacactccttcctaggaacaaatgtggttctccttcctaaggaaaagtggattatcagatttccaaactagttttgcagccttatagagaaatgttgcgataaaaattctagttttaaaattctgttccataattgtcatagaatcacagacttttccaggccgtggtccccaccagcacgttccatagcagacatcgccgaggggctggagcagtggatgatctgcctgggtcacctgggtggcgtcagcgcggccctgcggccctccccttacgggtttacattgggaatcaagcttcatggaggtgttgctcttgagccctggatttgagacagtacacgtggggaaagctaagcatctctaattgcaagcaccgtcttgcatttagaatggtcgcttgtagccttaacttagaaaaggagtctcgcccttgacctggtgtccttgtgttgcaggcgtggtgtccctcgtggccgttcacccctccaccgtcaacccgctcgggaagcagctcttgccaaaaacctttggacagtccaatgtcaacattgcccagcaagtggtaagcctcccgcaggagcggacagccgggatctcggtgtgaggtcgggatcggatgagccgtgtggttggggatgttcccaggtgtgcctggatttgggctccagttgcagcatggggcctttccctcatcagggagcccgtggccagtgctagattttccatagccctctgcagctgcccacgtgttgttgtgggagaggtgatggcgcccacagcactcctgtgtgccccagcccatgccatccttccagtaactggagggtggtgggtggggccgcggccccaaccagaggcagcttccttttagtgtcagagctcgaagctcttcatctaacaggggcttcttacgtgatgtggccgagcgttggctgtggccctcctggagacatcaggctgggaagccagagagggatagggccctggccgtggctgtgcgtttgccccggggcagtgacagggcagatgctgctcccttggccacgcacaggagaggggaaggtgggcattgggaagtggcgcatcccccctccccaggctgatgctggccaactgatgctgcttctcataatgctgtttcctgtctcgtgtccgccctctgcgtccttgccggtggcagcctactggagacagggagcccacacagaatcctgacctcaccagaaatggggccccaggcacttggtgggcaggtttggctgtgactggagctggtggtgagggacatagccatcccaaggctaggccgggcttccagtccttcctcagggacttgtttatggtgcctgagggctccttcctggtcctgagatgatgctgtggccccgcctgggcagctgccccagccctgttcctgccaaccctgggctttggtgatgcagcacctcttgcaccccggcctcctggcccactccaccccctcaccctgctccgtctgtgctgtggcccagtcctcttaaaaggattgaacacctccgggtgggatgagaacctgtccgttcactgtcaccaggtgtctctcaggcatacccaggtgtcctcacgtgtctctcgggtgtcctcaggtgtctcccaggcatcctcacgtgtccccaggtgtccccaagtatctctcaggcatccccaggtgtcctcacgtgtctctcaggtgtcctcaggtatctctcacatgtccccacgtgtctctcagggtgtctctcaggtgtcctcaggtgtctctcagggtgtctctcacgtgtcctcaggtgtctctcagggtatctctcacgtgtcctcaggtgtctctcagggtatctctcacatgtcctcaggtgtgtctcagggtatctctcacatgtcttcaggtgtctctcagggtgtctctcacatgtcctcaggtgtctctcagggtatctctcacatgtcctcaggtgtctctcagggtatctctcacatgtcctcacgtgtctctcaggtgtctctcaggatatctctcacatgtcctcaggtgtctctcagggtatctctcacatgtcctcaggtgtttctcaggtgtctctcacgtgtcctcaggtgtttctcaggtgtctctcacgtgtcctcaggtgtttctcaggtgtctctcacgtgtcctccggtgtctctcacttgtcctcaggtgtttctcaggtgtctctcacatgtccccaggtgtctctcagggtatctctcacatgtcctcaggtgtctctcacgtgtcctcaggtgtctctcacgtgtcctcaggtgtttctcaggtgtctctcacgtgtcctcaggtgtctctcacgtgtcctcaggtgtctctcacgtgtcctcaggtgtctctcacgtgtcctcaggtgtctctcaggtgtctctcacgtgtcctcaggtgtctctcaggtgtctctcacgtgtcctcaggtgtctctcacttgtcctcagctgtttctcaggtgtctctcacatgtccccaggtgtctctcagggtatctctcacatgtcctcaggtgtctctcacgtgtcctcaggtgtctctcacgtgtcctcacgtgtttctcaggcgtctctcacgtgtcctcaggcgtctctcacgtgtcctcaggcgtctctcacgtgtcctcaggcgtctcacgtgtcctcaggtgtctctcacgtgtcctcaggtgtctctcacatgtcctcaggtgtctctcacgtgtcctcaggtgtttctcaggtgtctctcacgtgttctcaggtgtctctcacgtgtcctcaggtgtttctcaggtgtctctcacgtgtcctcaggtgtctctcacgtgtcctcaggtgtttctcaggtgtctctcacgtgtcttcaggcgtctctcacgtgtcctcaggcgtctctcacgtgtcctcaggcgtctctcacgtgtcctcaggcgtctctcacgtgtcctcaggtgtctctcaggcgtctctcacatgtcttcaggcgtctctcacgtgtcctcaggcgtctctcacgtgtcctcaggcgtctctcacgtgtcctcaggcgtctctcacgtgtcctcaggtgtctcacgcgtcctcaggtgtctcacgcgtcctcaggtgtctctcacgcgtcctcaggtgtctctcacgcgtcctcaggtgtctctcacatgtcctcaggtgtctctcacgtgtcctcaggtgtttctcaggcgtctctcacgtgtcctcaggcgtctctcacgtgtcctcaggtgtctctcacgtgtcctcaggtgtctctcacgtgtcctcaggtgtctctcacgcgtcctcaggtgtctctcacatgtcctcaggtgtctctcacgtgtcctcaggtgtttctcaggtgtctctcacgtgtcctcaggtgtctctcacgtgtcctcaggtgtctctcaggtgtccccaggtgtctctcatggatccccaggcatcctcaggtgtccctggccctgtggagagctctctgtactgagctgttttttgttgtctagggcatctccctttggtctaatcatgttttcttcagagaacatgaccacataccagggatattttggtcatttttgcactttagtctttattttatatgcattcctgctatttccgtttatttaaatatgcttgaaattctctggattctttaacagatgttaggatatgagttttaagagagagtggcttgtgggtcacagccttgaggatctgagcaggattgccttccccgcgctcccttccccgcgtcccacttccctgcgccccgcttccccgcagcccccctccccgtgtgtgctcccacacagctgtcctgattgagcggttccagatcccaggcagcttttgtggccccgtttcctgcctgtggaaggtgacaaaaaacttgctctgcagaagttttgtggccattgaaagtagcggtttgtggaagccctaccacgtcatacggcttttcaaccacgttgcacagcagatcacggcttttcagtaaatgccattttgataaaagctaaaaattcagtttttgttttgcttgataattagattataggtttgcttataagttgactaggaattctaagtttgattttataggtgctgtgtgtcatagcagagtttgtctgggtgaataattgtagcaccactttcgtctttactgccggtgtgaatacactggggggaaacgaatgagaagattatcttattgatgtgctttaaacttcgtcactgaaagtcaagttcctgatttaaattcagctgttcgggtggagtttgtcattgctgttttgtgctttgcaaaatcccagtgatgggaattaaagctgacaaagggcaaatgtttcttaaacctttttatataccagaggtttacaaaaaactggactggctcattctgacacgaggggtggggctcagtccgggcatgtgagtgaaagcggtggggaggtccttaggtctctgacctgcaccagtcagcaggcgcagggcttgtcaaggtcagggtcttttgaggtgcggatgcttgtgaagcctgtggtgctgcagagctcagcacgcgcacaggaacgtgtgcgggacagaggacatatgtgctcagccggcaggagcagcggcctgtgtgagcccctggggagaagcagccccccacccaggcctgtgtcccagaagtcggcatctgtggtcgcagtggcctttcctttgcagctgcgccactggccctgtctctctggacaccgcggttaaccttggtccatctctaggattctgtgtctgagtggggtcacactacacggagacatcgtaatctcagtttttagagtgtgtgaaattaaggtgcaaaaagtgtgcacttagggcagaagggatgccttaaatcaggagtccccaacccctgggcctgttaggaagctggccgcacagccgcctgagccctgcctcctgtcagatcccagcattaggttctcaggagcgcaaaccccactgtgaacggcacatgcaggatctaggtggcactccgtatgagaatcgaatgcctgatgatctgaggtgggacagtttcttcccgaaactacccccgactccggtctgtggaaaaactgtcttccacaaaactggtccctgataccaaaaaggtgggggatcgctgctttaaacaccaaggctcactgtgcagccagtgaggaggggagctcctgggggaggagggttggtctcgggcaaggtggacctccggcaggtcctctactgtgggatgcttccacctggagctgttttctaacgactgctggcgtggaagctgcaaaagctttagagtcgaaagactgtgtctgaagccgtgtaaagactgtctggagccgtgtaaagactgtgtctgaagctgtgtaaagactatgtctggagccgtgtaaagactgtgtctgaagccgtgtaaagactgtgtctgaagccgtgtaaagactgtctggagccgtgtaaagactgtctggagccgtgtagagactgtgtctgaagccgtgtaaagactgtgtctggagccgtgtaaagactgtgtctggagccatgtagactgtgtctgaagccatgtcatttactttctctgaagcgcagcttggattccagccgtgagcacagtaggaagggagaccccttatgacctgtggggcctgggtcacctcccctgctccccagcgagaggcgggtgagggagtcgtgagggcggagcccatcctccagagaagccgctgttaaatctaaggggtgggtgtccctggcgcctttcagcccctgcctgcctcctgctcccagaggctcctggatctcctggaaagccctggttggagtgggacccacagcctcccagctttgggcagtacccctcattgtgctgtgaccacttctcccttccagggtctctgcccaccactccagctagcgtggccactgcttccaatacctcctttttttccctaggggcccagctctgaactatccttcccggcactgtcccatccaccctttggcacctccttggttcctgttttccctgcgcttctgcccacacacgccctccagggcttcagtgtgttgccgtgcctcctctggctgttgagtgtggctcctggtgtagggaagtgaggccgggggcctgctccatgtctgttgaatgggagactggaaggcgtcctgtggcacaggcggccggcccgagttcaccggcttcctgtgcaccaggaaggaaacgcacacacctgtgccaggtccgggagcaaagcctctgtctcgttcctgggagggctggctccaggccgcccctgtgatgctgactcagctcacagggctggtgagcagcaggtgatgggtgaggagcagggacagtgctgcggagacacagtgaggggagctgccacgcagggcacgcagaggaaggtgcaggcacccttgcccagcactgcatgggccggatgccgcggggccttccgcagggagcagttaaagcaggagagtaaggagagcttcctgtaagacctggcctccgtaaacaacgcattcccagtgcactggtggctcgttctcagggtgcccctgggtgctgagtcctgtcttccaggaaaggttgttggtgagcaccattgagcacctggtgtgtacctgcctctggctttctcttcttcccaacttacagtgggtttgacctgtgattttgactttaagatggtccaaaagcaacatgcattcagtggaaactgcttccactgcccatacgaccgtcctatttttcattttgagtgtggtattcagtgggtctcctgggatacccacacttgactagagtgggctttgtgtgagatgcttctgcccgactgggctaacatgcgtgatctgagcacgtgtaaggtaggctggctaagctgtgatgtgtggtaggagaggtggatgacgtgcatttcgacttagggtattttcagctcatgcgggtttatcgggatgttccttgtaagttcctcgttgtaagtcagttcctcgttgtaagtccactctttgtgagtaggtttgctcctgcctggaggacagcggcacggtgacggcatctgttttggggccaagatccagtgccttgcgtggtcctgggattcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatctgctgaactcaacgtaggaagccgtgcggggccagcgcgctctcaggcagcctgagtggcagggtccttttgtcagctgtttggatctcccacgtggcccagtgccccagcagcacacacacacacacacacacacacacgcgtattgaacaaaacaagtttcacaggacatttatccacgcccaggagatttatcttttgtatggcttcattttgcagaaaattcacttgtttgatttcatggcctggtgatccacagaaggccgcactctgatgagtctctgatcatcggagagatgagtgtcaatgaaaagatcagtccttgaaatgtttttcttctccggagctgacaggtgatctggcctagggataattggaaagtgtccccgtcagctgctcccagggccaccgcaggtgatgcatttatccccgtaagaaggggagctgggggggcccagcttagagtagctcagggcatcggccacatgaagcccccccgccagcatacaggtgtccagctccaatccctttaacggaaactgcatgtccatacaagcagtataatcgctgaggcactttgatttgtggtgaattgaatgatttaacatttactgagaaatagtgtttccagtttagatagagtcgtgccacaagatctttgaaaagtcagagttgtatttgcctgtatgagggtgtccaggtattcacactcgaacattcattgttggaactaaagtggtaagaccttgtcaagagtcagaccagccagcatgtccctgaagggagagacagttgttgacaccctcaggtgtgctgtggggtggggcgggtgggtcagtgtccacactggcgttgcctctggtggttccccccagaggggcccaggtgtgtgagccccaggggcgtgtggagcccctaccttccgcccccagtgctggtggccctccctccttgcctgacgccgttgtgggtgcaggggttcccccagacagggccccagggcacagggttaccaggtgatggctgtcaccctgctgggctggaggagcagctgctgtcaccctgcctgtgcttttgtcttttgagagctgtttttggtttgtttcaggcctctttttagtaccacagaaggatacaatttcatcctcatccatatcactaaaaggaagtaaaagggtgaagggaaaaatggaagcgtgctcaagtgccctgtgtggaattctgtgccgcccccttcattaaacttgaccgttagcgccttgtgtgcggtttgggggtcacgctctgccctgtcctgttcttgcttgcttgggtcgtccgaagtttcttgttgcttttgtctaattggagaagatgcctgtgactgacaagaggaagatgagccacattcagaaccggtggggtgatgccgtcaccgtgacaaaagcgtccaccgctggacgtttttcctgctccgtcatggctgctcactgtggttaaggaaattcagcagtggctgcggatagcgaacagatggtgggcatggcaccctcgccgtgtgggaggggactgactgtctgaattgtctttttcgactgtaggtaattggtacgcctcagagaccggcagcgtcaaacaccctggtggtaggaagcccacacacccccagcactcactttgcctctcagaaccagccttccgactcctcaccttggtctgccgggtgagcacttccctctggacccttagagttgtaggactgcttgcggttcgcacctccacgttctcctgggccacgtgtgtcacacagtcgtgcgatggggctcccacgcgcgttgacgccagcctccgaatcacactcacccatcatcgtggcctgcacaggtgtgcagccgaggcgcactgcctcggtcatggagaagtcgggctgggcaccgcccaccccgctttgtgtctggtgtagtgggtgctctctgaagggctggcagctcttggccaagacggggagaagctggcctcgtactcgccacaggacctcggagactttccctcgtctgtgctgggagcatgtgggatggatttcacccactgcccctgaattcagcctctactgcccctggggttacggcccccgcgggtggtcccgccagagctgctccttccactaaagcaagatctgatgagctgtgtctttccttaaaaacacacacacgcaaagctgcaaaagcctgcctgtgttggtgcccaaagcttcaccagctaggaacctcaggtggcctttcccgccatgtggggactgaccagagtgtacagagttgggctttccctcgacctgaagcacacttagtgctttgcacctgttgtcaagcggctgtcacagcccaagctgtatgaaattacagcctgctgaaattagtcctaagaattcccaaatttacactgaaacgtcccatagttcctgattctggctgccctctttagaaaagtggtgcttggggctcacgcctgtaatcctagaggccgaggccagcagatcacgagttcaagagattgagaccatcctggccaacgtggtgcaaccccgtctctattaaaaatacaaaaaaattagccagatgtggtggcacgtgcctgtaatcccagctactcgggaggctgaggcaggagaatcgcttgaacccaggaggtggaggttgcagtgagccgagatggcgccaccgcactccagcccacgacagagcgagactccgtctcaaaaaagaaaaaacaacaacaaaaagaaaagtggtgcttggtgtaccggcacatctcccatatgctgatttgggtcctggggacgcctcccgttttccctgacgcttggaaggttagaggtgcagcctgctggggagacactcgctttctgacctgcaggaccactgggcctgggggctggggctagggggtcctggcctgctcacgtgttggatctgctgcgcccgtgggacgtggcccctttttgtgcagctcattagagctctcaggtaaaagcattcctcgattcaggctgatcctcaggagggctgacagtcgcttctcttttcctttgtattttgaaggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagtaagtgtgtgccgggggccgagaggctggggtggcggagcccagcggtgtggtacgtttcgctcttttaatatcgggaacagttaaaaccatacagaaaatgccaagtacagcataaaagaatttttaccaaacgagtcagtaagtgtgtgccggggccgagaggctggggtggcggagcccagcggtgtggtacgtttcgctcttttaatatcgggaacagttaaaaccatacagaaaatgccaagtacagcataaaagaatttttccgatccatttgctggcacgatgctttgtcaactccagtgagtgagcacgtgggctggctctgcacgtctagcggcccagaaatgcacaaatgcccacctcaccagctgggctcgacacccgagagcccccggctctccttctggaacacactcaggcttcgcacagccccgtcttgccctgcgtcatctgtggggtgggagcgctccctgagggcatgttggggtggcggctccgtgagcggggtgcccctttgagccagtgcccatggtctacagtttaaggatccaccggcctttttggatcatttggaaactccactccctgtcatccccaggcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtgccccttcagccttccttcaaccttgatttcccttcaagtccgtgtagatgttttagtcgtcggtcactcagaagggtctgggctccgtgcccttatgctctctgtgtccggctggcagacggtcatgcagacgtctccctgcgtttctcagtcttggctgtcaggggagggagcatggttggcccagacccactagagtctgttaaactctagtgtaggttaattctgaatcctagtttgtgggatttttgttttctttttagataccatagttaaatccaagaaatgagaggaaaggggagaaggtatagtttagaaatggaaaaaaaactcacctatatcttgtagcacctgctatgtctagatttgtccatatcccttcgattacattctgggtaaacataggtaacactgtgaggatgtgaggatgtgggttttaaaaaacgctctgtggaacagttgtgatgattcttcacatgggtggtttgtttttgaaggtggaaagacagaggagacttgaaagaataaaacagaaacagtctcaacttcaagaacttattctacaggtaagagaatacgtatctgtggaggcagggtaatttttattttactaatttagctttataacggcaacatactgccttgggttacactcctgcatggcaaatcaaatgactgctctaagattctgagtgtgagttcatctcataggtgttgaacgtgggccttattcccagagcgaggttgtgcacgtgcgtgtgcatgcatgtgtgtgtgcgtgcatgcatgcatgtgtgtgtgtgtgcatgtgcctgtgtgcgtgcgtgcgtgtgcctgtgtgcgtgtgcatgtgtgtgcgtgcatgtgcctgtgtgcgtgtgtgtgtgtgcatgtgtgcatacatgtgtatgtgtgtatctctcgtcacagcatctaaataggcaaaagacagatggagggatgacttcatgcaaaagcaacatttgaaaaatctcctcagaggtgcttaacccaaggcccaggtgccaggcaaggcctgtaaaactgtggtggacacagtgcacctgggtcttgacagtgctgatcagggccctggagctggccttccccacctcccattgagtgctgagggtgggcggcaccactgggggccccgtgtctggtgtggagggggttgtgtgcaaggtgctcactgcagagctggctgctgccctgaccaaggtgtgctcgagccctcccagaggggacggtgtggcagccgtggtgatggaggctcgtgggcaggagctcctcaggacccacagagtgtcaggagggacagtcctggttgccagtgccttaggacctgccaggtggggatagacccagggtggccgggagaggaagggaatctcctggctctacattaatagcaaagaaggtctctccaagtggaacacttggtttggggccctgaggccctggccctggattcagccttgcagggcctattcccccagaggagcacccctgcagcacatgggcccttctgcgttccactttccagggtgggcaaagtccacggcacggcaccccctccaaggccatcaccctgtaggtgccatggtggtaggtggtcttagaggggtgaaggacagcaaggaatcgacttccaaaattggtgttttgttgagcgccgttgccgtggaggacacttttatcagggcacggatggctgtgcgcccgctttcccttagttctcccctcaggatcccgtttcctgagcgcttttctccctgggctgcagaggtcagcacccagcggccggcgctggcatttcagatgtccaggccaactcctcgctgtcacgtggacgcagggagggctgtgaggacccctcgagcacaggggctgcgttcttgtgccgccacgggccacctggctcctcttattttttttagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaagtaggttgtgggcggggagctgttccctggtcacccatctcttttttagggagccgaccctgttggtattgtcactaggacaagttttaaatgttgtacaaatagcaaatgttgcacaaattgctgtccattggggggtggtgggaggctgccgccatgtggcagatggaaggtctctgttccgggagcgtgtgccttagggcatgtcctcctggggagaataggcctcgatttgcctctcatctcatttacttcagagtttataaattctgtgaggagacactgatgactgggaaccgggaagctgtgtgtggcggtcagcgggtcagccgtcctggctccaccccagtgtgtaccgtctccgctgggagaccctgtctttctgactgtgcctttccccttcagatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacaggtcagcaatgcccagacaacctggcgtggctgtgtgaggaatggcccccagcctccgacggtgccctcccctcccggctcgggatgtgtcttgctgagatcaggcccacgtgtgtagggccaggagcaaagacaaaggggctgtgagggggatgagggcaggggtgtggctggggtggggtccagccagtgccgtgacccactggatatgggggccttgagtccacaggtggctcgtgtggatttcctatgtggtttgtgtgaggaggtgctaagtcaggattttaccctccaagtaggcccagaagtagaagttgagattctttgagaagtgcagttggattgctgatcccacccactgatggtagctgattggtcactagggcaaagtcaccaagaaaaagcatttcagagtcattggcgtcctgctccggagggccgggagcacaggagcttttgttgaaggagctttttttctgttctggtgaattctttccttgggggccgtagggtcccagccactgacagcaggatggctttaaggtgagaaattgtgaaggtgtcatatctgctgatccttctcttgttagcctaaacttggggtgtagatttattccctgagagggtcagagattcctccctgagctcttagactgccccagatcttgtgaaaatctggctggtccatgttgtcaggtgacagtgggctctggccgcccacgtgggctgggccctgaccccggcctctgtcccgtgcttcatggagctgccaggatgggctgtgggaagagggtttcagcttgacactttgattcggttccgtttcacgatgggtatgatactgaggcagcagcacacgtgtgccgtttgtaagtcagtgtgtgcaggtatttattgcaaggctgttcttgcctttttagagaagacaggcttatgtgactgcacagcgggatgtcctgctccgtggcgcagtgtggaaaatactggacaagcgaaggatatccggaagcttctacagccgtctgtcctgtggaactgcgcgtcattttgttggttgcctgtgcgtcttgtgttgtttctgtttcatgaccattcgcttattttctttcccttttcagaaatggctcagggaactgttggaggcgtgttcatcacgacggcaggttccacgtctaacggcacaaggttctctgccaggtgacagtcgttgagggtgtgggagaggcgtcatctgggcctcccccggggtccaggggccaaggcagggcagccgtctcaggtgtggccatcaggtctgtggctgctctgacgtggcttgtctgtccaggcagtggggccccgctggctttccctgtgtggagagctgcttttcttagttggtttctgctcactaaaaactgaaagtaatacatggtggtttttttttcatagtatcacctaataagtaaagtaggaatgaaaaccacccaaatcctcctgtccccggcagcccaagtaacagcaagtatttccaggttttttttcccatttttcagaacgcgtctgcggtcacagcgcacgtatttttcagaacgcgtctgcggtctgggcgcaagtagttttcagaacgtgtctgcgatcacagcacacatttttcagaacgcatctgcggtcatggtgcatgtgtttttcagaatgcatctatggtcatagcgcatgtatttttcagaacgtctgccatcacggcgcacgtgtttttcagaacgcgtctgcggtctcggcgcacgtgctgcgatcacagtgcatgtatttttgcgaacgcgtctgtgattatggtacacgtatttttcagaacgcgtctgcaatcacagcgcacgtatttttcagaacgcgtctgtggtcacagcacacatattttgttccgtgcatttttcagcttacattttattgtatgaatatatattgtttctatgctattaaagggcctttatttaaataaatttgtatttaatctttgacctgcaatcccacagagtagaatggtgtccctaggtattgatcttagtgcttcaaagataaatataacttttatggtaaatattaacaaaacaatgattttattaacttttatattgcattgtgatacaatatatagtattactttatattaatcttaagtgttaataaaatctttaattagaaatacaagaactcagtaacctatgggtccgggtaacagggctcgacatagtgagtttcagtgtgcttgagcctgcgttgggatgtgctgtggccatgagatgtaacaggtgtgtcgggcacgtgtagcttcctggccagctctggaagtgcaaagccagccttggcctcctcacctgtaaggtgagactggtgattgatgagttactgatctgtggcaaggatcagtgaggtggtgatggaagaaaggactttggtgacaagcttttgacagaggccggttctccttctgttgtagctatgtgtgaacgtgtggcggtcagtctgtaaacatgtttaatgctgcttcttccatgaggtgggatgtgggtatttttaggacttttatcatcacataatcctttttatggatgtgattcttcagacttgtcagtttttcataacaatggaaacaaagctattaccatttcttacgaaataccgattttcatagtggcatgatgagacattttatacaagtacctcatgaaaggacatctaggtagttcccagttagaataaaaactgcagtgagcagctttacagctgaatttctcgccatttctgacttgtttccaagatacagaattacttcatcaaaaggcacattaacacatttttattgtagtgttaataaataccattaaaatgtattaaaatatgtacatatggttttatgttaattgaaaacatctttaaacattaggaacgtagtgagctctggttggtggtaggtttttgtggtgctgccagccctctgggttctcagtccccgctgccagattcgacccacgctctggactccatcctgtcctgccccgggctctcttttttcctgttgctggttatgagtgaaagtcccggagggagggatctaatggttttacagtttgttccctctggggcactgctcctgatggaatgatgagtgagggagaggcagcgtgtggctctgctcagcctcctgtttctgtcgttatgggttccaggagacagggccagaagagaaccagacagagatggagtaagtgccagagcgttggcgtgctgtagtgcagacactcagcctccccgttctgtttgtgtgactgacaaaacccacacctgtggggcacagcctgtcatttgaccacaagccctgaggcggggggaggctgggtgggccgcctgcactgacggcgccatccgcctcctgccttgcagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaacaagctgtgtttctctaattcaggattattatctagaaatttgtctgtcttgttggttttactttatacttgagtgagaaagtaggttgttaggcccagacgcggtgggcccgggtggtccctgtgggtgcaaaccccaccaccacatgttgtctgaggcacatcctccgggagcccaccctgaaaaggtggaaggtggccaagggtggaggtcttggtggacacagggcaaagaggcaccttccttttcggtgcctgtggtgcagagaaagataagccaagttccttggccttttttcacaatgaaaattgagacaaaatttaaaagtttgactttgagaacaagaataagattgagaggattctgggaagatggtggaatagggagcaccaggaatctggctgcccaggtagatgtctacctcgcgggcaggatctgcctgatgcagctgttctgtaactacggaatctactgaaggcttaaagctttcaagggaggcttggtcagcacattgcagttaattttggtccatttcagctttctaccccgacctctgttccttcatttttctctttccccttttgggagccagacattgaagactaggacgtataaaaacaactgtgttgtatatatggggctgcccagggagaggctcagaaaagacccgagaagaccttacgtttacacctcaggctgaaccatggcacaggtacagcctagagctgtcaaaaaagcaataaacacagcaataacaaaaatggcaaatccgggggaacaggagacttcttttcagagttgtaccacagtaatagattcagatgtccagttttcaacaaacagtgacaaggcataccaagaaatggcaaagtatggcccatttaaagggaaaaaaataaaaacaaactgtccttgaaaaggatctgttggcaggtacactagacaaatacttttaaataactgtgttaaagatgctcacggaagccaaagaacatgtgcagaaagtcaagagaatgaaaatagaaccaaatgcaaggatcataatgaggcagacaacctgaaaaaccaacaagaaattctgtagctgaaaagtacagcaactgaaatgaaaaattcatcagagtgattcaaaggcagaagtagcaaatttgaagacaggacagtggaaataactgagtctgaggagcaaaaagagaaaagattgaagtgaacagagcctgtgggccctgcaggacaccatcaggctgaccagtgcacatgttgtggggtctatgaaggagaagagaaagaaaggggcagagagaatatttgaagataataatggctgaaaacgcaccaagtttaataaaagacatgaatataaacatccaagatgcaccatgaactccaaggaagataaactcagagatccacaccgagacacattataattaagctttcaaaagacagagaagaccttgaaagcagcagagtaggagcaattcatcacatacaaggggcccccaataaaattatccacagagttttcctcagaaactggaggccacaaagtagtgggccagtatattcaaactgctaaaagaaaaacaataaactaccaagaattctacaactgacaaaactgtccttcaaaagtgagggcgaaattaagacattcccagataaacaaaagctgaggaagtgtgctgccactagacctgccctgcaagatgtgatcttatatgcaggaaatctgaaagaatccacttagtttcagacactagaaaaaaatctaaacccatagcaagtagagggaaaacaatttaataaaaattagagcagagctaaaatcagagaacaaaaacaaaggagaaaatcaagaaaccgaaaagtgtgtttagatcaataaaaccgacaaacctttagttaggtatactaagaaagattgacattactaaaatcagaaatgaaaatggggacatttctactggctctacagaaataaaaaggattatgagagaataataggaacaattgtgtgtcaacatatttaaaaacctagatgaaatggacaaattcctagagacaaaacctacccagatttaataaaaataagtaaaaatctgaatagacctttgactagtaaggagattgaatcagtcctttaaaatctcactttggacctagtggcttccctggtgaattctgcgaaacatttgaagaataactaccagtcctcaagcttttctaaaaaatggaagaggtgggaatacattctgattctgtgaagccaccattactaccctgatatcaaagccaaagacaccacaagcacaaaataccaacatgcctgaggagcactgatgcagaaatcctcaacaaaatactggcagcgtatttcaaagatcatgcaacgtaaatgctagcagcgtatttagaagattgcacaccatgacctagggatttatttttagaatgcaaagatattttgacataacaaaattgatcattgtaatgcacacataaacggaatgaaagaaaaaatcatgatcatctcaatgttttattaacagcttttttttttttttaaattagggatggagtcttgctctgtcacccagggtggagtgcagtggcgtgatcatagctcactgcagtctaaaactcctgggctcaaactcccaccttatgctcccaagtaactagaactacaggtgtgtgccacaatgccaggctaattttttgattttgcacagatagggtctctgtgttgcccaggctggttttgaactcctggctcaagtgatcgtcccaccttggccccccaaagtgcttgaattacaggtgtgagccactgcgttcagctgtagtcattgcaagtgatgtacaaaaagtattttataaaattcaacatcttgttatggcaaaaagaacaaactaggaatagaaggaaactacttcagtatagttaatgccgtatatgaaaaactcaaagagaacaaacatcaaggtgaaagactgaaagtttttcctctaagataaggaacaaggcagagatggccaccctggccttttctattcaacatagtactggaagttctagtgaagcagttatgtgagaaaaataaatacaaggcattcgtatttgaaaggaagaagtaaagctatctccatttgttgatgtgatcttatatgcaggaaatctgaaagaatccactaaaaaacagaactaataaggttacaggttgtaaagtaaacaggaaaatcacttgtgtttctgtacactaacaatgaaaatatgaaaagggaattaagaaaataattccatttacaatagcatcaaaataatgaaatacttaggaattaacttggaggaggtgaaagacttaatacagtgaaaatgacaagacattgctaagaggaattaacaaatggaaacgcaccccatggctatatattggaacacagtattgttaagatgtcaacactacccaacttaatctgtaggttacatgcaatccctgtcaaagtcccagtgatttgtttttcagaaataaaaagtctcatcctaaaattcatacagaatctcaagtgacctcaaatagccccaacaatcttgaagagcaaagctggaggactcatacttttggtttcaaaactacaaatctgtaataatcaaaacagagcagtattggcataatgaaagacctacagactaaaggaatagaatagaaagcccagccaaacaccctcgcatatttggtcaagtgatttttttgacaagggagccaggaccatgcaatggggaaaggatggtctttttcacaaatggtattgggaaaactgattatccatgtgcaaacaaatgaggtgggacccttaacactgtttcagtgcaaagcttaattcaaaatgaacctaagatctgaatgtaaggcttaagactgtcaagctcttagaagaaaacagagtggccgattgtggtggctcactcccgtaatcccagcactttgcaggactgaggcgggtggatcacttgaggtcaggagtttgagaccagtgtgcttgaagccaaatgacgaaatcaagaactcagtaaaggtaaatatgtgcgcaactataaaagctagtattgtaagaggctagtattgtaaaagctaggtgaaaccccgtctctactaaaaatacacaaaactagcccagcgagatggcgtgaagtacacctgtaatcccagctactccggaggctgaggcaggagaatcatttgaacctgggaggcaggggttgcagtgagctgagatcgcaccactgcactccagcctgggtaacagagcgagactctgtctcaaaaaacaaaagaagaaaacagcagaagtttcatggcattggacttagcagtgatttttttggatatgacaccaaaggcacagggaaaaatagacaatgtggactttatgaaaatataaacctttcttgcatcagaagacaatgttgacagagtagaaagcccacagaatgggagaaaatgtgcacagcccctgtgtctggtaggggattaatatccaggatacatagagaactcttaaaactcaaaaaccaaacaacctgatttaaaaacaggcaagggcttgaataagcatttctccaaagaaaaatctatgaatgacttgtaagaacatgaaaaggggctcaacgtcactatcatgaaggcaacatagattaaactataaaatagaaaataaacattggcgaggatgtggagaaggcagagccctgtacacggtggggatgtaaagagccgcagccactatgaaaaaccaaatggctgtttttcacagaattaaaaacagaattaccctatgcccggcaattctgctcagcgtatacacccagagacatttgtacacccatgtctacacgtaccactattcagggtagctaaacagtggaggcacccgaagtgtccatccgtggatgagtggacaagcaaagtgtggtttgtacagacagcgaaatctttggaaggaaatcctgtcacactacaacacggatgccccttgaggacgttatactacgtgaaatatgcccgtcataaaatacttatatgaggtacttagagtcgtcgaatcatggagacaggaagttgaacggttgccaggagctgagggagaggggatggggagtgagtgttgaatgggacagaccttctctttggaaggatggaggggcctggaggtggatggcagtgacggctgcaggaccctgtgaatgtgcccagtgccaccaaactgcattaaaaatggttaagacagcagattttatattacatgtattttaccacaaaaaaaaaaaattggaaggacatagaaggtatgaaggagagctaagtgttttatttgagttggctaaatcaatcactgaaaattccaatagaagactagttttagaagaatcattttttcctaatcttgaattaccataagcatatcgagggttgtggaacttacataaaactacgggcagtcgtgcctcagagggctctgtgtgggtgcatgtgcagccagcacctgcgggtgcaccgtggcttcccgtggcgagcttcctgtgcctgtgtttcttccaggccttgggggttgaaactcagggctggtgattctgaagggtggggcaggagcagcccccggctttatcaggaaggggctctgatcgggcacgggggtgcccctgtgggtgggattgctggagcccaggacatcaaggccagcctgggcagcatagagagaccctgcctctgaagaaagagtggggctctggtgtccatggagagtctggggagggaggaagaggctagggttctgagggcctggagatgggggctctgggtggccatgggacacgtggcaggcgtgttgggttccagctgggttggctttgagagtctggtgggatgaaccctcatggctccaccgtcactttgaggtggtgtcacctctgacctctgaccttcagcatggcatgacctcgctgaggtgaccctggtgtcccacatatcaccctgagtgttcttaatacacagtcgagggctgtgttcattggactattctggtgtcaccgcccacttcatttctgtgcctggcagcacttttactcctggttgggagcatgaccgcctcccagttcagcttcctcctgcgtcccaagtgagcggggcggctgtcctcgaggactccgggctcacagccaacctgctggcacggctcgaggactccgggctcacagccaacctgctggcacggccgccctttcccgccctgcctcgggtgagccaaggacttgtcttctgcttcctgggttcctgaaagagctctcctctgatttctcaaaggcaaaataaaactcagatttaagtctttggtgcgtagcccctaatttccttccctttctctgaatcctcactgcccagcatgatggaccggcctgggctcaggacctgattccacaggctcccagccctcccacaggtaccgtgtcttctgtgctggtgtcgcacccgccggccaccgccaccctgcgtcttagacgtcccgccgcagctgtgtttccacctcatctccagcttgagtggcagccagcggcgccacctgcacacgagccccctccattcgagaagcacagactatgagtgtggccacgcgtcccatgacgtgaactcacgtctgcgccgagacctttgccggcggttttttactgacggagtaagcactggagatgcttggtacagcgtcttccatcggtaaattgatttagttaaccttacaacatatctgcaaggtttttaatctttcttccaagaccgtttctcatggacttttctgtgtgtctgttgggggctgacggacttcgacgcgccagtcgcttgtgcttggggccctttgggtactaacagccacactgctgagcatgtgaaatcaggacccaggctgcacaccgccgtcggggtgagacgcccgtggccttgcatgatgaaactgggacccaggcctcactgctgtctgggtgagaagtctgtggccttcagcaagagcaggtttgcttgtttgggagaatgttctcatttcagttttttgaaagggttagagctgctaacttaacatttatatttggaggagagacttgttcttggtgaacgagaagtgtgtttgtaactaactgggttttaaaccatcaggctgccgacacactcactccccactgtttgcctcccggagctgtgagcgtccttaggtgacaaccccacaccaacgtggtttttgtaattttcctgacttgcaatggagacttttagaaggagatttttaaggaagcgtttggtttttatttaatttctcccatatcaggaaacacgatttctttttttacatacaataagagtaactttaatatattttatgtttacaacttaggaattgcaattttaaaagcaagaattcagaatgtcattagtgtaagccgtgtttcatatcagtgcattagtagtttttatattaatgtggggggggcagttcatattgaagtgtagaaaaataaattatagtaagaaagtgatgtctacatagaagacgaatcgtttttatgacctggttaattagagagttgctgccttgcgttcccatggtagctggacattcttatagcagcaaattccatctaaaaactgtaagaattcaacaaggaagaactgatactcgcgagcaggtccttcagatgtgggcgcttctctggagttcgcacactgacaacaccgttgctccaaaccactttggggatgatttggcagggaactgacgggcaaggtaagcccaaccaggagggtgtccttgagcgaccccgcaggcgtgcccaggacccctgcgcaaaccgtttcacttctcaatcttgagtttgaactccactttcccttcatacgggtcgtggggattgttgaaggtcacgtgctccgccatgaccttgcacacgatggcgacctcagcgttcctggggatgttgaggagcttcgctgccaccagggggttgctgtagtggggctgaagtgggagtgaggaaaggacaggtgtttcaaaaatctctgaagttaaggagagaaaactaagcaaggaagtgtcaacagtcaggttggtgcagagaagcagctcttttgtgtaagactggccctgaccgagtgcatgccctggaatttgctgagataacaccccccatgtaaaaatggaaagcaactgtctggaggggacagacaataccaggagtaaattcagcttcaaactcttacgatgattaacgtaaaaatgaaacaggaaaagcacgtgatgtggaggaaagtcttcgaagtggatatgcagttgttttagaggatctgggaagtagaaaaattaggctgggcgcagtggctcatgcctgtaatcctagcactttgggagcctgaggcaggctgattgcttcagcccaggagttcaagaccaccctgggcaacatactgagaccctttctctataaaaaatacgaaaattagctgggcatgttggtgtgtgcctgtggtctcagctacttaggaggctgaggtgggaggatcacttgagcccaggtggttgaggctgcaatgagctaagatgctaagattgcattgctgcaatccaccctgggtgacagagcaagactgtctcaaaaaaaaaaaaaaaagttgaagagttagagttgtattttcatgttgcgtgagaggaatgtttccaggtagatacaagaacctgggcttgggaaacacgcagaacgttccagtcaggaccggctaagtcacacctttgtttcatttttctacatgaaggggcttattgctttcctttcgctaagtgtgagaggactcagcagctgtggtgagggaagcgtggaaggaaggaacctacctgggctttcttcccgtaataagggaagtagtgcagactgaaggtgccgttgggagggtagtacttgacctgcagcggctggccgagctcgcggggctggtcctggggaggagaggccactgcctgagtcaggcgggagctggtgtgtgccggtgtctgtgtgttgcgtttgtgtgcgtgtgtgcacacacgcgctgtgtaggtgcttgcataaacactttattgcatacttagcataaatcagatgcaatctttctaatcagtgctgagatctcagcaaggatatgatttgttagcatgcaaaatgcccagtgacccctccgtgtgcctctaacaacttgaaatgttggaaggatgacgcaggtgggtgaagctgggaggcggcttgcttgtctgtactcgagggtagccactgctcagtggcaagggctggtttgccaaaactgggttacaagttggtgtgagtggggcaagcgaatgcgtttttgtgagattggggccctctcgtttcagaagcagaggcttgcccagtgggtagctcagggtcatcaacgaacagctgaagggtgctttggatctgttagaatctcaggagccgcagtgtggcccaaataaattagaaaaggaaaagcaaatccccgcggcccccaccgagagtggaggcttcgagggaagtgaggttccctcggacaccctagtgggaaggctccacgcggtaatggaaccacgctgtgaaacctttgcctttgggtgtcatggtggaagcaaatcttagaagacatttaatttaaaaaattcagttttaaaaaatgttgacttaaaaagcagttttgaaaaacaacctggaattagcctgagatcgatgccaactcttagcagtctgtatactaaacacagttaaacaactgtagctgctggcaagctggaacctttttgtaaagaagcacataaaaaggacagaactggtggaaggtgcactggtctttccacatcgccaccaggcgttttgaagcgtgctgctgacacgctactcagatgcttctggaagccaaacaataagaaaaagccccattgtttcccttgctgggttttacccgccatggtggagctcgctgtggtgatggttcggtgtttacgtctggtttactgggccgacggctgacattcctggagagaaccaggtgggccgtgcccagcatgaaccagcacgaccctgacaagctcctttcctggggcagccctgcccgccgcgcggccgtactcaccaggaaggcgcagtccactctgggggccgagccgttgctggggaggaacttgacgatctagaagggaaaagcttgagcgtggccgctccccacccccaccgccatgtgaggtgcacggcacccacccatggagctgagatctggccggccccagcctgggctttctgaccaggactgagaagggcccttggtctggtttgcggcttcccttggaggaatccccataggtgtcactaactcatcattcagagccacagccctccccccacccacccatcagcaagccacttggcccaggcttcaggaggcggctggcaggaggcagagctggggcggggtggtcttagccctcgaaccatgtccaggtccggtggagcactgagacagagcacgggccggcctgcctcctgctctgcacagctcttccagaaaactctctctggcccacccgggccttcagcccccttccccacacctcttccctgggcttctccagccccagccatcccctgctgtgctccgagggtggcagctgccatgagacgggcacagtggccaccacgccctgctgggacccccgtcacagcccctccatgccggcagtgctgagaccctggctgacggggacccgtgaggtgtagagggcacaagcctgcagcctcttaagtggaaaaggaacagcacagctgcccggaggcccagcacagagctgctgattggtccatggagtggtggccccaagccctctgcttggccaggacctgccctgctcgagcctggctcagggatcacctccccacaccccctaaggggcccctggtcccaggttggaagcctctgctttagaaggtgctaaacccctcccaatcctgactccagaacttgaggcccctttacctggccctggcatctctggctgccctgaagggggccctggccttgcagagacccctgttcaaatgtttccacatgttttagagggccggctatgtgctggtgtctgacgagtggtttcaaatttgtatctaagaaccacacgggacaggtgcgtgccaaaccaaggtacagggtggtgaggctggagtccctgtcccgcttgggcaagccccagacaggacacctgtgctcctcgtggtgggtgtgggtgagaggccctgactgcactgttgtagtggcgtgtgaaggagaccctcagtactcaccctgttcattttaataataaaacatggctttccttcttcaaagccgaagttgggatccgccaggcctgagcagttctgcagcatatctgccgtgaacttgcaggagaacttggtgtggttgggagcgcggaaactctcctggaagaagtactgctcggaggtgcagttgatgctgtcctcctgggctgctggagagtagcctgcagacggacgcacctgccagccctgtcctgccctggccctgacgcctggctgccccccgggaaggccttgcaagccctgagtgcgagtttctcatgaaatagaaaaggccgaagctgtggagccgtttcacacctcacctgctgcttcacacctcacccacccgccgcttcacacctcacccacccgccgcttcacacctcacccacccgccgcttcacacctcacctgccgtttcacacctcacctgctaggaaggcgtggagagtctgtgtgaggtctgcccaggttctgttatcagagacgttgtagacaatttccaggcctttctccccgtaaacatccggccttaaggttacccctggagagagagacctttgtgcttagcgtctccaaatgctcaccacatttaagccatcagttctgaagtggctgaggatacgccagaggcggtggcccaacccaggagcctcctcggagtaaactgtctgcagcacaggaaggaaggacccccaggacagcacagtcagaatgcagcctgggtccctgctgggagttgccccggccctggaacctggctggctgccatggtggggggtggggggtggctggctctctccaccgggtgcctgctctgtgacaggtgatgactaatccagaggctgcacctgggtttctatgtaaaattgcatttgaacatgcattaaaaaaaatcttcactggttttggttaagaacaaaagcagtctaacaacatgttaactgtaaaactgaacatcaggatgcacacagcggggagtgaaacgcagagccgtcgactttcccgatgtgaaccgtcaaatgtgcatcctttgcacactttcctgtttctgtggaaacacagatgcagaaacgtgtgtttactgcaggtccttaggaacagcccgccatccacacaccactggcttcccagtggccacacacttccacttcccgtgcgattgggagcctctttttctgtcattttgtgtcaactcacctcattctttccataaatgtggtttcattgtgtgaagcctgcagtttgcttagttggtcccctatggatgcagctggctttacatttgaggctaggtgttgctgtttagtggattttgttaagagtaaaatctatacgtggtttaaaataaaaaccttcagcagggtctgagggaaaaggaggttctgcacttgctctgcacaccgatggggacgtctgtcctgtggcctctgacgactcggatgcctgttcctctgtccttgcaccctgctgatgtgtaggtgaccagcgggctcttttctgctggtctcccgggtgtgctccttggaaactgtttcctgtgcgtccttgcagaaacattccgtgtgcatatccaagcacaggaagtaagtggatggaaaaactttgtctctataacaaaacccttctgtttcataattaaaactaaagccaaagtcagattttataatttggagtcattttcctcatggaaagaaactaaggggccgcttatgccttggtgctgctcttaaagccggttcaggggccaggggctgccctcgggggcacctgctggggtgtgtggctcaccctggggctgccgggctggcttccctgggcttcatttctggggagggcacgggtcccccgggcgtctccagagccgaggaggcggcagcctggcctgtcacacggcatgggggcaacatcccgggcgcttacctggtgaccgtagctggtcttggtagtccggtgtgtacgggtccactgtctgcatcagcacatagaggcacagggcgaagagcccagtcatcaccacgtagaaggccacgtagtacaggctgatccacactgcgacacaaggcaggcacaaaatttaccacgtcagccattttaacgcacacaattcggtggccttgagcgcgtccgtgatgtggcgtgaccatcttccctacctagttccagaacattctcctcccccaaaacagaaaccccgtccccacaaacagtcactacaatcccctcccagcgccgcaccaccggccacgttctgcctctgggtttgcccgtctggacgtccacataggcagaatcctgcgacccgaggcagttgcacccagctgccttcactccagccgctgtttgagatgtggccgaggatgcgccaccaccccagctccagcaggaaccgagggccctctgaggggggagttatggttcccccatcacaggaagggaaactgaggcagagaggtggggtcctgcccatggtgacccatagtgcagcctggaagtgcatggccggtcctgcttccacaaagacatcaggaagagaaagggaggaagggaagccctggagatggctcttctcagaagcaagggtgtccataggcaccggcaactcagggtgcagcttcatctcatctgcttctgagaccctcctgtgagcttcccctgcagcgtcagaacctaacggaagccaccgtccccgtggccatgggcggctcctggacacaggcgactgcctgtgtgctgtcttcgtctctgtaaattagcttgtgtggatcgcaggaggcatttgcagggagacaccggcaggaagaggacggttttgtgtttgctacggcttttgtctttctggaaagtctgtaatgaactgggcctcctgctcctcctctccgctgatgtggcatggattctgcttagtgagccgttctccagtgacccaaaacacaaccaaagggcaggaccaagtcagagaagcaagggagtgcagggccaagaggccagagccctgagctgtgatgagaggctgtggcctgtggactgcctgccctcttctgtgagctgggacagcacagatctctgagccaggtcccttcagcaccagctgggctcagggctgggtcttgctcacctggcatccactttgagtccctcctttccccgccgggcgtccctggtgacggcgttcttgtgtggccacagcagcttggcttcagcctccggttttgagtttccagcttcagcagtgtggggcccgcagtggtggagggtttctgtcctgtcactggatcacgcctggtgcctccctggtgctggccctgcaggtcctgcctcagtgtccccaggtcactcctgatgtggcttctatttgacttggccgcctgtcccccggggacctacgctcgtgacggcaggggtctctgttcccccgctgtgggtcctgtgggtctgctctggggcccgtggtgcacagtggagatgtgggcggtgcgtgtctccccagtggctgctgacccactctgtggcgagtctcagctccaccaggcggctcagccctgcctcccgggtaggagcccgaggttggccaggctgggcccaggctcgggagggccatgctccctgcacttcctgggcccccgcttgcaccacggtgttcagggcacgctgcagtgcacaggggaggggttgggaggtgactgagagtcccattcccgccagctcctggggccggccgggtgcagctcactctgcctctcctgcacctgcacccgtcccccaattagtaagaataacgtgtcctattccttttgtttttgtcatttcacttgagttgtgttttcctggggccctaagactttcttatcccaaacggaggccatgtctaccggccaggcagtgagaccattccagaaggttctctgtggccctgcagccaggaggcggcacatgggagtctcagcatctagaatggcccaaaagatggggcttccaaggacctggccggcagcccccagcccagcccccgccctcagctccttccccatcctggcctcccgctctgccgccccgcctggcccaggaggcccttctgcccccggtccctgcctctctaggaacggggtatttgttctacttcaaatgcgcccatgactccagctggctctggtgccctttgagaccgtggagcctccagcgggggctgcagccttcaccagcactgtggtgagtgtgggggatttggcagcgtgtcacgggcattcccagcacgtctcagctacacacacaggtggggcgggcctggggctttgcattcccacctcggctctgggacccccagagccgggcaccgtgggaattgaggagggcctgaccttccctgggagccggggacggcaccaggccagccagttcagccgcatcccgacgcccaggggtcgcagggggaggtgggggcgcacaggtgcttcctccagactctctcataaggggtgagggcgtttcccggaacgggtgtggcagccctgatgtagacgcagacgcttccaccacctgtgtggccttggaggcccaggcatctgctttcctcccaggagggccaggctgcccgcgcctctgtgcagccacggggacaggaccctgcagggcagacctcgcacaaggcgcaggtgctgcaggctgaggcaggcctggtttactccccacctccgcatctggacgccagcgggtgtcccggaaaggggctggcagccgcgtctcggcagagccccttattcaggtcattgcgtgaatctgtgtgaccaaggaatcaccgttgccacctttcacgttattttcaaaatgattcactttagaaacatacttttaaaatgctgttctcagacatacggctgacatttggggccagtctgtggacgccctccaccggcgttctgcagctggggctccaggtcaactcagccttcaggatgctctggggaccctcgctttccctgggaggcaagtgaggccctggccgaagcccgtccacgccatccaggcagcatcggggtctcactgtcaggggccctctgctcccctcctcctgagctcacctggaggctgcgtcctcagagcggccccctccatgcacccagccggcccgccccccgcacgtaccccacctggacagggtgcggcccagcatctgccccgtgtccgggttccagcagtaacgctggaactcctccatgcgctggccacacgtcttcttctcctgcagagccgccatcgtccctggcctgagatcctcccgtctgctccctgcaccctctacgcccagactgaggccagatgcccacctctgggctttatagtttcctctgccagaggtcaaaggcatcgcaggcgaaggatcccagggagaggccagggccgtttatcagcgccggccatcgcctcaccaaacaccaggggctgggtgcagcccggctgttgcccctggggcgggccaggcccgctttcctcaccctgctgctcttgggacgcccttggctgcagctttgtctgctctgattgcggtgagggcacgttccggggtgagcagcactcacaggcccttccccttccctcctctccttcaggagggagattgaggtcagagcagagccggcctggacccactgtgtccacgaccttgggctgagccagctggggccgcatccctggcctgggagggcgtgaggcaggcgagtgaggggcgaccggctccctgggccccccgctgcggccgccccgattctgggtcacccagtggaagggtgagcctggcagctggagctgggttggcagggaacacaggggtccccggggactcctctgcctcccagattcacccagagcagcaatagcctcttagatccccagagggcagtggcaccgagggccctttaggatttttttgtgtccatggaggaattcataaacacaaacccctaaatctagtggtcctcaaaatgaagtgcacaggagccctgagcatctgttgaatgcagattcagcccagcgagtcctgtgggggccccagactgcatttctaacagtgctggtgggagggagtaaggcagggtccaggtgggggatgctcagcctgggcagtacctcggggtcaccgggggtccgggcagtgcactggggtcacagggccggggcagggaccatgaagtcatcactgcccacttccgcccggagattctgcctgagcctctcgcccatgggtccgagcaccaggacgtggagggctcccaggcagtcttgttgggcggcgcacttcagaaccccggctcagacgctttgctgttggagacaggggtcctggatggcagatgccattgctgcctgctggctgcagtgcccatctctgcaggaggttgatgggaatgcagggcaaatgaaatgtgctcaggggccttctgacaaatatgattcgaagtcgactagccctgtgtgtccagaattacatgcagagtttcccatactgtcaactctaggccgtccctctcagggacccgtgtaaccaaattcatttcttagaagaaacaaaattcctctaggcattacgctgctttaattttttaggataatttagagtttgcaaaataattgccctaaaattcaaatggaatgatgtcattttagcctggattcctatcatttcttttcttttttttaatttctaatttttatttcttttatttttttgtagagatggggtctccctatgttgcccagactggtttagaactcctgagttcaagggatcctcccacctcggcctcccaaagtgttaggattacaagcgtgagcccctgcgcccagccataatttcttaatggacctatccttcctttaacattgtacccatttctgactttggaatgttagggcgataagaacacagggtctggcagtaaaggccacagtctgattgttcacagactgtggccctgggaccccagagtgccaggggtctgacaacacctggatgcagcaactgttgtctgtgaagggtatagatgctcttgaaatgaacaaagtatgaattatttctaaacatctttgaatttagtcttcctaatgtagtctctgaatttccagaagcaggtacatgtgctgagctgtacacatgttatcagaatgaccttcttctggacacatacgtgtggggaggagggccagagaccttggtagagggcagtttccccacagcatgctctgaaaacatagaactaggtgctctatacaaattgggtgccagacaatgaggggggcccagaatcccacccacatctggcagccaccggtcacccctctctccccccatctgagtggtgtcagacacaacgtagtagaaagttaggactgtgaccaccacacagtgacaaggccacctcccactgtggtgtcagtggagaccatatggaaagccaggactgctacccacccacccaacagtcctcaggagcccacccaaaggttcccagtgggaaacctagacttctggccccacatggtgttaacaaggtgaagcctctcccttttgctgctgaagtggggtcagagaaagccagtaaaaagagaaggattaaataatatgaaaacgtctgggtttcagtagataaccactcatcacacaaagaacgaggacgattttaagatgaattaatacaaagctgggtgttttggctcatgcctgttatcccagagctttgggaggctggactgagaggatcgttttagaccaggagttccagaccagcctgggcatctctgctaaaaaattaaaaaattctaaaaatgaatttaaaaagacaatatatgccaacaccaaggtgacagagatgttaggattagctgccaaaaattttaaagcagccatgataaaaatgcttgaatagcaattacaaacaagcctgaaacaaatgaaaaactagaaagctgcaaaatatggaaagcaaactgatagaactaaaagtagacataaacacatccacaattatagttggagatctcaacactcctctcttaacaattgatagaacaaccaaatagaaaattagcatggatacggaagaactcaacatcatcaaccaacaggatgtcattgacattcgcagaatactcaacagagaatacacattctctttaagtccccatgaaatatatatcaagataagctgtatcttgggccataaaggaagtcttagcaaatttaaagaattcaaatcatacagagtatgttctccaatcacaatggaatcaaattagatattaataacaaagataacagaaaaacctccaaatatgaaacctgaacaacatacttctaatactcatgagtcaaaaaggaagtttcaagggaaatttaaaaatacatggaactgaatgaagaaaaaatacaccatataagaactcaagggacatagctaaagcagtattaagaggaaaatttatagcactaaaaatgcatattttagaaaagaggacaagtctcaaaaaccctaagctctcatctcacaaatgtagaaaaagaaaagcaagtaaaacaaagcaaaagcaagcaagcaaacaacagcagcaacaaaaacaagcagaaggaagaaattaaaagataagagcagaaaccaatgaacttgaaaatgcaaaagcaatagaaaggactagttctttgaaaatgtaaataaaattaataaacctgtagctagagagaaggctgagataactgatagcaggaataaaataggagctatcactacagaccctgcaaacatcaaaaagataaggaaggaaatacttgcgcaattctacatacataaactttacaacttagataatgggctgcttcatcaaaaatcacaactcacccgacttcaaatagataatgtaaatagcctataactattaaggaaactgaattaataatttaaaatctcccaataaagaaacctctaggcccagatgatttcatgggacaattctaccaaacacttaatagagaacaccaattcttcaccatcttttggaaaatagaagaagaggaaatattttccaactcatcttataagaccagtgttacctttataacaaaatcagacaaggatagttcaaaaaagagaactacagatcaatatccctcatgaatatagatgcaaaaaccataaataaaatttggtaagttgaatccaacaaagtataaaaagcaaatgccatgaccaagcgggatgtattccaggaatgcaaggctggttcagtattcaaaacccaatcagtgtgatccaccacattaacaggctgaagaaaaaccacacaatcatatcaatcagcaaagaaaaagcatttgatgaaattcagcttccatgtgacaaaagctctcagcaaaccaagagtagaaggaagcctgttcaacttgattaaaagcattgacaaaaaacccacagctaacagtatgcccaatggtgaaagatgaaacgttttttaccccaagaccgggaacaagcccctcatttttatccaacattgtactggaagttctagctagagcaatgaacaagaagaggaaataaaaagcatgaatatcagaaaggaagaaataaaactgtccttatttgcagataacatgaatgcttatgtagaaaatctcaaagaatccataacaaaactcctacagctgttaagtgagtttagcaaggtctcaggatatgagatgaaggtgcaaaaatccactgtacatctatatactagcaataggcatatggataccaaaattaaaaacacaataccatttatgattgctcaacaccaagaggaatatttaggtgttaataacaaaacatgtacaggacttgcatgctgaaacccatgtaatattgatgaaagaaattagagtttgaataaatggagacacacactatgtttgtagtgtggaagactcaacataacaaagagatcaatctccccaaattgatatagggtgcaacataattcctatcaaaatccagacacaatgtttttggtagatatatacaagattattctaaaatttatatagaaaagcaaaggaactagaataagtaaatattttcttgcatattttgaacatagggttttttaaacattttttgaaattttttttgaaaaacaagaataaaatgggaggactcagtctacccaatttcaaagcttattatgtagctgtggtgatcaagattgtatggtatggtcagagggagacacatagatcaatggaacagaagagaaaatccagaggtggacccacacaatatgtgcaactgatttctgacaaaggcgcaaaaggaattcaatgaagcaaaaataaccttttcaacaaacagtgctggagctattggatatccattggccaaagggggaggaaaaagaccttcaacctcttaaaccttctataaaaagtaacccaaagtggatatgaacgtaaatgtaaattgtaaaactataaaacttttaggaaaaatatgggagaaaatcttcaagatctggggctggacaacaccaaaagcacaatctataatatttatattcaacaaaatttaaaacttctgctctatgaaagcccatatagaaaggaggcaaagagaagctatcactgggagaggatattcgaaaaccgcatgtctgacaaaggactgctatctgatattgatagaatctcaaaactcatgacaggaaagcaaacaatccagttgttacatggtcaaaagatgtgaagagacatttcacccaagagcacgcacagatggcaatgcacacatggaaaggtgttcttccaccattagggaaatgtaaattacaaccgtaagggaatactccacacctaccaggagggccaaaacaagactgtggcagcgctaaactctggggaggatcctgaggaagaatctgctcaccatcgctggtgggaatgtaaaatggcacggccactccagaaaacagcttgccggtttcttcaaaactaaacgtgcaattacgacacttttaggcatttaccccagagaaatagaaacttctattcacacaaaggcctacacagatgtttatagcagctttatagctaaacactggaaacgatccagccgtccttcaaccggtgaacggcgaaacggactgtggcactctcctctgtggagcacaccacagagacgaggagggaatggctgacacctgggaacagtgctgagtgagaaatgcaggtcctgaaaggctacatagtgtctgactccattcatgtgacgtgcttagagaagtcgtggttgccgggcattgagcagggcgggctgggggaacttcggtgcatctgtgagcagcacaggagggtcccgtggatggaggcggcctctgtctcagccatatggatgccaatatcctcgctacttggcaagatgtcatcattacaggagacagagttaagggtacacaggatctctctggattgtttcttaacatggcatgtaaatccacaattatcacagaataaagagtttaattaaaaagggattttcagggccaaatgaatttgggaaacgacatactttacttctctttgagagacacgttcactctgaaatcactgaataaaccctgtgatggacacgtttcacatatttttaactttgcttgtttaacatatttaactttatttaaccgaacgcttcccaacatgactgcaggtggaacggcccccagtccaacaggaagccatcctcctcagaccctacgcctccacagcatcagcaccacctgtgagcttgttacaggtgcagtcttggcccacctggccactgaagcagactctttattccagcaaggtctccgggcgattcatgtgtgtagctgtttgaggcatgaaccaggacaggcagcgagacgtcagcagagacggctacacttcacaaagcaccacagttgccccattgggtgagcaggcaggaaggagttaacgtgatccgcccaaggtcactgctgtgaagggcagggctgggcccgtgcagggctcctggtgaacgatgggatatcactcacctcaaatatttactcgtgatccacctgccaaagccctcaggagaccgtggggacgtcggctcggtctgcgggccctcgcttcggcctctgtagaccctgccaggtgcagcccccagtgccctcccacagttgcctcttctcccacgtggaatggggtgggctgacagtctccacctctctatgctccggcattcttcctttctgcgaccctttgcttcctccctgtgtgagctggaaccaatcccctgctgaattcctcctcattcttctccaaacctttattgagtacctactgtgtgctggaataagacaggcagggccatgccctcatgaagctgacaatcctattggtgtgaccatccccaggtgtgtcccaggtgtgttgcaggtgtgtccgaggtatgccccagctgtcccaggtgtgccccagctgtctcagatgtgccccagctgtcccaggtgtgtcacagctgcattgcaggtgtgccccagttgcattccatgtgtgctccaagtgtgtaccagctgtcccaggtgtgtctcaggtgtgccccagctgtatcccaggtgtgcctcagctgtcttaggtgtgtctcaggtgcatcccaggtgtgtctcagatgtgccccagctgtcccaggtgtgccccagctgtcccaggtgtgccccagctgtctccagtgtgtcccagctgtgccccaggtgtgtgtcctaggtgtgcctcagctgtctcaggtgtgccccaggcatatcccaggtgtgccccagctgtcccaggtgtgtcctacgtgtgcaccagctgtatcccaggtgtgccccaggtgtgtctcagatgggtcccaagtgttccccaactgcatttcaggtgtctcaggtgtgcccaagctgtcccaggtgtgtccaagatgtgccccaggtgtgtctcaggtgggtctcaagtgccccagctgcatttcaggtgtctcaggtgtgccccccagtgcatcccaggtgtgtcccaggtgtgccccaggtgcatcccaggtgtgtcccaggtgtgccccagctgtctcaggtgtctcaggtgtgccccaggcatatcccaggtgtgcctcagctctcccaggtgtgtcctacatgtgcaccagctgtatctcaggtgtgtctcaggtgtgccccagatgtgcccccggtgtgtctcaggtgggtcccaagtgttccccagctgcatttcaagtgtctcaggtgtgccccaggtgtgcccccgctgtcccaggtgtgtccaagatgtaccccaggtgtgtcccagctgtcccaagtgtgtctcaggtgtgccccaggtgtgttccaggtgttccccagctgtcccagctgtcccaggtctcaggtgtgccccaggtgtgttccaggtgttcaccagctgtcccagctgtcccaggtctcaggtgtgccccaggtatgttgcaggtgttccccagctgtcccagctgtcccaggtgtgtcccaggtgttccccaggtgtgtcccagctgtcccaggtgtgtcccagatgtgccccaggtgtaccccaggtgtttctcaggtggattccaggtgtgtcccaggtgagccccagctgtattccatatgcgtccctctgagtggggccttggtttgatgtagctccggggatcttctgctccctggtcctggtgtcaccagcaactgcctcttgacaatcctgccttgcctgcaaaccccaggtgagaagaagacaaatgactgggaactgacccctcagtaagcgctggtggtctcacctacagacccccaggaagctggtcactgtgggcttcttttcctctctaaattcctattatcaggtggttttctttctcatttgctattttcttaaaaataaaaatagggaaaaacagcctttgtaaattacggtttcttccggctccatcctctccgtcaggcccacatcccaaggaaacagcaggcttgagcctggctgctgaagccaggggctggatggagcagctcagaacagagctttgagtgcctctccagccaggggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccgggctcccaggggcttcccagtggtccccaggaaccctcgacagggccagggcgtctctctcgtccagcaagggcagggacgggccacaggccaagggcagcagtcaggcctgctctgtctgtgaacgctcccggcttggcctcggctgatgggccctcacgcctgaagcgggcaggaagctccgggatggatttcgggtctttggagaccgtggtggccaactctgccttcatcgccgcccgaggcagctttgacggcagcagctcccaaccctcccgggacaagaagtacctggccaagctcaagctgcccccgctgtccaagtgtgagtccctccgcgacagcctcagcctggagtttgagagtgtgtgcttggagcagcccatcggcaagaagctctttcagcagttcctacaatcggcagagaagcacctgccggccctggagctctggaaagacatcgaggactatgacacggcagacaatgacctccagccacagaaggcccagaccatcctggcccagtacctggacccccaggccaaactcttctgcagcttcctggatgaggggatagtggcgaagtttaaggaggggcctgtggagatccaggacgggctcttccagcccctgctgcaggccaccctggcacacctgggccaagcccccttccaggagtacctgggcagcctgtacttcctgaggttcctgcagtggaagtggctggaagcccagcccatgggggaggactggttcctggacttcagggtcctagggaaagggggcttcggggaggtgtcggcctgccagatgaaggcgaccggcaagctgtatgcctgcaagaagctgaacaagaagcggctgaagaagaggaagggctaccaggtgagcagcgcgacccggccagcagggatggggtggcagggtgcagggatggggcggcagggtgcagagggcccccaggtcactgtcggctccggggcccttaacagctggtgcctaagggagcatgcatgccagcctcgccacgtgggcgccccgcggccgtgcggttacgagcagttccagtccatgtgcagaagtccctcctcggagagtgacctccacatttttgggtggggacgtgccacgttcactcgtcggtttttcaccaaccacagactagcctcaagtgtgggggaaagaggacctctcaggggaggctgaagaggggcagggtctccggattctttgccatgactgtggaagactttccagggccctggctcctctgatcgcagcgaatgcaggaggaactgaggcaggacggaggcagcctcgctctgatgacagtttctgtgaggcagagcctggcgtgacgccgggggcaggaactgttcccctgagtgtgctgtcctcgggggtgggagtgagcgacgggcacgcaggccgctctaagtttcatccgctctgcccactggcgtcagactgtgcatctggggcaggatcagcagaagctgcttacaggtcttaagggtgaggggcagcggctgtgccgggtgtggacgtgatctcctgagccagccccctgcactttgactccacgtggctcctggcccctctcccaccacgcagctgtgttgagtgcacaggaagctcttagggttaagcagcagccactgtgcaccctggctctgcggaacctcaaccctcagtgaaggtgaaataccaggtgctcacagcgctgggcggaggccctggaacatctgcgtgttctcgccgtggaactcggggcgagtaactatgctgtgtggttgtagcagtaatttttaaaaattagctttcttgacatctaattcccccaccgtgccattcacatctaactgtaaatttaacccaacattcagcctcttttcctgacttccgtcaccaaactgaactccatactgacatcaactgaacacctccccatgtaagtgcagaaaggggcctccgacatcaggaattccctcttcaaagagggatgtgctatccttatccagacacttacaaactcgttcaatggagcattgtgaggtttcaaaataaagacaaaatgaagcagagtggtgagggggtttgggaggtgctggtctgggagcccagcccacgggggcctggacaggagggagggctgtggctgcaggattgctgggcaggcggggctggcagggtcctcacccatgttgctcagccttggggcttgagcctccccttgccagaggctggcccagaagaccagaagtcccctgtatgtgaaggaattcacatgtctggttttctgaaatgggggtgcaggcatgttttgaagtcatttgcaattgctttgtgaaaggcgcatttaaagcatgtttgcgactgctccgtggctgtgtgcagtgggcgtggccgggtgcacacggtctctgcgatgcacctagtccctttcctattcaaagccagtgcgtactcagcgtctcacttttcagggtgctatggtggagaagaagattctgatgaaagtacacagcaggttcatcgtgtctctggcctatgcgtttgaaaccaaagccgacctctgtctggtgatgaccatcatgaacggaggtgacatcaggtaagggctgggccagagggcacgagggggccccgctgtcccactgggtcagggtttccagggcccgggctcctttccacaggcagagccatggtggccccaggcctgccctcgagggaagccttgcacccatcacaatccccttctcgctgttggttcctgaaacaatgcaccctggacccacatcggagcaggagcctgggaggcgcccaacctgacaatcagggctcgtcctgtgtgtggtcttggtgtgggtgtgggaggcacgtggtgctgtgggggacgtgtgatgcagtcggcggggcctctgcagggctgagggccttgcaccaggagggtaaatgaagacgaacttcaccagcgcccactcctagggctgaccctagagctggagacaagatcagtccagctgggggccgtgatcttgctgtccccaggcagagaggaggtggcgctgcctccacaaagtcctgccccggatctgccgctgagacaggccccaggcccgtgctggggatcagatcacaggctcgcttggtagctgggccgcttagccactgcgtgcttctgtttcctggtctgtaaaatggggagagataatatctgagtccagagactgtccggagattaagacaatacgtgtgaaatacctgcagtgtctgatgcccgtaaggttagcagtgggcaggggccatggctgtggctggcagcaccatgccccattctcacctgcttttaatttccaaggaaattcctccaggtgaggctggtggccccatttttcagatgagaaatgtgagtccagactaagtcaccacgcggagggggcactgggaagcgcagacacaggggtgtccaggcggaggggagggggcgctgggaaacgcagacacaggggtgcccaggcggaggggagggggcgctgggaaacgcagacacggggtgcccaggcggaggggagggggcgctgggaaacgcagacacgggggtgcccaggcggaggggaggggacattgggaagtgcacacacagggttgtccaggaggaggggaggggtgctaggaagcgcggtcacaggggtgcccagggagggcctggtggctctggccgccttgtggtccgcctggctccagggcctcctctcctgtttcctgtgacgatactcctggtgccacctcgtttaaattatttcttgtttaaatcatttcttttatttgttaggttttgcttctctgcaaaacctgtccgtggaaaacataagagatgatgttctatgggggaggaaagaggctgagaagaaacaccttactgcaaatctttcatgagtctgatgaacttggggcctgcggagctgcatcccacctcggcctcggcctggccccttcctgagacggtctgggctgtttcctagcacctgcggcccgcgctggaaagcaggcggacaggagacgcacgtggacagcactttctccctgttagcagttggggttcagggtccctgagctgctaacgccgccagccaccatggccttcgggtgtcctctgcagggacgtaggggggccaggcctcaaaacgaccagaacgctggccgagagacatggttctgaggccccagctctgtctttccatgattttactccccattaaacccggggtgcatggttcccacgtgtcttcccccaggtaccacatctacaacgtgaatgaggagaaccctggcttcccggagccgcgcgccctcttctacacggcgcagatcatctgcggcctggagcacctgcaccagaggcggatcgtctaccgcgacctcaagcccgagaacgtgctgctggacaatgacggtaggaggtgccctcggctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctaaaatggagacacaaaggattacccccctttattctggagctcaaaatatgcaacttcccaactactcccgcagataacgtcactacggtggaacctaagactggcctttgagatgtcttttcaggttttttgcaagtctgacaactgatttccccccctggaccggtcagcctccctggtgccacccagaagcgactcggggcacaaggaccatttcccacaccccgacgactgcacccccaaccagtcagcagcaagcgcccttgcctacccacccgactctcttcccctaaactagccttgagagaccctggtctctgcattttcagggaggctgatgtgagtaacaataaaactctagtgtcctgtttagccggctctgcgtgtgtaaaactgtttctctattgcagctctcgccactggccaggaaacggtttccccctcctcgggctgtgctgggaggaagggtctgaagtggcttgtaatgtcggaagcaaagtggaggacttgcccggaagagggaggaaggccttggctcctttgagccagtgggaatggaagggaaggcggccaggatttcctcaaaaatatttccccatagccggtcagctccccacggggccaataccgcatcctcactctgggcgcaaggacggccccttcccagagcccatttagaacttggatgaatgttctatcaacactcatggatgttgcctggatgaatgggctctatccgggccttgagtaggaagaagccgctggcagttacttgctcacccagagactccaagcagccacactcacctgggctgatgactcaattgactcctgagtttctccggctcttcattgaggtctgtcttttccacctccatctttgagcctctgaacttgatgaaaatcggttacatgtagatggcttttctgtccaatgctagagaactttgaacttaatggaatcctgccgtcttttcatcaactcagtgctaaacaactctagattttaaaatgatatccagtgtgactgcgtccatttcacatggcacaaggattgtctgtgatcacgattcataaagctgctattttttagctgacactaggcccaagcatggcccctgggggcacagggctgtttatttctcttttaaagcaccctaatctgggaggtgtattttgccggtggctggcgggctgggagcagagaaaagttcagtgtaaaaatgaaaatgcattcccggcaggaaaactcccaccctaagggcacgtatgcagtttaccccaaaacaatggttgccgtgggtaacccgagtggtgttgccagtggctgccagtttggcccttccagggagatgtcaagagaccccttctaccaatccctttcctcattaaagaggaagaatgtttgctttctgggagatatttaagaggacaatttgaaatcccacaaaagccagggttggtagaatcaggacttggctcagcccagctcagccccgcagcagctaccccgggctctgtttgtcctggcttccaccagggccagcgcttcacagccggaagcaaacaggccaagcatttcttggttaatagcacaagggggccaggcttgctggagaagcagcggtcagggccaggggcccctaacctctgcagtcgcccctcccagtggctttccagagctgttttccacctctccctgaggagctgaagggcgccgggggccgagtcactgccacagccgcagggaccaagccccatcccagcaaggctgaggcctcaggaaggcggccagcccaggccctctcgccactggccaggaaactgttccccccctcgggctgtgctgggaggaagggtctgaagtggcttgtaacgtcggaagcaaaatggagaacttgcccagaagagggaggaatgccttggctcctttgagccagtgggaatggaagggaagaaggccaggatttcctcaaaaatatttccctgtagccagtcagctccccacagggccaatacctcgtcctcactccgggtgcaaggacagccccttcccagagcccgtttagaacttgcttctcttcagactacattccctcctggctggattctggagaccataactggggcacctaccaagtggggcccgttagaggtgctggcggagttcccgtgtgaccccatcagggtggctcacagcacatctccgcagcgacacgctcaggtctggttttccagtgtgtatgcgtggagcccagcagtggggcccagatggcgtggtgaggatcaccactgaaaggcaggcctcgagcacttgcccagagtccactgtttggagggcagttcgattcaccgtagccaattagcccacagcacacacaatctttcttttcccattgagttgtcttggcaccttggttggaaagtaatttaccatgtatgtgtgggtctatttcctttatttgaaagtgatttttaaaaggaaaattgcaagaccccttcttctaattgtggccccacacccttgcccatgcatccgactcatctccatccatcctgtgtgtctggtagtttcataaaaagtcaaacacatacctgccattatgacccagcgattgtactcctgggcatttatcgcagagaaattaaaatgtatagtcacacaaacgatcatagcagctttatttggaacagcgaaaacctgggaacagccccattgtctgtcagcaggtgcgtgtccgacgcatcgtggtgcctccacaccacacaacgtgctcagcaacggagagaaacagactctgggagaaaactccatctcaaaggctgcattccgcactccgttcccataacactcttgaaaggatgagtgacgccggcgggtgctgtgggttagagaagggccccgcggggcacacctcacacctgtggggatggacggtcatgcatctcgaatgtggttgtggttacagaaatccacatatgcggccacacatcgcagaatctccacacggagtcgtacccagaataaaacaaacacacggaaacctaggatgtccaaatgagctccgtcatccagtgacttgcgtggtgcccatatcagtttcctggttttaagaatttgttgtagctctgcaaagtgctgcattgtaggaagctgaggaatggaatgtgggacccctctgtactattcggcaactttttgtgaagctataattagctcaaaatgcaaagctaaaattactgaggacttagaaataaacttgacaaaagatttacaagtcctatatactgagaactgagaaacatcaatgagaggaatgaaaaaaggcctaaataaatggagccatagcatgttcatggaagatgccaactctccccagattgatctccagaatcaacacaatcccaatcagaatcccagcaggatttttgtagaaattggtaagctaattctaaggtttatacagaaatgcacaggacttggagtaaccaaagcaagcataaaaaagaacagagttgaagaatttatattacttgattttaatcaagacagtcaatataatcattataacagataaataggtcaatgagacagaacaacacccaggcctactcatctatggccactactcatttatggccaattgacttttgataaatgtgctgaggcaattcaacagggagagaataaccttttccacaaggaatgctgggtcatttggacacccataagcaacaaaataaaacaattacaaatcctcaaaacccttacctcacaccacatacaacaattaactttgggctggatgcagtggctcacacctgtaatcccagcactttgggaagctgaggcaggtggatcatttgaggtcaggagttcaagaccagcctgggcaacatggtgaaactctgtttctactaaaaatacaaaaattttctgggcatggtggcatgtgcttgtaatcccagctactcaggagactgaggcatgaaaattgattgaacctgggaagtggaggttacagagagccaagaccacgccactgcactccagtgtggctgacagagcgagactccatctcaaaaaaaaaaattgtaataggtcataaatctaaatgtgtgaactaaaacagtaaaacttgtaagaagaagataagataaaatcatggtgacttttagtttgggaaaggttttttaaatagaacacaaaaagttcaaactacatgaaaaaaccaataagctaaattttattaatttaaaacttttgccctttaagagacactataaagaggcaagctgccaagctggagaaattatttgcaaaccatgttcaaaaaggacttctttctaaaacatgtcaagaagcctttcaacacaataatgagacaaaacaattcaattaaaaagtaggcaaaatatttgaatggatatttcaccaaagaagctatattaacagacagaagcacgcaagacgatgctgacaaccatttagtccttagggaagtgcaaacgaagaccagtatgagaggtgcctacaaacccaccagcatggctaacatgttcaaaagtggccctgccaagggctggcgaggatgtggggcaactggagcgcgcagcatgttggcaggatcataacacaagaaccacagggaacggttcggccatttcttaaaaagctacacagagtcaccatgtgacccagacatgtctgttctgggaacgtccacagaaagactgtgtcgtaaacgttcacaacaaccttgcctgtaatcaccaaaatccaaaacaacctgaacgtcctccacgggtcagtggatgaaccaattatgatacacccatgcaactagtgctccccagcattgaaaggatgaattgttggatgaatctcaaaataattacactgtgagacaatgtcaggcaataagagtatacacgctgtgttacccaggacagaaatgaattaatctacagtgacagaaaggtcagtgtcatcagaggagcaggagggtggagggacggggcaggggccagcctgggggaggggatgtccatggtctcgattgtggtcatggctctgtgggtgcagcagaatgtcaaaacttatcaaaccgtacgtcttaaatatgggcatttaattgcatgtcaaaaaaatctaaacaaagctgaaaatggacaaaataccacaaccaatgacatctgaccgtaaagagatggatttaggtagaaggaagaattctttaacacagaatatgggtctctgagggaaatgttatctcgtaattttctcacttttggtgtatttaagctgtaggacaaggagtgaaccctaacatttggtgagagtctgtgaaacacactaggaacccccatgctgcttgcgagttacttccgagaaacagcagaatgtcacaccctgtcacccgcaggtgccgtctgaggggcgctcatccccaccagcccgagggcctccccgccaagggaggggtgtactcccttccacttggcgtctgcttgtgcattgcccctccctgaactcaagacctgagcctctctcgcctggactatttggaaagtctacaaatggaagaaggggtgctctcactgagttgtgtccgcacaagggaaactgtccaggagccacagaagcaaccgcaaagtgagcctctcagacgtggttaaagggaagccaggcaaaaagactgcacgctgttgggtttcatttactcaaaaccctaaaacaggcagaatgagtcatctgtggtaaaccagcattggggttacctctgggggccgggagggaaccctggggtgccagtcacgtctggcgtctcggcctgggtggtggggatggctcgccaagcctgtttgttgcacacgtggcatgtcagcagaaacacggggcaaatacacacgtgaacacaagaaccccgggtccctccctcatctacccagcgaccctcagtcaccccagccggctccctctcgccacccacgggctttctgtggaggccccagcctggccctggaggccgtgacccaccccgcctcttgcctgaggtcagcccaagagaccttcctgtcttcggcctggagaaggagcggccgccaggaccacccgggcctcagctccctgggagggcccctggaggaccggggctgctaaagtccacgggcatcaccgcatctaatccaggccctttgatgtgggtgatgttgatactcccactttacaggtggggaaaccaaggcttcagcttccgtggccaggggatgaatgggagtgtggtctggatggtggctcctggaccggaagcatgatgggagccatgaggaatgcaggttcttgggtccttccagctctgctggattggatgctcgtgggggctcagggtcaacacaaccccccaggactctgacctgggaagtggagcagcctgatttggaggcgaggacacaccaggaggcaccttgccctgtggccactgcactgaggcttgagagatcactagagacagctcagcctcagtgctcccgcgcccccgcctcggtgctcctgcgcccccgcctcggtgctcctgcgcccccgcctcggtgctcctgcgcccccacctcggtgctcctccactcccaccccggtgctccttccacctctgcctcacccgatggactgtgcctttgcgtttcttgtgcacaaatcctgctgaagtctgggcagctgtgtgtttgatgatgggcttgtaggagagaagcatctggactgcgccgtgcagatggcgcttctctccaggcacagtcacattcctgggaggttcctggaggcctccgagcctcgtgcagacccaaggctgcctcaccaccatggccacagcccagtgctggctgccgggcatcaaatctgcagaaatgcacgtggcataaaagcaccagagacatccgtccagagccgagggctcctccctggcccaacattttgtccacgtaagtccactttttggctgctgctcccaggcctggcaagaacgcagatccccacagcctcctgctccctggcagcctgaggacagtgtcgtaggcctgggatcctcgggcagaactgaatgcagcttttccattggagggcgctgggcccacatggcaatcacaggtatggcagatgaactcacgggatgctccgggactccaggggcctcaggagaaaggcccactggcagcgggttgcccagggctccagaggggggctccaatgtgaaccagttgcttgtggcacagcgggtcacccaggatggccctgcgtggtcagtgataacaggcagtcactcacagcgcgacttcacccatggtcactcccggtgaccagcactgcacagcctgggctttcgtcccacatggcacctccctgtccagccttggcccaagtgcctgggaaacagacagggcaccgtgtgcctgaacacactcggacagtcgaggcccccaggagaagcaacaggcaatgactcggtccccaagaagctgagcctgtccttgctggggtctgtcatctcctcttagccccgccaggctcctgaagctgccacatgtgcagcgggaggtgggtggtttgggagcagagcgaggctctggatggacgggctttaccaccagcagccaccaccacctgctctgcagggcctgggccagccctgaggaggtggcagacggaaggaggggcagcactgcctcaggtctcctttactgtcttccagacatcagctcagggagagtaggcatgtagcactgagaaacagggttgctccccatggctgcctctgcttccctgccgcacagtgtctgtacacggcctggggacctgcgaggccagaccgcagggcaggggcccacggctgtgccagcttctctcccaggccgtggcggttattacctcctgacttggcagagcatccggctactggagcccattggttccggccagtgcagtcaggacttagcttcccagctgtgatctaaatcccagcctcccaaaggcacagcgcctaagttctcccctgccaagctcacagccttctccttggcaggctgccctttctcctgctggaccaaaccaaggagcacggtgacccagggacaccacactcggtgtcagcctctgaggccatggagccacgcagacccagcacaggattagaaacagaccttcccgggaggcagagagccaggcctcctggtttatagcatgacaaggcagcactcaggaggacgcatcaatccttctccatgtcagcacctgtgactgtgaccactggtgaggtggacatgcttctttttccattttacagatgaggaaactgaggccaagggagggtcagcagcctgccctgggctgactggtgatgcagcgagggtggggtgtgggagggtggcggcggcccttgcagtccctgggaacctgcacctcttcctgggcgctgttcccctctctctcccaggacccttgggcctggcgtttcttcacctgcgaccatccaggagctggacctgccctagggcgtcagtttccagggaagcctctggcctgtgtgtgagcctccccacctgcccggccacggcctccacaggcgccctgcgcagccccgcccctcctggggcaaaggctttgcgaagactttcttctctggctcatccctttaaggaggcataaaaacgaaccccgggcctcacaggtccggaatgcgcccccctccacgatgggagcttcttggccttggctgtgcaggggccgcggctcctgggggtctggccggatctgcagtagtgctgaatgagctgtggccaggaagacgcaatgaataattgtcacttaaaaggataaacagaaattccatttcccttttaaatacttgaacatttcaaaacatctggaggacgcgatgcttttccttccaagcatctccgtggagttttgtgggttaccgcagaggatcggcagcattcctctctcagggaaaactggcctgagcattgcataacgcaggcagactgcacccctcacgtcgcctggggccacatgcacatgtttccaagagacttgctggagaatcttccccggatcttgacaaagttggacatggaaagcacgttggtccatccaaggtccacagagcgaccctggctatgaaaaatcatcctccgagtgggagtctgtctgccaggagtgaggtgacaccgcacatggcctcaggagctggaaacgctggtgaattcagatgcagccaaagcttctaacttagtcacagttattaattattcttggtcttattggagcaggaaccactgccatgcatcaggccagcaaggctcactccccaccgtaggatccctgtgtagacggtcgctccatcagtgtagttgggtgtgtggagcaagggactgggctgaccctaccttccaagcatcgatgtggccttcagcagagcaggaggagatagcccaggacttgtactttgcagttgaagtgccagacctaagaaatgcaaacctgaggatggaaagagggtggagaggggggaggtgtctggattggccgtccagagcagccccagctgcagcaagtggaacttggctggctgcctcacaggcctggtggcagcgtccccagcgaggagcctgtcccacatatgaaggtccccatacccttagcccctagctgagagtttcactgaccagagctccctgagtccagggctccactcaagggactgctgtccccgttggtgaagaaggcctgttggggccaatgcttccccccacagggaagcggagctgtattttgtcggacagaactttgcaagcctgaaacagctggtggtggccccagagccaagatctgacctcactccagagttgaagggcacagagaaggcacagctagaggcggcaggtacccctcaaagctctcgggagagggtacaaagtgggacctcccagcacccttggcctccaggcctcaaaagccctgagagggctgcatgcaaggagacaaagctggagaaggatgtgggaggcaggtggctaagaagacaggctggaaagggacgtgggaggtaggtggctttgctctaaacagaatcgtctcagtaatgtgacactgcacatgtataggtaggctcgctcatgggcataaccctctaaaacacaccttttatggagtgaaattcacttaacagccatcttgaagcatatacttcggcggcatttgctggattcacgacgttgtgcaacctctgcttctccagtttcagaacatttcatccctccagaacaacagctcatccccattaagtaatcactcctcattccttccccatcctctggaaaccacagatctgctttctgtctctatggatttgtccgttttggatatttcatataaaaggaatcacgcggtgtgcgaacgtttgtgtctcacttctttcggtggaagccacatttccaagcctcatcccagtggtggcccctgagtcccctcagtgtatcagtgtctcacttctgttcacagatgcataatatcccaccccagggaccgggcaccatttgttaatcccttcacctgtggtggacacccggtcgtctccgcctgccgagaccagctcggtcagggagaccctaacccagcggcgctagaggaattaaagacacacacacacacagaaatacagaggtgtggagtgggaaatcggggctgacagccttcagagctgagagccttgaacagagatttacccacatatttattgacagcaagccagtgataagcattgtttttatagattatagatttaaaggcattctttatgggaaataaagggatgggctggaaataaagggatgggtttggctggttacctgcaggaggagcatgcccttaaggcacagatcgctcacgctattgtttgtggattaagaatgtctttaagcggttttccgccctgaatgggccaggcgttccttgccctcattccggtaaacccacaaccttccagcgtgggcgtcatgaccatcatgagcatgttacagtgctgcagagattttgtttatggccagttttggggccagtttatggccagattttggggggcctgttcccaacatccgccttccagctgttacgaaggacgtagctacgagcgtctgtgtgcgcgtttccgagggaacaggttttgtttccatggggcgtgtgcttaaggggtaaatgctgagtcccatgctaagtgtatgcctaaactttttcaggaaccaccaaagtgttttctgcagcagccacaccattttacattcccactccacattctcgcatttttctacttaaaaaaactccaggcagagggaacagaacaggtaaagaccagaggcccagtaggcggtgcttggctggagctcaccaggggctggaccagaggacacgagaaagacgggagtggaagctgatgcccagtggtggatggcaacgagggctcgggtggctgggccgtgtcgcttatgcagaggaaacggagatgcttggaaatgctttgcagaggtgagaatatggcttgttgggagagcgcttgtgtatctggaattatctgaggcctggaggagtgacaccagtgacaaagcctttgcaggacacccaggaggccatgggagttgtcaggtgggactgccatgagagagggctggagagaagaggcgggcagaggacacagcctgggagcatctgcagtctgggcagaggcggaagcagccttcagggcggtaggtgggaaggagacagggcagagagggttatccaggactctggggagaagaggcaggtcccaagttgtttaccaagaatttacattaaaataacataagctaggctgagtgttgtcacacctgtaatcccagcactttgggaggccaaggcaggcggatcatttgaggtgaggagtttgagaccagcctggccaacatggtgaaaccccgtctctactaaaaatacaaaaaattatcctggtgtggtggcgtgtgcctgtaatcccagctacgctggaggctgaggcatgagactcgcttgaatccaggaggcagaggttgcagtaagctgagaccacaccactgcactgcagcctgggtgacagagcaagactccgtctcaaaaaaaaataagctattgatgggctatatattgttaagctatagggtgtggttacagtgtccagtgtagcattgttcgattaatttatagcctcttgtggcaacagcaagcagtttccagagatgaatacacagcttgagtaggcaggggggagtaggacatgacggctgcctcatcttaacaccttgggcctgataatttaaaaggactcacagtcctcagataaacatgactttcttttctcatgaggaaacagagaaggtggctaaagggtatctctttctctcatgatcccaaacctatcaggtttttatttcccacaccacccagttttccagctccttggatgccaactggatgtcctggaattccattcaattctgagactaacaacctgggttgcagtgcaccgtcctccctcccggcatctggatgaattcaccaccctgggagtttttggaaccccatcatttaggatagacatcctaaattatgtgtacctcatggaggttccattatgtaggtgtggggccaagggagagcttttccctcagccttacaagggttctctgaaaagtcaactcacaaaaagcagattaactggagaaaaggcacacaaattaatgtgtatacaagggacccttcagataaacagctcatttttatgcttaggttcaatgaagtatgggcagccatgtagaaataggattggaggcttagctggatctgatgctaatggactgagtggggaaagccagcctggtctgtgtgtctggattctccttggcctctctgagcagcgccctctccttctgggtgtgggtgggaccctctctggaatgggggtcttaggagctacagccaagccaggtaggtcagaccatttctttatggccagtttgtacacacagaggcacagggaaaattagagccctagtttttggttgtatggctggctttggggaaaggggttctggtttctaggacccactgtggggaagaaggattcccatttctatggcaccttgagtgagagtggtactgagacacagaggatgggagaagctcagacagaaacttgcttcagaggctgctgctggggccctcattttggagtatgatcttctaagccccaacacaggcaccaaaaataacgtcctaaggcccccagtgactacatggacccgctcttggccaaggggaccccagagaaacctggaaaacagttcccggccgcaacaggaagggagattggacgcctggctgttcccactccctttggaatttaggcattaatgtcaaaacagagatcagaaggctgacagaactgaccgtggcaataagagccccagttacaaacaggacccaagaccatgtcagacgagggttaagtcaagtcatgcaccctgttagtcacccctgccccatgtttcgggtgcagatgtcctcatcgctgactctaggttttagataaagctttgctcctttaaccagccgcaaactgaagactctctgaatccacctataaccgataaggcttgcttccagatatcccgcgtgttcgagctgagccaatatatatctcgtccacctgtaacgcctgtcccctaaagtgcatgaagccagactgtaatccaggcacctcaggaacactcactctaggcttcttgggtttgttttttctccaagctgtggtcaccgtattaggggtcccaataaacctctttaaaatgttttacagagtttggtttttcattaacagaataatggattaaattcttggccatcggtaatcagttccatcttcagctcctgtcctctctcccctcccgcttcctggaggttggggtggatctgaaagtcctcacctataagtcctgccttggtctttctggggagcagtcccttcctgaagctgcccaagggtcaccagctctgtcctctcgtcagcacacaaaagacacgctcatcactcaagaggttccaggtctcttagaagctctggtgttgggaatctgggacgaagaccaaatctatattttgttattatcacaataccatggcaacagtctgcaaaccaggaagagagcctcaccagacgccagccatgctggcaccctgatgttggcctttctgcctccaggactgagcgagaaaaatgtttgtggggtgagccctggtctgtggtgcgctgttatgggcgggacccctgtaagcccagagtcagcgcttgctgcatccctgctctcagaggcgtgtggcagttgcctttccctgtggagggttgggtgagattgcccttgcactgacagcaactgaaggacgattgagggccctagatctctgggtgcagggcacctggtgaaacgacccgccacacatgactgattttcagccaaagatcacttgtagcttaccaaatatgccagaccaaaaactaaaaccaaaagttgacagagaatcttcattttacaaatggagaaatcagagcatcctaatggtgagcaacttgtttaaaaaggaaaattctgtatggctgtggatctgcggctgctgtcaaagggttgctttcagtaacttgccaataacggtggagctgttgtgcttgcttcctagccagagatcgtgtcaaataaaataaccctaattttggaattagataggttgagttcaattcctagctcctgaaaaatgattttgaacttagaaattggttccagcaatattatgagtcaagtatgaaggtagaataaagatgttttgtggcattcaaccttccaaaacatttacctgtttaaacttattttagaaagttacttgaggatgtgctccagcaaaatgaaggagaaaataaagaggaagacctgggatccaacacatagtggattcaactgagaaaagttgtggagggaagtcccaggaggagagctgcacactggatctgagagagtagcacaatgtaggctgcacatggggctcatcctgaggagacctcctggcataatggagcactgggggtgaaggcagatagaagatagtcgggagactatgaacacacatgagaatgtgttgtgagaaaaaaagtcaaaactatcagggtgggcgaagggcagggggaagctgttgatggaatgaaaaataaccatcatgctttgtttggctcagtcataagcaatatttacttagtcatgaaaatgtaaatactaactatggatttaactaaaaatagagatataattatagtgtggatgtggaagtaggggagatggagctaaaatacctgtccagcaggaaataaacagataatgtctaaaatgggtaagtcaagcaacaaaaatagaggcatatgattttgtgataaaacagtcatgaccagaaggaacagctttaacagggacaagtagttgcttttgcaaaaagagaattaggacgtggctgggtgggaggcaagtaactgtcagctccagggtccacatctggtcctgctttattccacagttcaagtgtattgtgtaaagatcgatattttaattaaagtgtaataaggtgagataattaaatagtaaaaataaataaataaataaaacaaagctgcccattcccttaccttgttgctgagcttcccacagcccccaggccctaccccgagggcttcctgcaggacagtgcacattgcagctgctgcagcaggaacgggatgcactggtcactcacaaaccacaaagcggaactggaagctagtggagtgggggaaatatttgcagtaaatatgacacaaagattaatagctacttatagatttcacatctattaaggttcatctgtaaaatcactgtagttggggtttggaacacagagaaactcacacatgaagcagcactgaatacacgggaaagacacggtcacatgcacagggcacacaggagcgatgcagtgggcacaggtcaccacgcatggcccaggagatgcaaggaagcggagcaccactctgtccactcagatgcccagctctgcactcagcagccacggcgaagagggcagcctcggaagcgatctgacaaaacctaggggtgaatacaggagttcacacctttgacccactctcccactagaaagtaatgacaggaggaatgatgaggctctgggtggcaaatgcataacaggagacaatccaactatctagcaatgaggcattaagtagatcaaggcacatctatttgtggcttatgagttactgggtggatgtggggtggacacagggagcccagtaggccacagcccccatcctccattcccaccacgcctcacagctccctcctcacttgggtggaccttgtacagttctaccatccagcagccatgtaagtatctgccagattaaattccacatccactgaaggatgaagagagcagacaagactttaagcagatttccccctctagcctctctgtgagctccatctgcaggcgctgcctgtagggcctgacatactcagggcccagcacacatggggcctggcacacacacggtctggcacacacaggcccagcacacatggggcccagcacactcagggcctggcacacacacggtctggcacacacaggcccagcacacatggggcccagcacactcagggcctggcacacacacggtctggcacacacaggcccagcacactcagggcatggcacactcagggcctggcacacacagggtccagcacacacagggtccagcacactcagggtctggcacactcagggcacagcacacttagggcatgacacacacagggcacagcacactcggggtctggcacactcagtgcctggcacactgggggcacaacacacacagtgcacggcacacttggggcctggcacacactcaggcccggcacactcaggatctggcacactcaggggctccggggctccagggctccaggatattaatgctggtgcctggagttctcagaggtgtctaggggcacagaagaggcactggctgggcctcctggacagggtgagggtggggcgtcacattctatttcgaaaataaggagtgtttttaaaaagcagtaaaacccataaaaggaaactcctcagagccacatcttgaggtttacctggacatgaacccgtttgcctctttggagtttccaggtgctgggcccaagccctctgtgcaggccccagagcagcggctgggaattcggagggtgtggagggcatcctgaggcagggggatccgggcgggcagcacagggcctgcgggggcgtcgagcttcacagtggacaaatcctgccagcctggcacgtggcctccagcctggggcccgacacctgctggacgatggagggtggaaaaggaaggcccacggtgacatgtggaattttaaacaggttttcctggtttgagggagccgtcacgtctgctcctggcatgggatcactttgctgtggaagcttggatgccggtgcttgcaggccaggcttctgccaggagcccttcaacccacacttcgggctgtggccccgggggctgtagggggtcagccgccggggcctctggttgactcagaggctggtgggggctcctagcagaagctccgagacctccaccttataacccaatgggtcgcagggctgcgcggcagctgtgggctgggctgggctcatacttggtcctacaagtgaagccactttggggaccagcttctgggcccaagtccaaccacaaagaggagatgaaactgatgcatttctaaatgcttcagcttggcagcaatacaaatatttgggaaatctttgacatttaccgagcacctactatggacagagaactcaacaagcactttccaggcgttctcctcaatgatcctgaccgtcgctgcgggctcttgtccttgggaccttaggcagccgccttgctcacccagagcacggaagagttgagatcagaacctgctccccgcccaccctccaagcctcgctctgcactccccatcacagggctggacacggggaacacctgggggcagccagagttgggagggcagagctggaggggtaccctgggctgttaccagccatgagagtccagctcaggaaaaagtggggagcctggccaggtggctctggggccaccatcttgggtgacaactgctcagggctctgggtttcctgccaggagggaagggagatcagccacacacccatatgctgggactctcaaggtgtctatgctttcacagagacctcatgttttgaggacgggtcaaagtgcaaaatcagtgaccaccagctgggagctttgggcatcctgatgggcccactctggggaagagaggggtccaccagtctctgctggcctggtgtcggggtgaggcactgccccgggtgcccccgctgccccacggaatgtctaggccccagcaggtagctgtacccaaagtctcattagtgtccacacctgccaagagtgacacgtgtgcccaccgtgcccggggtggaattccacagagccgctccccagcaggcagctcttcagtcccactggctcttatcagctcctgtttactgcagcgactgcacccgcctcctctctacgatgcgtaagaactgcctttcctgtcaccccgagaggcagggttgtggggcagaagtggtggctccggggctgggcaggcaggcttgagcctcacttgggatcagtcagcttgagccgggctgcactgcagaaacaaatggcctcctgtgtcttgggcttccagcgacagcgtgtgcttctcactcgcgctacaggcacatgatggtcagctggagctctgctccatggcctctcagttctgggacccaggctgaaggatgcctctcatgggaggctctgtgggctggaggatggggacatggtggaaccacatgatagcccctgaggcatctgctcggccaggacattggcgaaagcgtcacccaaacctgacatcaaggggccccggggagaggcaggaaacactctgagcatgaatctagccagtctacccgccgtgtgtccttgagcaagtgaggaccttctccagacctcggtggcctcagccgagatgggcatggccgtggcaggacgactggggtccggtccgtgtgcagcatttccaaggcctggcccctgcctgctgtctctgcggggccctctcattctgctgaggtctcagtgatgattgataagggggacagcacattctgagccctgatgtaccctgcagaggcaagggctgtctgtggtcaccatggtttctggaaccctctgttttccatttgaatcccacacagccagctatggctatggacaaagagtgcaagctctgaatcttctcccagccttgtggccctcagggtcactcaactcccagtgccttacgtggtaggctcctctgagagtgtggacggccacttcactgggctgagctgcttcccccgtgggactgcctgacctcccgacgggcctccggggcgtgtcccgcatgccccactggggaccctccacactggtggcaacgtcaggccagccctgctgggagcgccccggccctggcgttgtgtctcctggctgtccctggtctcctgggcagattttccggctatttttttttcatgcctgcacatctgggttgatttcactggcaacgcgaggctcccgctagacgtctcattttgtttcacagtgggaagaagcatggaataatactgacctcttgatccacgatatatctgggggcaccaaaattcaggagttttctctcctcccccatgtcagaggcagtaacctgtccagcttacctctcagaagcagcaggatgatcctgagctgcttctgtgaatgttcacaagctgcttgaaatgacttcctaccactggatctattgggggagagcaagggggagcgagcctgaagcctccagtgtgcaactcaccccaccgtgtaacacctgactgtgcaactcaccccattgtgtaactcaccccactgtgcaaatcaccccactgtgtcaccccatcattgtgtaactcaccccatggtgcaaatcaccccactgtgtaactcactccactgtgtaactcaccccatcattgtgtaactcaccccatcattgtgcagctcaccccactgtgtagctcaccccattgtgtaactcaccccactgtgcaagtcaccccactgtgtactcacccatcattgtgtaactcaccccatcattgtgaaactcaccgtatcattgtgtaactcacctcactgtgtaactcaccccattatgtaactcaccccattgtgtaattcaccccatcattgtataacttaccccatcattgtataactcaccccatcattgtgtaactcacctcactgtgtaactcacccaattgtgtaactcactccattgtgtaactcactccatcattgtgtaactcactccatcattgtgtaactcaccccattttgtaactcaccccattatgtaagtcactccatcgtgtaactcaccccatcattgtgtaactcaccccactgtctaactcaccccattgtgtaactcacagagcttggtcgtcccatctagtatcactgtcctaaatgcactgtcgggtcactgaacctgcgattagcctgggctttacctacccagaaacacttctgcatgccatgagcacctttgcaggctcagctgtgaagtttctagattccacatgcacttgccccatgagaggccaggatgctgctggagttgtgttcacctcaggtgtgtcatcactgtagctgttccagtccgtgacatagccttgcaatgttggcgtggacgtggaagcgtgcagggaacagtcggcactggcatcaaggccccaggatatggccatccacccccgatggccccaggtcctttcagcccctccgtgtttatttcctagggaaactctggtttggaaccataactgcaaagaggaaagtcacagaagctcagtgggatgatctaacttgcttgccaacaacacactgctctactaaaattctcttgtagtttctacacccaagacatgggccaaaaattcagaagccactgggacagcctgggaagaacaaacccggccagggactttgtcagtcatcccgagtcaaaagcgctcaggggtcccggaccaggagagggggtcttggcccagagctcaccctcctcgctgaggcacagctggggcatgcttggtgcatcggagctaagatgctctgcactgtgcttttaaggagcagggatcctgccagggaggactcttaaacggaaccacaataagcagcgatctacggtcagcccctctacacacagcagatgccgtggggcctgctgagctcaggagcagtgcacctgcactcttgcctcccggtttgacccagctccagcctctgtgctccgtgctgcactcctatcccaccagtaccagcagctgacggcaggggagacgttttttccacgataagaatttgtttgaaccagccatgagttcttccagtaaacacaattagcacataaaactgtgcaccgcgtggtgaaaggaattaggaagatatgctgtgtttactttgtggttccaagagctggtatctttaaacctttgatttgccaagagcccaaatcatgggcaggaaaggagggtaaacccggccccatcacttgcaagcagccgatggataaacagccgcctggcatctcctcacagcgcaactcagctgctgctcccgagctgtgcttccaagtgtggggctgtttgtcctctgcccccgagtggaggctcctgcagagcacagccaggagcagggtggctccgttgatgctgtcattgctgtgcctcagtttccatccacagaagaggggaccgtacagggctcttgagcagaacaaggtcgttgtcatgagactctgggggctgcgccaaatgacgctggtcactgaaaaggaagcagcctgtgttaccaggaccgcatgacctccacaccgctttccagaaggttcgtgaataacccacccctcatttacgtgtaattaggtggaggtataaacagccagccagcaatctgagggggcccctttgccagtggacagccctgctctgtccgtgcagcagcctttggctgtgccctgtcgccctaatcaatgcttcttccactgtctgattctgtgtgaatctctcctgatcaacgcctcctccactgtcagctcacgtgcgaatctctcctgatgaacgcttcctccaccgtcagctcaggcgtgaatctctcctgatcaacgcctcctccactgttggctcacgtgtgaatcactcctgatcaatgcctcctccaccgtcggctcatgtgtgaatctctcctgatcaatgcctcctccactgtcggctcatgtgtgaatcatctcctgatcaatgcctccttcactgttggttcatgtgtgaatcatctcctgatcaatgcttcctccactgttggctcacatgtgaatcactcctgatcaatgtctcctccaccgttggctcatgtgtgaatctctcctgatcaatgcctcctccactgttggctcatgtgtgaatcatctcctgatcaatgcatcctccactgttggctcacgcgtgaatctctcctgatcaatgcctcctccaccgtcggctcacgtgtgaatctctcctgatcaatgcctcctccaccgttggctcacgtgtgaatcatctcccgatcaatgcctcctccaccgtcggctcacgtgtgattcatctcccgatcaatgcctcctccaccgtcggctcacgtgtgattcatctcccgatcaatgcctcctccactgtcggctcacgtgtgaatcatctcccgatcaatgcctcctccactgtcggctcacgtgtgaatcatctcccgatcaatgcctcctccactgtcggctcacgtgtgaatcatctcccgatcaatgcctcctccactgtcggctcacgtgtgaatcactcctgatcaatgcctcctccactgttggctcacgtgtgaatcactcctgatcaatgcctcctccactgttggctcatgtgtgaatcactcctgatcaatgcctcctccactgttggctcatgtgtgaatcactcctgatcaacgcttcctccactgtcggtgtgtgtgtgtgaatctctcctaagtgaagccaagagccctcttggatggaggaggtctgcctgccttgattttgctctgcagaccactcgccttggtttagaaacttcctctcttgaggaaggtgattgcctgctaaagcaaaaattgtcaacactttctggagaaatagaatccagagccactacacataaaatttatatttgggataaaatccaaaattatttgacatatgaagaccaagaaaaatattaccaatcttcaaaagaaatgacaacttttagtttccaatattgagatgaaaagactgttggagttaccagacaagtactttaaaacagctattgtaactgtgcttagtgaagtaaaggtatgcttatgatgaatgaaaatataaaaaaatctaagcaggaaaatataaaatattaaacagaaccaaatggaattttaaaactaaaaaatacaatatttgaaataaaaagttcaggtttaatagaggaaaatagtagtaagcttaaagagattgataaacaccatataaattaaagagaaaaatgatttaaaaagcaaacagatctacgatagttgtcatctcttcaaaatgtctataaagtgtttttgtaagcctcagtaatcataatgcaaaatcctataatagatacactaaaaataaaaagcaatgaattaaaacatactaccagagaaaaccacttaaccacaaaggatgacagtaacaaagaaagagaggaggagaggagttatgagacaaccagaaaacaagcaacacaacggcagtagtaagtccttacttataaataacctcaatgggttggctccacagcaaaattgaagaaacagtggaaagaatcagcgaaacagaagtacaataaaaattacccaatctgaacaacagagagaaaatagactggaaaaaacatgaacagaacctcagggacttctggggctataacaaaagatctgaattcgtgtcatcaaaatctcagaaggagaggagaaagaggatggagctggaaaaaccaaaaataaaatgactgaaaacttaagaaatttggcaaaagacataaacctacaaatatgagaggctgaaaaaactccaaacaggatacattcaaaaaaattcataccaagacacatcatagtcaaacttctggaaagtaaagacacagagagaaatgacattttacccatagggaaaagcaattcaaatggcaacagatttctcatcagaaaccgtggaggctagaaggaagtagcacacaaaactgccaacacaaaagtctgtattcagcaaaaataatcttcaggattgaaagggaaaattgagacattcttaactgaaagaaaactaagaacatttgtcactggcatatccatccaaaaagaatggctaaaggggcttccctacacagaaagaaaatgatcaaagaggaaaacttggaatatcaggaaggaagaacaaggtagcaaaagtatggatatatataatatgccttttttctcctctcaaattttctaaattatatttgatgaagcaaaaattaaaccactgtagctctaaatattaatatatctggaggagatacttatgacaattatatcatagataagagataaaaaagacaaagggaggtgaagtttctatactttactcaaagtggtaaaatgatgatacaagtatacagtgataagctatttatataaatgtaatatctagaccaatcattaaaaactaatataaagagatatacttaaaaacactatagaaaaatcaaaatggagttataaaaattgttcaagtaactcatgggaagacagaaaaggaaaaaagagcactgaaaaacagaacaaacagaaaacaaaaaaaaatgtcagacttaggtcctaaaatatcaataattacattaaatgtaaatggtctaactgcattaattaaagacaaacatttgtagaatggattaaaaactgtgacctaactatgtgttagttacaagaaactcacttcagacataacaatatagaagagttgaaagttaaagaatggaataaagtttatcacgtaaacattaagcaaaaaagaagcagaagtgattatagtacatcagataaaatagacgacagaacaaagaaaattgccagagatagagagggacattgtataatgataaaagggtcaatccaccgaaaagacataggaatgaactctagatatgtatgctcctaatagtgatatacaaagtatgtgaggcaaaaattaatagaacataaaggagaaatagacaagtctacaattatagttggagacttcaacatgcttttctctataattgataaaataactagacagaaaatcagcaagaacatagaacccaataacaccatcaacaaatagaatctaatcaacatttacagaacacccactcaacaacaccagaatatatgctgtttccaaatgccaatggaatgtatactaagatagaccatatcctgggccataaaacgaatctcaacagacttaaaaagaattttaaacagagaatgtgttctctgaccacgatagaatcaagttagaaatcaataacagaaagataacaagatgtccagatgcttgaaaactaagcagtactattctaaagaatccatgggtgacagagaaagtcaaagaaaatcaatgcactaaactgaatgacaataaaaatataaatcaaaatttaagtgatatacctaatgcagtactgacagggaaatttataatactaaatacctatattagcaaagagaaaagtttcaaatcagtaatctaagctcccgcctccagagcctagaaaaagaaaagcaaaataatattttacccaaaatagcagaaggaaagaaataataaggataagaacagaaatccacaaagttgaaaaaagaacaacaaaagagaaaaatcaaggaaacaagtaactttttctttaaaaagatcaataaaatagacaaatctgtagcaagactgaccaaaaagagagaaggcataaattatcaatattagaaatgaacaggggccatactaaagaccctgcagacatcaaaggatattaaaggaatactgcaaacaattctatgtaaatatgactacttagatgaaattgaccaattcattaaaaaaaaaaacccgacaacacatccaatatgaaatagatcatttgaatagttttacaactatttagaaaattgaatttgtaatttaaaaattgccaaaagtgaaatctccaggcccagatggttttattggagaattctaccaaatgtttaaagaatttataattccacccaatctcctttggaaaatagaagaggaaagaacactttccaactcattttacaaaattaatattaataccaaaaccaggtaaagacaataacaaaaaagaaaaccatagaccaatgtcctttattgatataaaaatcctttgttttttgttttttgttttttttgagacggagtctcactctgttgccaggctggagtgcagtggtgtgttctcagctcactgcaacctccacctcccaggttcaagcgattctcctacctcagcctcccaagtagctgggattacaggcacctgccaccacacccagctaatttttgtatttttagtagagatggggtttcaccacgttggccaggctgttctcgaattcctgacctaaagcaatctgcccaaagtgctgggattacaggtgtgagccactgcgcctggctgaaaaaatgaacattgattgatattatacaccaaaattaactcaaaatgaatcatagccctaaatgtaaaaccaaaaactgtagaacttctagaagaaagtctcaaagccagcaaatatttcttagctatgacacaaaagaccataaaccattaaagaaaaacttggtaaatttaaaatttttgctttgggaaagacaccattaagggaacaataaagcaaatcatagaatagagaaaatatttgcaatacatatatctaaacttgtgtctaagataaataactcttatgcatcaatgagaagatggcgaatgacccaacaaaagagtgggcaaatgatttagacagacataaaagatatatgggtgttgaataagcatatcaggaaaatgcaaattaaaaccacaaagagactccagtacaaatccactagaaagggtgaaatgaaaaagactgactgtagctggtattagtgaggatgtggagcaaccagaaaagccagcacatcgcacgattttggaagacagtttgaaagtttccacctatcatatgatgcagccattccccttgtaggtgttgatccaggagaagtggaaagccaaaaactggaaaccacctaaatgttcatcaacagaaggtggataatcagaatgcagtacgtgtaatgcaaaaaattcaaacaaacacacagtgacagcatatcagcggctccaggtgtggggccaaggggccctagctgcagagaatccgcagagtctggagggagggctcggtcgttctgtatcttggttgtggtgggtcattgaattggacactccaaagggtttattatacatgaattatacttcaataaagttgatcttaaaaacttaaaaagaaatttctaatcaaatttttagcaaatcacatctagccacatagtaaaataataatacatgagacctgtctgtgtttatcttaagattgcaagattggttcaatattagaaaatatagccatatttatacatgttatacatttaaaacactaattcatcacatcagaaagggaagtaggtcaaaaagaggaaatcctttggttttcatcattattgctgaaaaggcaatgatataatttagcaaccttacctgaaaaataattactgataaccagaaataaaaggaaacttccttaacaagtttttgctttttaaagtcagtggaaaacgcacttgaatgtgttctacgtgccagcttttattcaccctcctggctgtacatcgaaagccatgaatctccctgctgaagacaggctgcctctccctggaggcttcccatctgtttttgcccaacacatttccacaaccctttagacttagagataaccaagagagaagaaaggtgggggaggaggaggaaagtcttctgcattcctgggccccaccaggccagcagatcctcccggtgggagcagaagtgggggtggggaggctcaaagagcagcacctgcaggggcaggtgccgctgacacccagggagcccgacaggaccctgccctgagcccagctgtcccagaaaccacctggacttcagccaagcgcagtccctgtaaggtatttaatggcatatccaatccacgaagcaccgaaaggctccctggcttcctcctaccgggacttgagaacttcttcagccacagaagcaactcaggctccccaaatctatcaaagaagaccacagggacgtctgcaccatgcacaaattgagaggagcctcctgaccctgaacgtgaaacacccgcaccctcagcccaaaaacagggggcttctccagctcagggctgcagcaggagaccgtctgtagccacaggtcctctagaagctctaccagtgcagcaagagcaatcagcaaataaacaaagtgtgcagtatttgaaagaaagaaaaagaaactatcaccacctgcagatgacacatccaagcgtctctttgtgccaggccctgtatacattttccagccactctgtctcattccacacacattttgcagagaatcgggacctgcccaaggcttacgtcttacagatgctactcctggaatgcaaacgcaggtctggctgattccagagtcagaacttcaagccaaaaaactttcccaaacaccccaaaggatggactcaaagttagtaaaattaagagaggaaattacaatgatggtgagtaaaatcaatatagaaatccaatagcattcccagatgctagcaataaccacctcgcaagcaagagtgagggggagcctgttcgaaataacaacccagcatcttaaatacccaggacttgttaggccaagagatgagtacaaaatttatattgaagaaacaacaaattttgtaaggaactataggaaaaaattgggtcagttgagagatgtcagcatgataccaaaggcagaaaccagagatgggaggaccggtaagtctgagagcataaaaatataaaacccaccatgtacacatttgtaaagcaaacagaaatataaaactccactaagggacatgaaaaagcaggtgactagatgcagaaacatgctgaacacttaggagcccttttatttgttgaaatattttcaaataagtgaaaaaatcaggtaaagcaggaaattgacaatgatacatatacatctcaaatgcttccttttaacttaaaatatatgagtctgaattgatttgattcttgtgagaacatctctgtgaggtctgctctttgaatttgttttttcctggcaaaaagaaaagaaattttaaaaatcttataattcatcactcatggttttacgctttatttccttaaattaaggcaagaattaaagatgctgtcatggtgatctgagggcagaatccctttgaatgtcatcttcctccaatttttacagctttcttgcatatatttggttttgcagcattaaaaacactttgccagtttgtctccaccaagccttcctgagcgctctcccactctgcagtcctggcccattcccaagaggcagagatgcatgcagagggcaccagcgggcctggcagccacccttggctctgctgagccttagctgtgggagaggccacctgggcccccggctctggatgtgtgtggagggatggagggtgcaggctggcctggcatgtcggctatgtgtggccaaccagaagagcttggcaccacccttgacaggaaaactcaatatttgattccctaattcctcccctaggaatttttcctaatggaactcagtgcccacttcatagtagtggttatctctgcataaattttatttccttctttgtgttttcctgtatttttcaaatggtctgcaatctacacggattacttttataattagaaaaaaattaattgtaaaaacattgtttgaagtttaaagagtgccatcttggttactactcaaatctttatactgtccttacgtttttcagtgttaacccaaactgtgacgcccatctccctaggacacatcataggaaggcctgcttcagtgagaatgcactcgagataggaaattacccgtgttgataagcagggcctgcctatgtttttaaatttcaggctccctaataaaaggagtaggataaaatgccagcatgctgacatttcaggacactgccgtccggcgggggactgcgcacagcgctgcccactctgttctgacccccactgtcctctgactcctcctgggttgtcctgccatgttcccatggggaaggtgtcacacccagtgccagtgggtgatgatcagaggggatatgacagggctctaggtggtacctggatggatattttttaaaatagttactaatttattttagtgtgctgtagaaaaaaccaggcagcacaatggaccttcaatctcacacagatgtatttaaatgtatttaaatgtaaacatattttacatttaaatgtatttaatgagtctattgaagatgccctaggtagacaataattcagagcacatggatatggcaaaactttgaaatctgcacacagaagggtgcaatttgggaaactgtcatatgaaatcgcacttgggctgcacattacgaacacggcaggtcgtatctgtgtgttttcattgcttttaaatctcttttagcagctcattctgtgcaggcaccggttctgatttacttaagaagatggtcttaacttccctttgatgggtatcgtcatcctttctcttagttggtttcagtattattgcaataggatatactgaagttttgaataatttattaaacgaatctttacttcctagatacaactatcttgacttttttctaagtactacacttttgaagtaaaataaagcctcacctcaacaacagaagtggggtccagaacatcccgtgggtaggatgtgggagctttcctgcaaggtcgagtggcccctgctgggaccctacctctggcttaaactgtgacggaaagattctgggtattgtggttgcctggagcttccacgattcagcaaggattccaggactgtcctggggagtagctgccgtttaattagcctgacagagagatcgctcctggagaagcctgtagacgcaggactcctgccttgttgaaggatcagatgtagcaagtgaagagggaaggtgaggaggctgccaggcagccggtcagtgggtgccgcttaagagaaagtgttggccaggactgcaggggcaagaaccaggacacaggcctttgatttgttacctgaagggcctgctggggctcggatgcaggttggtgacagactcaaacttgccataaccttttcctcaatgtatcctcattccaaaagtctaggggattaattccaaaatagttagatagcccccttgtatttcttcgtgggtgtttttatgatccttcctctttctttatcaccttaaagcctgacaagcagatgcctggggatggggctggggtgatgaaaccttttagcattgcttgggatgaggcttgctgcctgtgaaatcaatgccaagatgcgctttgagtaaggaaactttctggaattaacctttgagttatttatttccatgttgctgataagggcttgaaagttctgtctgggttgcaaacacggccctgattgcttattaactgcgtgatctcctacaggtcactgattcttctcaagcctcggtttctttatttgtagcttgaggcagtgacacctgcctcatggggtcgctgtgagacagagtgaggcctctctgcccacatgcgctgcagcatccggcacactgtgtgctcagtaggcagagactgtcatccttcttgttacaacaaccaccacagttgtccctggtatttgccagtgtattagtccattctcacactgctaagaaagacctaaacgagactgggtaatttataaagaaaaagaggtttaatggactcacagttccacatggctggggaggcctcacaatcatggtggaaggcaaaggaggagcaaagacacatcttacagggcggcaggtgacagagtgtatgcaggggaactgccctttataaaaccatcggattgtgtgagacttattcactatcacaacaacagcacgggagaaacccgcccctataattcaattacctcccaccaggtccctcccacaacacgtggggattatggaacctacaattcaaggtgagatttgggtggggacacagccaaaccctatcagccagtgagactttgggacccacccttccaggctgcggctccctcactctcatcctcacgcacttctgcggtgcctgagctgcagtcaccgtggtaactgggattgaccttttaaagtatctgttataactacaagcttagtgtcaaaatactattaacctgttttgcctttacagacttatttttaaaatagtgtgaattcagttgtgtttgattagcagcttttcactggagttgccgcccagcgcagcgaggggtcttctgcaggcctcgctgcctctgcactcctgtgcctccaacggagcagccattagttggaccaggctggtcttattctccagcttcctcattatttggggtgagttcctcacagcctcctgttagttctcctgattttgtgtattcttattctcatgttgcccatgtttggcctaagagaaggcgcctcttggccggcttcctggaggactcttgctttcttgcatgccacagcagtgacagctccggcaaggccctcctggtaaagtcattggcagatccctgtctttgaaagtgttcatatttggaagaaaatgagtccaaagctgcgaatgtccgtcctcctgccagagaggcagacagctgagtgctattgtttgggaatctgtaagaactttgctatggcaaaatccctggccaccaacagcagcctcctgaggagagcactgagatagtaaaggtgcctggaggcgatttgcatccatggaccaaaaaatttaattccccccgaactttatcagtggatgtagcaataattggcttcactagcgctgtgtccgttggcaagtggagatcttctctgttcctcaactgtgtagagggggaaacacgcggggaagtcatccacacggcgctggaaacaccaccggacccgcagtgtgcagagccccagggctgtggactcaaggtctctaggaactgtattcaggggagaggagagggtgcggaggacatgacaggtagccatagaaaccagcacacagggtggggccggcgtcccgttggaagtttccattgtaatacacgcatgatgggaaaaaaaatgtaaaagaaatcacctacagtcccatcacccagagaaaccacaaaccatccttgaacattttgccatatttcccttaagaactcttatattgtagttcaaggaaaaaaatggttgggcttatatgtcatatatataattttatatcttttagaacggaattatcacagattactttatcataactcatggatggaatgttattaattcttgataaatgttattctctctttctccatgaccatacattcagagaatttaccacagccacttaacaacctccctattagacatttggttggtgtacatttttcactagtactaataatgctatactacaatgaatatttttggccatagtttttctgcattttgaattatttccgttggataaattcccagaagtagaatgttgggacaacaaatgcctgtaagactcttcataaatatcacctggccagcctgacagcatccaatgctttgagttaaatacaatatattcaataccaaaacatttgtattttgctggagagttctgagaagtttgtttttctcccttgaagacctgtgcaaaccatgttgcatagtgagtagtgcggtgtttaggagcaagacactaggagcactatggtcttccgacacttatggggtacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacactgggtgctgggagggatgaagaagaagaggctgaatcctcagggcatgccttctcctcctggcctagagtgagggtgacgcctggatgggcatcgtggaaaagcccctggggagattctgagcaggactggtggacacagacgtggacaaggtgtcccagagcatcctggtcatgatgcaggagaagctcgaacgcacgctcagccctggtcgtgacagaagaacagagaggaataagaaacgcctttaggagctcccaacccaagggagtgggaggatgttctgcaccgtttttctggaagcttgggtctaatttttcagttacttagttacttatggctttgaggctggatagcttcgtatattttgtttcctgaaatgaccccacaggttctacagagcaggagaaaaggctggacaggggtccccactggatgagacgaccttcccgccccctcggtctgggagtctgtgatcttcagggccagcccccagctggcaggccccacctggaagctgagtatgcctctgctggcggtcccagccttggcaaggcagctcttatttctctccagcctgcggtggttttgataaagcggcatttctgccttgttggagcctggttagtgatgatgcatcttagtccaggcctctcgagtttgaaataagaaccccaacccttggatgagccagaactgccttggtttgctggtgtcagttcagagcattgaaattcctgcttcactttaaagaaaaatctgtgcagtaagaatctgtgtttctagactgcgtgagagaactcggaactttctgtcacttatttttagagatgtcccaacaatgattccctctgccaagcctctgcctgggggaacccaccttcctgtctcaggtgagcctgacccctccccacccctttgctgctgctggacttcagaacagattgcaggcagcagctacaaacctcagcttctgaaatgtcactcattcatccactcgcctgtgcaatcctctctctaaactccctattggggccagttctgcaagtgtgtctagggccgcacacacaacggtgggcaaggcccgcactcactggcacgatgggtctggccctccaggacagacagtgggcctgtcaccgggcccgtgacttccagacacgaaccctcctctttagcgaagcagggaatttgtcaaatactggccctagcaggcatagcacagcacctggcttctaacaatcagtgaggggagaaaaggtgcaggacactaatggggccacatttcttcacgaggacttcaaggttctgcacaaggaggtgagtgaatctcagacacaaaaagtacattctgcacggtttcgtgtcagtgactttcaaaaacagaccccacttacctctgatgggagacaccaggacggtggttgctctggtcaggagaccccacttacctctgatgggagacaccaggacggtggttgctctggtcgggagaccacacttacctctgatggcagacaccaggacggtggctgctctggtcgggagaccacacttacctctgatgggagacaccaggacggtggttgctctggtcaggagaccacacttacctctgatgggagacaccaggacggtggttgctctggtcaggagaccacacttacctctgatgggagacaccaggacggtggttgctctggtcgggagaccacacttacctctgatgggagacaccaggacggtggttgctctggtcgggagaccacacttacctctgatgggagacaccaggacggtggctgctctggtcgggagaccacacttacctctgatgggagacaccaggacggtggttgctctggtcgggagaccacacttacctctgatggcagacaccaggacggtggctgctctggtcgggagaccacacttacctctgatggcagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatggcagacaccaggacggtggctgctctggtcgggagaccacacttacctctgatggcagacaccaggacggtggctgctctggtcgggagaccacacttacctctgatgggagacaccaggacggcggttgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatggcagacaccaggacggtggctgctctggtcgggagaccacacttacctctgatggcagacaccaggacggtggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagtggggggcaggtggtgggggttgcgagaagggtgtgcaggagcgttccgacgagaggctgtgtctctattggggtgagggttgcataggagaagcaactgatcaaaactgcacaatgaagatttgtatatttcattatttgcctgttttacctcccaaatccctcattcaggtgcgatggaatgggagcactggagacacagacagctgaacgtcgcacgctgttgcccaaggctggtccggctgctggggctgcacgccaggccggggtcttgggttctccgagtttatgcctcttttccggcctgcgaataaaccaatagagaagaggaggtcaggaacttggtgactgtgccatccaacgtggtgagatgaaggcaacagtgcccatcttagaaggttgtcgtgaggattatgtgagttaatttacaaagagcacacaacatgcccagggctgtggttgttttgtgaacatcattaaagtctggtaaactgttttcccctcagctgtggctgcagcactggaaacactggctgcctaaggtgctggaggtcggactgcagtctgggtcctcccagtccagattcctcagcttcactggacagacaggctcacctttggaaacgccacaaaaatccacttgtgctatttgtgttggtttattactaaatggacatgtgatttatttggcatagcaactctgccttttcccaagaggttccctgcttggggtattatctcagatggagggctgaggctgtctggtcccatcctggtgagtggtgggcgaagagacgtggtgtccaaaccacatcacaagtactggaagggggtgttaaaatctctgtccacattggaaattaataaaacatattattccccacagataggttgcaaagccctggtctacaaggtcagggacctttttctgtgggcccagcactgtccacagcctgagagcagagagaacagagaacaggtgaagcagctgtgactaatgaacctgccctgccttctcctctagggcaatggagataggcccagggtgtcctttggctttagccaagctctaccatgcagacagtaagacaagagcagagctgcaacaaccaccaggcccatgatatgcccccagccaccccacagagaatccactattaataccatgttactcgccctatcaatcccacattaccccatcatcaatcctactagctatagaccactaagctcaagggtctgtcgccacctcttgccacagtcagtgtccatgaacagtgtctgcagggctgctctctcagggctctgaagagaagccaatggtggaaacctggatgttggcagacatggctcatggcagtgggcatctccccatttcaacctcacatatttttcacatggttcaggaaccacagagcattccagccgttcatagacacggacatgatgtcagtatttcctgctgaccttcctctgtggaatgtgagggctcctgccccgtgggccccagttgggagcagcactcctggtccatctgccaagccaactgcttttcctccttctcacctctctgcaaagcatactttcgccaccacaaaaggggagcataaaaggaaggaatgtaccagccacatgccaactcttactctccctctttgcagcataaaccttccgatttcttataaccctttcccatctaaagccaattggtgcatctcaaatagcaatatatgattctgaaattaacaatagaaccttattagtgcaaaatgaagcccagtttgctgtaggctgagatgttttgaaccatctaagggagttgagttattttagcagcacaaagacattctccaaaaacatgttctcctggaaggcagcactagacaaagagactaatgatatcttgtgctgttgggtaatctcaggtgggcccttaacttttccaaatcacggtctctcaggaggctgcagatgagtgggttcccacggcctcttttgagctctggcactagacaaggtggtttataatgggaaggggcaaaaagtgagctgtggagtctatagacttagtttgaattctggtgtttcaagtttccaggggtgtgacctcaaagagcatgtttaacttattctcagataccctatctgtgaagagggtatggcaacttaagggttaatacagaggattcaaaataaaatatttaaatgataaatttttcaataaatgatattaggacaattagttatccattttgctaaaacaaaattcctcctctctactctttatcgcatgtattaaaacacacttcagaggatcaaagatttaaatgtaggctgggcacaatggcccatacctgtaatcccagaactttgggagactgaggcaggaggattgcttgaggccaggagtttgagaccagcttgggcaacctggtgagtctctacaaaaaaaagaaataaaaaattgggggctgtagagaaaaaaaattaaaaaattaaaaatttcactgggcatggtggtgcatgcctgtagtccaagctactcaggaggctgaagtgagaagattacttgagcccaagaatttgagccaggggtgagctatgattgtaccactgcactccagcttgagtgacacagcaagacctggtcacacacacacacacacatacacaaattaaaattaaatttaataagttttttttaaaaaagatttaaatgtgaaagaagaaagagggcactccctctgtggtcgccactggctctcagaagtagtgcgtgagcaggaggctccactctgatccaggagcactggcatctatgaagagggaaaccaagaaaaaattctttctgctatctttcctttcagtaatgcttatcttaagaacactcaactggaaaaccactccacctaaaagtaggaaagatggcaattctaaatagcaactattatcccagggagacccctcagatatgtgaggaatcaagccataaatgtgcatttgctggacattatataccacgtcatctctatgactacagattttaaggataatttttactcacttaacaatttcactgtaacagtgactgataatgtgaaaatgtgctttatacagtgctgctgatgggtacacagacaagttcttgctgcaattatttctaaatctagccagatcccagagtcatgaagatataagctctgtgagaccagggaccatctctctttcttgcatcataggcacacttgataaatactcatggctggaaaaaaaaaaaaagagggaaagatagagaaaaggagggcaggacaaagaaaaggaaaagaaagacagaaagtaatagaaagcaaaggtgcatatttttataatcttagaatgaagaagaccactcaggaaaatcttaacacctctctggataaaaaattcagaaggcactgcaaaaaacaaagctaataaaatatgtttacacttttaaactctttgtgggaaaaaaacatggtaaataaaagaaaaactgggggctgggagttttcaattcacttacaaagagttgatttccataactacaaagcatgcttaccaattaaaaagtagagaacaggacccaacttttggtaatggcagaatagcccccactgaaccaacctttccacaggtaacagctataaactttaggtaaaatatggggggaaaacctgcttaaaagcactggagtgtgatagaagcaggcaaacactggagttcttgtggtgatggaaatgtcctgtgcttcaactgcactaatgtttgtgtcctgattgtgatgttgctctgtagctttgtgagttgacattgggggaggctgggtgaagaggacacaggatttctgtgttacttctgtgtgtgaatctacatatacttcaaagtaaagtgtaatttttaaaaagtcaatttatggctaggcatggtggctcacgcctgtaatcccagcactttgggaggctgaggctggtggatcacaaggtcaggagatcaagaccatcctggctaacatggcgaaaccccgtctctactaaaaatacaaaaaattagccaggtgtggtgacaggcacctgtagtcccagctgcttgggaggctgaggcaggagaatggcgtgaacccgggaggcggagcttgcagtgagctgagatcactctactgcactccagcctgggcaacagagccagactccatctcaaaaaaaaaaaaaaaaaaaaaaaagtcaatttatgtaatttatatgattagaaaataaaggattaattctaatcatcaacagatgtataacaaacatttgaaaatcaacaaccattaatgattaaagaaaaaacccaggaagcttgaaatagaaggaaattatctcatactgataaagaacattcttaaaaacctagagtgaacataaatatcagtttcctcttaagataggaaacaaggcaagattgaccattctaaccatttctttccaccattgtcctagagggcatggttggtgcaatatgacaagaaagaaagccagataaacaaaaacctcacagcaaaggctgaaggtctgtttacctcagcttcttcggtctaacacatcatgtccagatttccagaaaaaattacaaggcgtgccaaaaggcaaaaaatactgtcagaagacacaaaatgagcatcagaaccagctcagatatggtagaaatttaggaattatcagatcgggaatttaaaatacctatgattaatgtgctaagggctttaataatagaaaaagtgaacaatattaaaaaatgaataggtaaaattgaaatgcaaagaaagtgtaaaaaggaaatgcaagaaattataaacactgtaacagaagtgaagagtgtgtttaatgggttcatcagtgagctgataagaaaagaatcagcccgatatgtgggtcaaagaaacctcaagagaaattaaaaagtattttgaactaaatgaaaatgaaaatgcaacctatcaaaatttgtgagaatcagtgaaaacagagcttagagggaaatttacagcattggatgaatatattggaaaagaataaacatctaaagtaaataacttaaaattccatcttaagaaactagaaaaagaagagcaaatcaaatgtaaagtaagcagaaaaaaataataaaaatcagagcagaaatcaatgaaattgaaaacagaaaaacaataaagaaaatcaatgaaatcaaaatttggttctttaaaaacattaataaaattgataaacctttagtcagactagtcaagaaaaaaaaaagagaagacacaaacctctaacatcagaaatgatagagggacatcactatagatcccgtggacattaaaaggataatacatgaatataatgaacaactctatgcccagaaatttgatacctagatgaaactgactagttacttgaaagacacaatctaccaaaactcacaacaaggagaaatagattatcttaatagacatatttcttatagaaattggatcgataactgataatcttcccaaagacaaaacaccaagaccagaaaggcttactggtgaattctaccaaacatttaaggaagaaattataccagttttctactatctgctccagaaaacagaaacagagagaatacttcctaattcattttataaggccagcattattctaatatcaaaatcaaagacagtacaagaaagggaaactaaggaccaatatctctcatgaacatagatgcaacagttctcaacaaaatattagcaaattaaattcaacaatgtataaaaagaattctgcaccatgatcaaatgggctttattccacttacgcaaggctggttcaacatccaaaattagtagtgaaattaatcacatcaacaggctaaagaagaaaagtcatatgatcatatcagtagatggataaaaaacatttgacaaaaatccaacacccattcatgatacagactttcaaaaaactaggaatagagaactccctcaatttgacaaagaatatctacaaaaacctacagttaatgtcatacttaatggtgagaaactagacacttttcccccaagattaggaaagggcagagatgtttcttttcacttgctcctattcaacatcatattaaaatgcaataagacaagaaaagtaaataaaatgtatgcagattagaagacataaaattttctttgtttgcagatgacatgattgttcagatagaaaatgcccaagaatcaacaattttaaaactcctccttaaactaataagtgactataagaagattgcagaatccaaggactataaataaaatatcaattgctttccaatatatgagcaatgaacaactgaaatttaaaattaaaaaaaaaaaccatttacattagccccaagttaaaaaaagaaaaatatgtaggtgcaatctaacaaaatatgtatacgatctatataaggaaaactacaaaactttaatgaaataaatttttaaaatccaagaaaatggagaactattccatgttcatggataggaagactcagtattgtcaagatgccagttcttcccaacttgctatagagtcaatatattccattcaaaattccagcaagttattttgtgaataccaggaaactgattttaaagtttatgtagaaaggcaaacgacccagaatagccaacacaatactgaagaaaaacaaagtcacagaactgatactacctgacttcaagacttactatacagctatggtaatcaagactatgtggtgctgttgaaataatagacaaatggatcattggagcagaacagaaagtccagaaaaagacccacacaaatatagccaactgatgtttgaaaagaaacgaagacaattcaaatgagaaatgatagtcttttcaacaaatggtgctggaacaactggatatccacatgcaaagtttaaaaagtgaaattagatactgattctacacttttcactaaaaatttattcaaaatggatcatagacctaaacgtaaaatgtaaaactataaaacccctagaagataacataggagaaaatctagatgaccttgggtatggcaataactttttagatacaacaccaaaggcatgatcctgttgatgacaaaactaaactctgcgaaatattttaaaaggattattctgagccaatgtgagtgaccatggcctggggaacagtcttaagaggtcctgagaaagtgtgtctgaggtggtcaggttatggtttggttttatatgttttagagagacagaaattataagcaaaggcataaatcaatactcagaaggtatatattgattgatcccagaaaggtgagacattgtgaagcaggggcttataggtcataagtgaattcaaagattttctgtttggcagttggttgaaagagttaagctttgtctgaagacttgaagtcagtagaaagaaatgcttgagttaagataagaggggttgtggaagccaaggttcttgttatgtagatgaagcctccagatagcaggcttcagagagaatggatggtaaaagtccctttttggaccttgaaagttgtcagagtttcaattaatctctcctagatctggggaagtcctggctgtattaatggagattctctacagatgcgaatttcccctacaaaaggtggctttgcagggccatttacaaatatgtcaaagaaatataccatgggataaaatattttcattttcttcagggtttgctatctgtcatgtgatgctatgccagagtcggttggaatttggtatcttactgccacagagtcttctctgtcagtttcatgatctctattttaatgtaaatgttagttagctgtgcctaaaccccaacagggaggggttataatgaggtgtgtctgacctctcttcccatcatggcctggaatttagtttttcaggtttctctgggatcctattggccaagaggggtctgttcagtcagttggggggcttaggattttatttttggtttacaatccataaaagaaagaattgataagctggactccatcaaaattaaaaactgctctgttaaagacattgttgagagaatgaaaggacaagccacagactagaagcaaatatttacaaaacacatacctgataaaggaatggaacttaaaatgtacaaaagactcttaaaatttgacaataggaaaaaaacaacccagttaaaaagtgggccaaagatctgaacagacacctcaccaaagaaaatatacagatggcaattacgcccatgaaaagatgctgcacatcgtatgtcatttgagaattacaaattaaaacagcaatgaggccaggcccatggctcactcttgtaatcccagtgctaaaggaggccaaggcaggagattgcttgaggcaatgaactcaagaccagccttggcaacatagtgagacaccatctaccaaaaaatttaaaaattagctgggcatggtggcacacacctgtggtcctggctactcaggaggctgaggtgggaggattgcttgagcccaggagattgggtctgtggtcagccatgatcatgccaccacactccaacctgaatgacacagcaaactccatctcaaacaaacacaaacaaacaaacaccacaatgagctactactacacacccattagaatggctaaagtataaaatatgaacaccaaatgctaggaaagattaggagcaacagaaactcttgttcattgctggtgggagtgcaaaatgttgcaactgctttggaaaacatttggcagtttcttataaaactaagcaacctttaccacatatatataatgaaaacaaaccaaactttcttctcctgctatactgtcaacacagaacacttctggtcctcaaaatgtggaggggctttctccacacacctgtaattgcctgacgggttcttcctgcctgccatacagacaaaatctattcatgagaccatggcattgtagtagagaaaagagtttgattgatgtgaggccggcccacacgggagagctggagctatcccttaaatcagtctctccaaaggcttagaggttagggtttttatggacaattaggtggacagggggttatggaattgggtgctgctaagtggttggggacgaaatcacaggagcgtggaaaacagtcctcatgtgctgagtcagcctctgggtggggccacaggaccagcctagtcatgagacaggagtccaggtggggtcaatctaaaaacatctcaaaaaccaatcttaggttctacagtaatgatgttatctatagcagtggtctccaaactttttggcaccagagacaggttttgaggaagacaatttttccacagaccagagggtgtgggggaaggtgttgggatgaaactattccacctcagatcatcaggcattggattctcataaggagctcacaaccctagatccctctcatgtgcagttcacaatagggtttgcactcctatgagaatctaatgacaccgctgatctgacaggaggcagggctcaggcggtaatgcttgctcgcctgcctctcacctcctgctgtgcctcctggtttttaacaggccatggagtagtacctgttggggaccccaatctatagaagcaattggtaaagacacaagtcttgtgacctctgctcacatgactcctgagcagtaaggggttatagaaagcatgcctacatctcagcagatttcagttcctcccataatcctattcttgtagctttcaatagtcttacaaaggcggttttcagtccttgagcaaggaaggagttagttttagggagggactattattatccttgctttcaagtggaactataattcctcctgaagttagcttggcctacacccagaaatgaccaaagagagcttggaggtcagaagcaagatggagtcaacaatgttagatttctcttactgtcacaattttgcaacagtggtttcacaccaagcaattctccagtgcacaccaacagtgccccataattcaatttaattctgacactaactaaagttagcacagatgctgcaggttgaggtatttgcctcacaagatggcccttatttccaatgccaattgcaagtcccaggtcatttcaccagtgcttccaaccttctggctattaatgcggggttctcatggccctccttgtgttagattacttgctagaatggctcacagaactcagggaaacactttacttatgttcactcacgcatgataaaaggatgtaaatgaatagccatttggaagagatgcaccgggagaggcgcgtgggaaggggtgcagggcttccacactctctgtgggcaccactccagggacctccatgtactcaccaaccagaagctctctgaactctgtccttttgggattttatggaggctatcatgtaggcatgatttgttaaatcactgtccactggtgatcaacttgaccttcagccttctcccctccctagaggttggggatgggaccacaagttccaaccctctatgcacatggctggttcctctggtgacctgctccatcctgaggctgtccaggcgtccccagcccccagtcatctcattagcacacaaaagatgttgtcactccacagattccaaggctttaggagctgtatgtctgggaaatgggaaaaggaccaaatgtacatcacaagatcatgccatacaacccagaaattatgctccaagagattacccaaatgagttcaaaaccacacaaaaatgtgcacacaaatgtttatagcagctttattcataattgccaaacttggaagcaaccagatgacctttcatgggtgaatggataaggaaactggttcacccagacaatggaatactagccagtgacaaaacaaaatgcgctgccaagcccagaaaagacatgaaggaactgtagctgtgtttgctaagtaaaaggagccaatctgaaatggttgcacactgtgattccaaccatatgatattttgggaaaagcaaaactatggagacagtaagagaggagtggttgccaggggtgagggaggagggaggggtgaattgggagcacagatgagtttaaagcactgaggcggctgcaatgctagagtggtggacacagccgtgacatatccatccaacacacagagtgggtgtagtgcagaccatggagtttgggtgacagtaatgtctcagtgtagcttcacctattgtaacaaatgggtcacactcatgcaagctgtcatttgtttattattattgttttagagacagggtctcactctgtcacccaggctggagtgcagtggtgtgatcttagctcactgcagcctcgacctcctgggctcaagcaatcaacctcccaagtagctgggagtacaggcatgcaccacgccagctaatttttttttttttttgtagagatggggtctcactttgttgcccaggctggtctcaaactgctggcctccagtcatcctcccacctcagcctcccaaagtgttgggattataggtgtgagccaccaagcccagcctgcaagctcttagggaaaactgtggtggtggggagggaacacatggggacactgtacttactgctcaatttttctgttaccaaactaaaggaagaaactgaggcaaaactaatgtgatttatttgcactgagctgaggatgactttccccaacgtatgcccagcttgccttggggagtgccccctgggccctttgttgcaagcaggttttcaaaggcaaaaagggggttcagggactggcctgacaccaagttgttcatcaggaattcttaccaggagcaagtgtgtcagtgacaggacggtggccaggcccgcctttcccctcgtgatggtcatcgtccttgaaataccaggaggcagcaggaccccccagggtccaggttcagtctttggagatgcagtccgagggtctgtctgcagagcctccattcatgcagaccaacatggaacaggactcacgggggcacacgtctccgccttgccatcaaccagatacatgtgtgaattcccacctggccctgagtcacacccagtttagtgctttcacgggaggaacacctgccgtcctcacagcagggatctccaaggatggcccaaatatcggcttcccagtgatactgctcgttcctgcttggaaactccttttccacggtggtgagatattgaacttgactcatggaatagaagctccccgggatgccaccaccttgtgaaatagcagctcctcaaattaccttgttatgcttctaatgccagggtccaaagaagccctctgttgccaccagatacattttgaacccagttcatttagaaaccatggttggtggtcatcatctacttgtgttctgagaaaccacaaagttcaacttcagctcttcagttatggtcttttcatattattttagaatgtgaaatttatgctgtgtgtccctccttttatgtcatgaacacagcctgctccgtatggtgcctaacgctcctgtgacccctgggctttcctcgtgtttaacgttctggttttctccttccttgaggtccctgtggcctcttcaaggtcctgccttcctcccatttattctttgtggttctgtacagactgatgcatttattttgcctttcccaactaagtattcctcactctgttcttgatggaggggagaaggagggcaaagaagttaaatttacttcagggcatcaaaatgaatgtctacttaataactttgtaaaatgtaaagtgatacatataattgtaaagtagtgttaattttacctaataattacagttaaaaaatatatcattggtttacagaagtaacactgcttagtgatgagctacacattgttgagctgtgggcatgggttatggagtccagcatgcagcattgtgggcttcatttgcgctgttccaagggatgaacccacagctcaagggggagtgggaagtggctgcggtcttgttttttttttttttttttttttgaaacggagtcttgttctgttgcccagtctggagtgcagtggcacgatctcagctcactgcaaccttcacctcctgggttcaagcagttctcctgcctcaccctcccaagggactacaggtgcctgccactatgcccggctaatttttgtatttttagtagagacggggtttcaccatattagtcaggctggtcttcaactcctgaccttgtgatctgcccgccttggcctcccaaagtgctgggattacaggcatgagccactgtgtgcagccagtggtctcgttttaatgtctcccagggcctgatatttttaaagggctcaaattcctcagataagaaaagcatattgaagcaaagactgcttctgagtaagaacaacagaagcaaccccagcacctggaatattggggttctaaaaagcgacttcttacatgaacttttagattttattattttattgtctatggttggtagcatttaatgattcacctgaacgtgactttgaaacatacgctatggcacaaaaacgaattccaattccaattaatgatgggaagagaatgtgtggcctgggaagacctggagtctgctttggagttatgtcctcacctctaaccctcatggcatacatttgtgtaacttttgcaagcttggaagaacacgcatgcctgatatccacaccccacccgctggaacctgtggattgcttgcttacaccgcaccagggactctgcatagggaactcggtgatgaatcttgagatgggagatgctcctgatgacctggtggggcccaggtaacctgcagggtcctcctaaggacggaaaggcttgaggcagagactggacactgctgtgctgtggctgtgaggatgggttaaggggcaggaaccaagggagacagagatggaccccccagtgcctcccgacagagcctagagggcaacgctgccatttcagaactgtaaaacgacagatttgtgttgttttaagtcaataataacaacaacaacaaagtcaggctaattctttctttcattcaataaacactgaatatggaccatgtgcccacgatgctgggagtgaggacacggctgtggaggacattgccgggcacctgcacttgggcaatgcagctcacagctgcaccgagactcacagagcctcctgctgaaacagcagaggccttcgcgggcaggggccaggggcgggtgggtggagagagcagcaggcgctggccgggccctgggatggccgggtagcagggagcaggcagaccctccctaagaaacccagcaccccgctgtcctcccggctgccggcgcccccgcgcgctggccccccgcccaccatcgggcgccctgctggtcaccgggcctctgcggccgcctcagcgcatgagggttccgtgaagaggggtcgcgtgcccctcagccggcattcccggggctcgggaccccggacctcccagaggaatcactctcctatgccagagcctggcctcaagggagacgctggcgtgaatctaccccggcccgccttggaggggatggggctccgagcctggtctgggctgtccaactgggcataagcgtcacagccactgccaggggagggagaacctggccagaggccccgccgtgggctgtggagccagcccctccgcagccctgtccatgtggggcaggcctggtggcccacacagccggtgctggagcctcgcgaggagggggtcgggggacaaccgcatctgtcccagttcccgtgagggcaagacggggcgctgtccaggaagaaaccctgtggagggaggggagcgcacctcaacgtttcttccttccactcttgcaggaaaatctgggggaaacgttattaaggcagaaagagtgaccctgttcctttttttggtaactccattcactccacttcaaccataagaatcccaagcaggaaacttaccaagcatcacaaaccacctcgaaaagcaacaccacacaacctacatgctggaccgctgaggggacatacacccggccactgagcggacgcacgcagggcccctgagtgacgtggggacgcacgcgggggcgctgagggacgtggggttgctgagggatgcacgcagggccgctgaggggcgtacgcgggactcgagtgacgtgagcacgcacgtaggacctgttagtgacgtggggacgcacgacggggcactgaggggacgcacgcggggacgctgggggacgtgggggcgccgagggacttggagggcgccgagggacgtgggggcgctgagggacgttgggggtgctgaggggacgcccgcaggggccgctgagggacgtgggagtgttgaggtaacgcaggcgggggacgctgaggggactcatgcggcgggtgctgaaggacgtggggcgctgaggggatgcatgcgcggggcagtgagggacatggggacgctgaggcagcgcacgcgggccaccatcggccaaggatgagaccattagaacatctgcaatgggttgaaacgcctcgaatgcagtaagatccaggagttataacgatactaaaaatagcaacaatgacccaagtcacctttggacatgctaaaaaccagcggtacctcaggatgaccaaatagttgatgagaaaaaatccctcttcagaaaagtattacagctcacaggtgaagaaaggagacacagaatcggagcatcttccctccgaagccccacaatggaatcaccggtgcagggagatggccaggcctgcggcacccgagagaggccgtctgacccgggtcctctgtgcaggcagagccccctccggtgttgtgttcccgccaaaactggccgcgaatcgcagatgatgatgccgggatccgcgcccttgcaggagagacgggggtgtggggaggatgccggcagctcagggcacagtccagacctggggacaccacgggacaaaagacaagtcacgagaggaagaagcggagagaaccaaggattttttcctggttggaaaaaacagagtcttaaaaatcctgtgggatgccagggagtcctgggcgctgatatctggtggcattaaggagtcaccatcaattattttaggcataaatacagaactggggttgggtggggtgtttggttcttatctttgagaatactttctgaagtgtttatggataaaataatatgatgtctggaactgttttaaaatagcccagtgaggaagcgggtggggtgctggccttggcaggaacacggggccattgtgctggtctctcgcgttgtgttggaactcactataaacagcaccagcgagggacggcagcctgccctgtgcctgccctgaggtcactctcactgtgaactcggctccctccagcccagctctcacagggtcacaggtggtggcttcagccaatgtcctgtgcaggcttcttcctgaaggaacacagagtcctgagagtgggatttcctgtggtgattcttcggtctcagagtcccgagggacacgcgtgtttgagaatcttctccatgtccatctggatgatcttcgccttcattctcctctcctattaaatggaggccatcagcacacttagacacgcctgccagctttaagagtttagagctaaacaaatgaagcacacagtgcacttcaaagacttcgagaggaaggctcagtgtgcacagaggccccaggaaccctgagcttccccaggatgcccatcctgagccctcgggggccatctaacccactcaaactccaaacactagtctctcccccatcacaaggaaagacaggcatggtcccccacccatcagcggtgttgctgaatctggcagccactgtgtttgtcagacctgcctgccttgttcagcagggaaaccacttgctatgatgaatggagctgcatgtgaaacttagataagcaggcaggtcgaaaacacctcctgtgccagcattccagttttcttgcttggcccaagaacctggtttcattttggaaggtggagggagtgtgtggcgaccttgttgccattttcaggcatggctgggctctcacacagtcactcttagaacagacatgtccctgcctggaggccaggccctcttgggttgtgggaaccaagcccaaaaatgtcaaacaagtggcaaaacctttagggtaattttcctctaactcaaaaaacacctggccgcttctcctccccagatgttaaaggtccttttattagcattgtcctattgtgtttttttcatttctcagacacagacacaggaagcatcaactctgaggctttggccaggatgtgagcccgactttcgcagccccaactggcaggctgacctcatgtgaactccctggcgatggcatcctggagacacccacatggctgagctggcaccatagggtgagggcaccagggccatggggaccgtggttgcttgcctcagacatggccagcaagggaggcacaacatggggctgttgagtgaatgtgtgagaggctgtgggtccccacagtccagccaccagcggcctcgcagcatcataggagtctgaggtccaagacaccggactcacatctcaaccctgccctgtgctgctcagggccaagtctaagctgctgtgacaaagaggcccccacatgcagcagctgccacagaacacggtcatctgtttttcatgcacgctgtagccctggtcattccagccagagcctccaggttttgttgctcttccagggcacgttctgggctgtgtgatggaggctggactgtgggctcctctgaggaggtagagggatgcgcaccagggcccccgtgttgaggctcggctcccaccccatcacctctactctagtgaggccacttcctgcgaaggtagctggatgctcctgcctggagctgcccccggaccacagagcatccaggagatgaatgcacttccagccccgccaccctggggagatatacagctgaggtggcagctttggagcaagcagggcagagatgcttccccctgaggtccctcccagctctgctaccttgtcactcaaggtatgggttggttgtgttccccaaaaatacatgttaaaatctgagtcttcagcacctcagaatatgacatcatttggaaataaggtcattgcagatctaattaccatagtgaccccttatcctggggaaaatgttccaaggccctggtggatgtctgaaacctcagatagtacctaaccctatatacactgtgttttttcccatgtgtacagaaatacgataaagtttaatttataaatgaggcacaataatagattaataacaatgataaaatagaacagttataacaatatactgtaataaaagttatgtgaatgtggtctctcgctctcaacatatcttactatactgtattttcccttcttcttgtgatgatgtaaagtgctgtaaaatgccacgtggtgagatgaagggaggtgagagatgcaggcattgtgatgtagatggaaaattccagaaatagaaaattcctcagtgttcagttatattctgttccgagccatcccatccaagcctgggttgccattggccacttggcagtcatcctagtgaccagatgggctgtggtgtcacagtgcttgtgttcaggtcacccttcttttacttaataatgcccccaaagcacaagtgtagccatgtaatatttgtggagcgtggttgaccgtgagtgactaaaacccagaaaagtgagatggaagacaacgaggaccactgtagttaggatgaagtcgtgactgtgtccttataagaagaagggtgacacaggagcccatgtggtggtggaggcagagatggaagctgtgaatccacaaacccgggagcatctggagcttcggaggctgaggaggcagggaggaccctcccagctgttgggggagcacagccttgctggcaccttgattttggacttcaggcctccagagctgagagaagatacatttctgtggttttgagctccccggtttgtggtacttttccaactgccccaggacactgctgcgccaatgcccttgaccttcaaggttgcattctggctgatggagctgatgggcaccccggcttcactgcccttgggctcccactctgactggcctgtgctgaaaggttaaaaatagctctgcatatattaaaatagctatgtcaattctaaaggctcacacagctgctctaagtgtcttggatactcttcaaaataatatttataggcctcttcaggctctgtcgaaccagcttttttaacattaattaaagccaagctcattagtttgtttacaagttggacttggcacactttagcacttaacaggagatgaaaactgcagtttgttcaattttcttttaataattttgtttacatttttgccagcactcataatccaggttcagtttctgccagcactaatttggtttattccacatggctggagccactgcgggactccatttgttccggggccaccttcctgtcaccttttactgtttcttgagtcagcaagaaaggcagatccgactgaagactccagcactctcctcagctgcagcccccacagagctccgcgaagtcctttctcccacaggacagatctgaggcacccaccattagaagaaaggagtggagaaatgatatgcaggaagaaggcccattctgattcaccaatcgcatggacgcactttcctaccaggctaggagggaggaaagtagagccccaccctgactgctaagccgtttgctttggtgtcatgaaaaaagagttcagcttcccaaatcagagaggaaaaggttttcaaggggtcccctatttctattatgtaagctttaaatgacaaagtggacctctggggccaacgtgggtgtgtgatggtggttttgtgggattctccccatagccccatcagacggcctcaccttctgggtctcagtggccccaggtgcaacacggctcctccagaaatgatgacagccctggcgaccaaggactccctgtgccactgggtttgcgctcagaagtatattcaatgatttccccagaaaattccaagtcatctcctaatactgtttgtgaaaactaaatgaactgtcgtggtcttcttcagggacagtttgctaggaagggtggttattggcataattttccaaatcaatgaactaagttacaaaactttctcaaagaccctgatggctgttacaaagacagaaaagtgaatggtcagaaagaagtgtgataattcacccagtattgggaggacgaggtgggcggatcacgaggtcaggacatcgagaccatcctggctaacacagtgaaaccccgtctctactaaaaaaatacaaaaaattagccgggcgtggtggtgggcgcctgtagtcccagcttctcgggaggctgaggcaggagaatggcgtgaaacctgggaggtggagcttgcagtgagccaagatcacgccactgcactccagcctgggcgacggagcaagactccgtctcataaaaacagcctaagacaaccacacagcacacaggccttcatccttggctgtgacggatgcgtgtccgtgtggagggccaggcctgtttctcccgtcactaatggaagcctctctgagtttccatgaaagtctccccctcagaaggggctctctggaaattttcaattatgttggttaggatagtaatacatgcttttgcttaaaaatcaatgggtgcagaaacaaaagtataaagtacaaagtgggtttcccctcctcagccagaggcaatgatgttagcaggtcaaccccgataccgccgctcattgcttgaggagcctgtgtctttccttatgtacgggggtcatgccacggccacccctccacacgagagcgggggcattgactaaggccagagccaggcactggaaaggcgcagtggcccctctacctcacaatggtattgctaggacccacgtgcatttggggccccacatcaaagctccccaagcaacccccttgaaatgactttgcttatagctcacctccaggaagggcccttccctagagaacagaaggacacaatatccctcaggctctgggaaagcagccgttatcctggaaaccaggactcctaggagattctgtgcctcccccatgtgggccgtcttgatccccacacagactccaggttcaggtgctcctcgaggctgggcatccctccaccaggtggtcctggtacggcccctctgtcctccgctctgggtcttgtctgatgagctcatgcccgttcaccacaggctcctgggaggaggacggtgaggcgggcagccctcctgagccccttcctccttgcagagcactttccggggcctgatgcagtggaaggagctgagcagttccccatccagcccaaaacaggacacctcagggctcgaaaccctcagagtccccacccacacgctacccacacaaggccgatgcctgagtgtgaaacacagaacacctcctccatctccacctgacttcactgacttccctgagcattaaaaaataaaaactaaaaataaatgaaaccctgaagggtttcaaagcaggagagaggccatgtccagactgaaggaggcacattcttgatgagtccctggtccagcaaaactcccacctcagatcagcccaatgcttttgtgtcgaatgccacacatgtcatggtgtctgtttgtttgactggttttgcccagtctggaaggcttggagtcacaaagttaaggtcatgaggcatgactgtgacaattaaggctgtccccatgacaggatgtgaatctggacttcagggtacgggtccgtccctctgagagtgaagggaaacgtcctgcccacaccacaatggcacctacatgacacctagtgacacccacacggcagtgacactgacactgcagcgacaccgatgtggcaacgacacccacatctcagtgatacccacgctgcagtgacacccacacagcagcaacacccacatggtagtgacacccatgcagcagtgacacccacaccacagtgacacccacaccacagggacacccacaccacagtgacacccacacctcagtgacacccacgcagcagcgacacccacaccacggtgacacccacaccacagggacacccacgcctcagtgacacccacgcctcagtgacacccacgcagcagcgacacccacaccacagggacacccacaccacagggacacccacaccacagggacacccacatggtagtgacacccatgcagcagtgacacccacaccacagtgacacccacatcacagggacacccacaccacagcgacacccacacctcagcgacacccacacctcagtgacacccccaccacagggacacccacacctcagcgacacccacacctcagcgacacccacaccacagcgacacccacacctcagcgacacccacacctcagcgacacccacacagcagcgacacccacacctcagcgacacccacaccacggcgacacccacacctcagtgacacccacgcctcagtgacacccatgcagcagcgacacccacaccacagggacacccacaccacaaggacacccacaccacagggacatccatgctgcagcaacacccacacctcagtgatacccacaccacagtgacacccacaccccttttcttctgcagccctgaagtcactcccaggccccaggctgaggactggcctcagggcgtcatcagaagctgcagaggcatgacagtactgtttcctcagcagcttcatggaaagatccagccaagccatctggggctgagctttgctgcgtcttcctgctcctggccagtgtacgggcttcctgtccttgaaagcaacacctcacttccgacgtcccaagagctgaacttctaggtgtcaggaaccaagtgcctcaaggctctgggcactctagatttcaggtggagctggctggtttcccaccccaaggagagggcacacggttgcttgggtgttgctgtggccctggctcccggtgtcctgctggaggagccttgctcgggtgcccctgatgcagccctggcagcggcagcagggccagccacatggccacctcccatctctgtgaaagggaggcctcactggaccagaattttgccagaccttccagttgcttccgaccaaccagcaggtcctgcagcgtgatgcacatttgctgttctgggtgacaacccccaatcccatgaccgggtcagacaggagggaccgtgcttctctggagagcgagctcagaccatgttacagacacagagaagtagaaaatgtgatgaagcggctaattatgttgctcaaatagacgtggaaatcccgcatcgtggtgcccctcggggcaggcggctctgttaccctcgctcagctacccacaggtgatgctagctgggcccagtgtggcctttgcctccccctgagcttggcaaccccgggctgcctcctgggacggggctgtctctcccttggggatcaggcagctgttgctggtctcagacgacacctgcttgggcccagccccactgtgagggtggcaagtggagctggaattcccacccaggcggctgacgccacagtccagagcccatgcctcatctccgtggcctgcgctgctccattcttgtctaaaatggggagtgagataaatgccccacttacctccccttcccaggaaactctctctgctaggcttcctgggtaaagcggggcctcaggttcccacacggcccggtgtgggtgctgccccaggaaagaactcctttaccgaaaactaccagacagaccctcaccccgaccccctcccgcccatcaccatcaacacacacactctcgacctccttgctctcgacaggcaaggccgtgagcggtgaggagctgtgtgatgggaaacagggaacctccaggccaatgcactccatccacctggagggcttatcatacacctggagggcccctcacacctgcagggcccgtcacacacctggagggcccaccactcacctggagggcccctcacacacctgcaaggcccatcacacacctggagggcccctcacacacctggagggcccctcacacctgcagggcccgtcacacacctggagggcccaccactcacctggagggcctgtcacatacctggagggcccgtcacacacctgcagggcccatcacacacctgcagggcccgtcacacaactggagggcccctcacacacctgcaaggcccatcacacacccggaggatccgtcagatgcctggaggtgagccaatgactgcccgctcatggcctggagagagctctgacatcactcagaggagaagccaggcagagcccgatgacccctcgagtgggggcagagccaggtgaccaggaggctgaggcagcagggcacggggaggggcatgagagaagagagaggctcacggaaaaaggactttggagatttgcagaagatcctctctagtttccagctaaatcaccacacccttgagaagaaacgacccaaggccagagaaagaaccatctgggccgggtgcagtggctcatgcctgtaatcctagcactttgggaggccgaggcgggtggattgcctgagctcaggagttcgagaccagcctgggcaacacagtgaaaccccgtctctactaaaatacaaaaagttagccaggcatggcggcatgtgcctgtaatcccagctactcaggaggccgaggcagaagaattcctagaacccgggaggcagaggttgcagtgagtcgagatcgggccactgcactccagcctgggtgacagagcaagagtctctaaaaaaaaaaagaaccacctgaaaggagtagagggaccaatcccgcagctctcacaggtccggaatagttcccgtttccatccctcagcgtggaaaatctcattatccacaggacattagggtgagcgctcacaaaggctttgcctggagtggcagcttttgccctgactccctgcggctctggttttgccctaacaatgcctaaaagcaagactttagagataaaaaataaattgtctgagatgaaggatatactggatagaattaacagcagatatgacattgcaaaagaatagggaacttgaaggcatagtaatagaagctaactgaaatcaaacccacgcagagggggaaagactaaacaatgaaaacagaatagccttagtgagctctgggaaaactccaagcagccatctgtatgtatacctggagttccctaaataaggagagcatcttggggacagaaaacaatatttgaggaaataataccccaaaattttccaaatataaaaattagaaacccacaaatccaagaatctcaatgaaccccaagcacaagaaacctgagagaaactacagggtacaatgtgataaagtttcttgaaattagtgataaagagaaaatcttaaaagcagccagaggaaaaagacattatgtacagatgaacaaagaaaagaatgattgccgatttcctgttggagacaatatatgctaaaatacgggagggcaatgtctttgaaattaaaaggcacaggggaaactgtccatctagaattctatttgcagtaaaaaagatccttcaaaaaaatgacttttaaagacatacaaaaactgaaagaatgtgtcaccaacatacatacgctcaagaacattttaaaggtttttactgaggcagacaaaaaaaaaaaaaaaagataccagattgagtctgcatctactcaaagaaatagcagtgctggaaatgataaagatatgagtaaatatttttttctcatcatttaaatattttaaaagcattgtttaaagcaaacaatagtactctgtattgcaaggtttatgacacatatagaagtaaaatgcaagaaaacaacaacataaagagaggagagaaatagaagcagactgctgcaagtgaacaggtgactctaataagttaaagctgtataataaaaatcacacagcaacaccaaaataacacaacaaacaattgcagttaataagccaacaagggagaaaattctatcataaaaaatttggttaatccaaaagaaggcaaaaaataaaataaaataaaggaaaggaaacaacaaatgggagtaatagaaaacaaataacaaggtagtaggtttagaccaaatcattttaataagtatattgaatgaaaatgatctaataacccaattaaaaggtaaatatcagattggatttaaaaaaggaagactcagttacatgctacctacaggaaacctaccttaaacattaagacaaaaatagaataaaggaaaaagaattttaaaaattatatatatatatatatataatgcaaacactaatcaaaagaaagctggcatggttattttaacaatcagacaaatagatttcagagcaaagaatattatatctcattatgataaagggatcaattactcaggagtacgtaatttaaatatttatgcaccaagtaaaaaagtttcaaaatacatgaagcaaaacttgaattgtaaggagaaatagacaaatccaaattctagttggagagttcagcactccattcttaataactgatagaataagaaggcagaaaatgagcaaggatatggtagacttgaacaagactatcatccaacttgacctggttgacatttatagagcattccatccaataggagctgaataaacattcttttttagaacacacaggacgtttaccaagatgtaccatcttctggccacaaaacaagtttcaataaattaaaaagaattcaagtcatatacagtatgttctctttctacaataaagccaaattatacattgataaccacaaagatatctagaaacttcccaaattgttggaaactaaataacacagttctaaataatccatgggtcaatgaagatatcaaaaggaaaattataaagtattctgaactgaatggaaatgactcacttaagtgtgggatttaaaatgtgtaggatacagctaaagcacggctttaaggaaaatttctagcataaacatctacattagaaaagaaggaagatctcgaataaatgacctcagctttctacttaagaaactgaataaagaagagcaaatgaaacacactttatttcatttttatttcatttttcttctgtgggcagaagaaagaacattataaaaattgtataatgagaaaataaaaaatgacaaataatacagaaaatagagaaaaatcgataaacccaaaagctagttatttgagatcaataaacttgttgaatctccagccagaatgaccatgacaaaaaattaaataaaaagacaaattgtcactatcaagagaggtgtcattaatacagatctacagagattcaaagagtattgaggggctagccgaggtggctcatgcctataatcccagcactttgggaggccaagacgggtgaatcacttgaggtcaggagttcgagaccagcctggctaacatggtgaaacctcgtctctactaaaaatacaaaaattagccagctatagtggcacacacctgtagtcccagctactcaggaggctgaggcgggagaattgcttgaagctgggaggcagagattgcagtgagccaagatcactccactgcactccagcctgggtgacagagcgagactctgtctcaaacaacaacaacaaagagtgttgagaaactattatgagcagctttatgttagcacagtaaacaacttggatacaatgggaaaacttccccaaaaaaacaaactaccaaagccaataaaaaagaaatagactatctattaaagtatatatagaaacagagtcttactctgtcgcccaggctggagtgcagtggcacaatctcagctcactgcaacctccacctccagggttcaagcaattatcctgcctcagcctcccaagtagctgggattacaggtgcccgccaccatgcctggctaatttttttgtatttttagtagagacagggtttcaccatgttggccaggctggtttcaaactcctgacctcaagtgatccacccaactcggcctcccaaagtgctaggattacaggcgtgagccaccgtacccagccttaaagaatatatattaaagaaattacatttataggtaaaaacctccccacaaagaaaactataggtcctgatggcatcattgtgatttttgccaatcatctaaggaagaaataagaccaattctacacaaacacttccataaaattaaagcggaagaaacacttaacaattctatgaggccaacatttcttagatatcaaaccagacaaagaaagaaaacaacagatcagtaccctcataaacatcaatgtaaatattcttaacatgtttttgcaaattgaattcatcaataatttaaaactatgatatatcatgaccaagtggggttaggattatttcagggacacaagattgatttaacattcaaaaatcaatcaagataattcacatattaatgaataaaaaaacccatatgatcatctcaatagaatagatgcagaagaaaactttgataatatttaatacacattcctaatttttaaaacataatttgcaggaagctagaaatagaagagaacttcctcaacctgataaagagaatctatgaaaagcctacagctaacattatatttaatggtgaaagactggattattttcacataggatcaggaacaacacaagggtacacactgtctccatttctagtcaacattgcatgggaggttattaggcagtgcaatcagacagaaaagaattaaatagcacccagatttgaaaggaggaagtaaaagtgtctatatttacaaacagcatgattatctatgtaagaaaaattctactgaagctacaaaaaaatcagaataattgaattaagcaaagttgtgtgatacaagataaatacacaaaaatcaaatgtttaaacaattagagattgaaatgaaaaacaatgccaaaggccagatgtagtggctcacacttgtcatcccagcagtttgggaagctaaggggggtgggttgcttgaggccaggaattcaagaccagcctgaacaacacggcaaaagcccatctctacaaaaaatacaaaaaattagccaggcatggtggcgcatgcctgtagtcccagctacgtggcaggatcacttgagtctggggggcagaggttgcagtgggctgagattgcgtcactgcactgcagcctcagtgacagagtgagatcttgtctcaataaataaataaataaataatgccatttacaataggacaaagaaagtgaaatatttagaaacaaatctaataacatatatatcaggcctgtacattgaatactatgaaagactgtggagataatttaagaagacttaaataaatgaaagatataccgcgttcacatatcagaagcctcaatactgtcaaactgttcattgcctaaaaattgacctatagatttaatgcaatctcaattaaaatcttggcaggctttttgtaaagaatgaccagctgattctaatattcatatgtagatgcaaagaaaacagaataaccaaacaactgcacactttgagaaagaagaacgtttgagtatttacactacctgagtatttacattacctgacttcaattcttgttatgaatctactatagtcaagacagtgtggtattaactttaaaaagagacaaacaaataaatgggacagaacagagtctacaaatagatttgcacatatattatcaattggttattgacaaaggtgcaaaggcaagtcagtggagaaagaatagtctttttaacagtgctgggatgattgcatttccctaggcacatacgtacagatacacactttgtttcatacttcagcatttataaaaactcattcaaaatggatcaccatcttaaatgtaaaactgaaatctacagaacttctgtaataaaatctttgtgaccttgagttaggcaaatgtgacaccaaaagcagaatccattaaagaaaataagctgcacttcaaaattaagaattctgatctttgaaagacactttaatttctttttatcttggagacagagtcttgctctattgtgcagaccaggcttaaactcctgggctcaagaaatcctcctgcctcagcctctcaagtagctgaagctacaggcacccactaccatgcctggctaaagacacatttaatagaatgaaaagacaagccgcagactggaaataaatatttgcaaaccacacatctgataatggacttgcttctagaatagttatagaactcttaaaactcaacaaacagctcaacaattggaaaaccaaacatcccaagtgtattagtcaattttcacgctgccgataaagacatacctgagactgggcagtttacaaaggaaagaggtttaactggactcacagttccacgtggctggggaagcctcacaatcatggcagaaggtaaggaggagcaagtcacgtcttacacagatggcagaaagcaaagacagagagcttgtgcaggggaattcctctttttaaaaccatcagatcttgtaagacttattcactatcatgacaacagcatgggaaagacttgcccccatgattcaattacctctcaccaggtccttcccataacatgtgggaagtcaagatgagatttcggtggggacacagccaaaccatatcaccaagtaaaggaaaagaaagaaagtaaaactgaaacagacatttcaccaaagaagatatctggatggcaataagtacaataaaatttgttcaacatcactagttatttgaaaaatgcaaatttaaactacaatgaaataccattatatacatattagagtgagtaaaattttttttttcagtggagtgtagggtttctttttttatttttatttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctggatacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccccaaaaccgccattgtcatcatggcccgttctcaatgagctgttgggtacacctcccagacggggtggtggtcgggcagagggcctcctcacttcccagtaggggcggccgggcagaggtgcccctcacctcccggacggggcggctggccgggcggggggctgacccccccacctccctcccggacggggcggctaaaaatttttaaagtgaccacagaaagtatgggtggggatgtggagcaactgggaccctcatgcattgatggtgaaaatgaaaaacagtataaccactttgaaaaacagtttaaaaagttaaacaaatacctactatgggatccagacactctgctcctagatatttccccaagagaaatggaagcacgtgtgcacacaatgtccacacgatggacacacacatgaatgcctacagcagctttatttgtgatagtaaaaatttagaagcaagtataatgtccctcaacaggtgaatgataaacaaattgtgttatatccatacagtggaatactactgagcaataaaaaggaatacacctgcaacaagatagatgattctgaaaataaatatgttaagtgaaaaaaacagacaaaaaagtgtacatacagtataattctttttatataaaagtctagaaaatacaaacaaatctatagtgatagaaagttggtcagcggtttttgcatagaaactgggatgtggggtagggtggggacatttaggagggaggaattaccaaagggcatgagaacacttttttgggtgatggatatgttccctaacttgattgtgatgatggcttcacaggtgtacacagctttccacctcatggccacagaccggttaaccatccatataaaacatccattgccctgggtccaacctcctgccccctgtggaggtgaactgtctacttcaccattgatatttcaggttgtatgatatagtgcctgacaactctccatttttggaacacatccaaattgtttcttattcattttccatttctgccttcgaacgaatttcctgcactggtaactaggtgaagaattttggagttatctggggtaatggagacatcctccattgcaccgcatatttgctttctgtattccccagttatagaaatcaaaacgagcagttgtatgtgaatgcattgtatcaaaccaagtctctagatgataggaggcattgtcattactaggatagtaactcagtagaaagagtgaattgagaatatgaggaatgagagtggggtccagactaaaaggaggccaggggtcctgaactgccccatccaactgagttcattctgatacctactgatctgaagcagcaggtccacgcccaggtgcagattgtcccagatgaacaggcagaggctagagatgctcattcctaaagggatcaaataattctgagaatggcaagaactccattaactctcttctccaaaactacaaaaatgtgcagaaaatacgaacaatttttaggagcttacactctttgaagtttatccatgggctgctggaacccttaggaaataatagctagaagtgcctcagacactgcctggcacacagcaggtgctcaatgaattacactgcctggcacatagtaggtgctcaatgaattgtctgatgaagtgattaaggagccttgtaaatactgattaaaacatgtatcaccccatccaatttttcaaaccagtgcttctcaagaacaagcaggaaaattaatgtaatattgttttgaagtagccgtggtggtttcggggcagaagcccaggggtactccttactccgcctgctccagtaactagctgacatggaagtgcctcgtcattctggttcagacacaggtgcagatagatgacttctctatcccactttaattctccttgaagatcattcccagggacattcatttgcttaaattaacatgctcggccaggcgcggtggctcacacctgtaatcccagcactttgggaggcccaggcgggcggatcacgaggtcaggagattgagatcatcctggctaacacggtgaaaccccgtctctactaaaaataaaaaaaatcagccgggcgtggtggcgggcgcctgtggtcccagctactcgggaggctgaggcaggagaatggcgtgaacccgggaggcggagcttgcagtgagcagagatcacgccactgcaccccagcctgggcaacatagcgagactccgtctgaaaacaaacaaacaacaacaacaaaaattcatgctcataatcccactttcaaaccagtgacctcaaagatttctagcagcaatcctattccattcttccaattacagaaagcaaagagaaactggatctggggatctaagcgttgagcctgctgagcagaacggccattcatttggggtgaggtgctgactcactgcccctctacattgcattttggggtgtggggatttccagagcaggattctccagagaggagtatccaagctccctcctcccgcagcagggggatgctgggctaactgcctggttcggtcccccgtgagtggtctgctgtgttttggttctgtttgtttgtgtgtgttttgcctatgactttgcgaaatattccaagacaagagccagaaagtcttggtctctgaagacaagcacaatgttgctttcagcttaaatatctactgggaaacctcaagatttttaatgtcatcattatgaaaaacagagattataaaaggaaaccgtcgcatttcactcgctggcccccagtgggattggatctgacctcagtgtatcttttctttggtaggttttaagtcttgacaaaatgtgcctaagaatgaagactccaaaaaggatgcagtagattcggggggagtgggggttggaaagaggcttaaatcttcacatgacacctggaatatggtcaaaatgtacctgctcaagttgaaccaggtattgcgtcctccttttaccccatcgctagtgaagacaaccaccgcctggggagacgctccttttccgaaacactcgagtcccgccgcgtcccggacgctccgctttccccgcgcccggatcctcccgggaacccgcgccccgcccgcgcgctggtcccgcccccgccgcctccccgcgcgcagccgcccgaacacgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctcctggggtggaataaatgtcacccgggatgaaagagtggttctggatgaaccatggaggcctgtttccgcttacatttctagtggttgacttgacccctcttagatctgcctttctgaaagctctgaggctgtcagatggccactgtgcacttgtggacatagctcatccctgcagagatgacgcacctggggctgttgcccgggggctgcccacagccccacaggcccgtgccctccttcagctcagcctagcttggtcgctctccccggcctctctgttttcctgtttctttaatgatgaatcctggcctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtgatgggagttgagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcactcaggaccccatcactttaatacaactgcggttgcgtcacatggtttctgtgctggcatgttcatctcctcaccctcctgcatgtggctgagtggctttggtgcccgggaggcatccctcccatcctctcacagcctggccccagcagcctctgtcggcttcttttcagcgtcatctcagttcccagcgttctgccctccttcccagcccccatgccaaatgataacaacccgctttccctctggtttttggatctggccattagcttgctgtctgtttctgtttctgtttccggttcctgccggcaggtggatgctggggacagcctggttggggcaggggcaggggcagggtccagaggctggcttgagtcccagccggctccagcacaccaggcccacccctcccaggaccctagtctccactgcatcctctgccacactcttgggagaccccaggcccgaggggactgtccaagcacaacttcctgctaatgcatgaaaatcatccatgaacttctccctgtcaaaggccaggggctccttgtctttgaaatgttgctcactttacattttgtgcagtgcggctgattgaggaaaagggctgtggcctgagctcaagaggtgaccaggacctggccatggtgactgtcagagcatccttgggtccctggcctccccaggcccaggatcctgatgtgtggtcctccacgggtggttgtagggaaggtggtcccagccccctgccattttaggatgtgggaagtgcctggccgccgttagttaacacgcacctacccagccctggctgtttcccctgggcaggctcctacgagggagggaagggacagctggagccagctctccagtgtgctcaccttcatgtccacctgctaaactgctaacctgcccgaagtgtgtcccactgccccttgctggggcatcttcctggttgcgccttcttcccggaagcacccgctgtgcagcccttccagcaggcagatactaagcccggcacccctcccaggctccaggctcacttgtgtgctaacctctgtgcccacctggccacctgctcacctgcctgaagcgtgtcccactgccccaagctggggctgcttcctggttgtgagggaagtgcctgctctgcagacccccaccttccagcaggcggatactaagcccagcacccctcccaggctctggccctccccacacacctgtggtttcaagccctgttctgctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttgggaacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattcacacatggacaccagcacagataggtgctgactcatggatacaggtgtgcagggacacacacacccctacctagacacatgcacacatgtacatatgttcccatagacacagatatacatgcacacacacaggcacacacatactaacagacatgtacatacgtatgcacacattcacatagatatacgtacacacacacactgacagacatgcacacacataaacaggcacacacacatactaacagacatgtacacatacatgcacacattcacatagacatacgtacacacagtcacacactgtccagacatgcacatacaaggcacacacatactaacagacatgtatacatacatgcacacattcacatagacatacagtcacacagacatgtacacatgcataatgacatgcacacacatactaacagacatgtacacatacatgcacacattcacatagatgtacctacacagtcacacagacatgcatacataggcacacacagacatgtacacatacgtacacagtcacacacacagacatgcacacacaaaggcacatactagcagacatgtacacatacatgcacacattcacatagacatatgtaagcacacagccacacactgacagacatgcacacacatacatgcacacattcacatagacatacgtacacacagtcacacactgtccagacatgcacatacaaggcacacatactaacagacatgtatacatacatgcacacattcatatagacatacagtcacacagacatgtacacacatgcatgacacgcacacacatactaacagacatgtacacatacatgcacacattcacatagacttacatagtcatgtacacacatgcataatgacacacatactaacagacatgtacacatacatgcacacattcacatagacatacatacagtcacagacatgtacacacatgcataatgacacgcacacacatactaacagacatgtacacatacatgcacacattcacatagatgtacatacacagtcacacacacagacatgcatacataggcacacacagacatgtacacatacagtcacaaacacacagacatgcatacataggcacacacagacatgtacacatacgtacacagtcacacacagacatgcacacacaaaggcacatactagcagacgtacacagacatgcacacattcacatagatgtacatagtcacacacagacatgcatacataggcacacagacatgcacacacaaaggcacatactagcagacatgtacacatgcacacattcacatagacatatgtaaacacacagtcacacacactgacagacatgcacacacatgcacacattcacatagacatacgtacacagtcatacactgacagacatgtacacacatgcataatatgcacacatgtacacacagtcacataaatagacacatatacacacacaggcacacatggatgcccagccacatgcatgcagacacacacagacacatgtgcaccctctcacacacttttctctttctacaactttggggtcagaagaccactgacagctgcagcaggatcactaaaaagtgacacaaggtcacggggctctgtggccccagcttcctcagacccccagggtctctccactcccagagccccctgcctgaggggccggagccctgtggccaaggcctttcctcctgggcccatcctgaggcctgcaggtggaccccggcccggcctcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgctgaacgtctccctttgttatttaggaacaaaacactcttttaggaagcaagtgcttatggcttctttcttgagattctgagtaaaggggcgttaagcttgctagctggggcatgctgagcacttcccaggttatggctttaccccagagcgattgacaggcatccaggtttcctcatgcttcattttcccctgttttctaaggttaaaactgagagctgtttctccaatgcaaagctgcttgtttaagggtttcgtatttgatgttggaaatgctctggactcttccatggtttttatattccagtgatttcactgcaaacctggtgtgtacgccttgtaaattttgaccctggccaagtgaaaggttcattttaaaagttttaaaataaattttaaaggggagctggaagtggaataagttaagaacagtatcagttttgcctttcactctgacagaggcactctctgctctgactgacgggtgttgattaaaagtataatattcaaaagaaatagtaaagtgcattgggccttgttaatgttctactaattttctggggctccgttttcaaattataggtgaaatttttttccttccagtgttagtgcctatgataagaaaatacattttctccacatctgtccacaaacctgctagaccctgttttgtgactacctccccttggaacttggggctccatggaaaacacacagcttgacccagccagccctcagagagcctgggccggtcactgcagtggctggattctcagcataaaaaggccaaacgttcggccaggctgggactggctcccatccaggaccaactgtccacagtacagtaaggccactctctgagtcaacattgtttcttttctgaattgctaagttgaccgtccctgcagaagcagagagggctgcggtgtggcattcctgcccactccaaatgagggcagcccggacgcgggagctctcagggaggcgcagtgggctttgggtgtgtctggactgtctccaccacacctggaagatactgttcacttcctttttacacttgtgggaaatacatgacagtgtttacgggcaggctggctttccgtttatttcaaccctgacaattgaatagcagcagcagatgatgaaactgttcacttcccgatcactcccgttctcagatccatcacttagctcgtccgtcgctcagctcgtctgttagtctgaaagatgaatcgtgcacgggtcctcctgagagtgctgttctcggggtctccatgtgtgaagttgttacatcctcatgacaactgtgtaacagctgtcactgagccattttacagatgtggaaactgaggccctgagaggctgtggagggctacagtgtgtcctgggcatttgagccccacactctgtcattaactcctgtgctcgctgggactgggggagagcaggacgcggcagcacccccggccccactgtgtgctcctctgtgtgcaggcgactgtgagcatactggcacccatgtgagggctgagtggtgctggtgtgggcgcataaagcacagggcggctgcggggagctgggtgtgtgtcagtggctcggagcattagtctcgtgaacatggtctgccaggtgcgtcatgctgggctacagagcccatggctccaccataaatggtggttttgtgtttgaacttgagtgttgctgctcagtgaggccagaggaaggcaccaacctgcaggcctggccggtcctcacaacacggaaggcaaccagtccactagagagacatgtgtcccggccactggaggagtccaagtgacctttaagtctcaccagtcctcagagcaacccaggtgaatttggggcctgagcttggtcgtctggccgaagaccagctcaacttggataaagctggaggagaagcctgtccctcaggcagctgccagggcatctgtgatttctgcttgcgtgcactcttggcgactattggtggtggtcgcagtcagggcatctggttgcctttactgtccttacaccagctgggcagagctcaggctgggagcccagtgggagaggccggggcgtgactcccggcgcagaagcggcagtggcacaccggcgtcccaagcacagctgtccctgccaggcccctgcgcgttggatctttgggttgagtcatgctcgatggtgcagccatcctttcaagggaactgagctgtccagcgtcccatggagcagctccccgtggatccggagaggccgtaaataaacctccccatttgtaagccgggaacacacatgaactttgcaatcgtgtttgtcctgggatcatagaacgtggtggctggcaagacccaggcatcctcatcctgtgctgctgtgaacagaggccggtagcttattgagggaccagtcccagttcgctttctgtggggaagactctgatggaagcctaggccccaaactccaaggttagcacatcttcttggggggattgacacctccaaaggtgaacttgggtccaaggcacgtgtgtgcgacctgaagcatgggtgccgtgtgcaggagacgccctcaccggagatggggaccgagtccacacggctctaactgcagaatcactggccctgtgcccacgactattttattttgctgttttatatgatcacaaagtacactgtcttgtttttcccaaagcatttgcagtgagacatcccacttcctctccacggcagctgttgcgggcacgaggctgctcccaggacagcgatgccaccggggctggggtgggcacggaggaaccctcttccttcctcctccccgccctctgctcccccacagactggcctgtctttagtcagcactttcccaggctcccttctgcccaccacgtgcaaacagtggcgtgtcctgggcctctctccttgtagtgtttcttgtggccagcatccctcccatccaacagctgtgtggcttcctgactggcttctctcagggcccgcaaggatgctgccaaatggccagagacagtcactgctctgcacttcaaagcaggcagccctcggtggggcttgccctgaaagacagcgggccttcctcgatgagagcctgtgctggctcagggcctgtgggggctgcagctctgttccttccctgcgtccacgctcacatgctgaatgttgtgcaccacaggacaccctgctgggggctgtcgggagcatgctctgtgtttggggcagagacgggcagagtgagtctcagcattactgccgtgcagggttgagtctcagcatgacttccatgcagggggagtctcggcgtcactgccatgcggggcgagtctcggcgttaccgccgtgcagctgctggaagccactcgagctcctctgtctcgtttgccatgaagcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatgccgggtatactgactgtgctttcctggggcctgtctccctccaggtcagcctggggtcctctgggctgggggccatgcactgcctcctgtgggcagtgggatcagcacttccactttgctcagggctagagcaggctgctgcgggtgtgaagacttaggaaacgaattcggaaggaaggaaaggattttgcacttcccaagctagaagaacatgaatagagccgggctgccaggccaagggtctgtaagacggcggctcttcagagagtctgcaaatgctgagaaaggaaggctccccaagggcagttcctgtgggcgttactctgagttttctcatagaagtcaagttcttggaagacagcactatggtcaaagggttagtgaattcttgtgaccatttcccatggaaaatatcagagaaagttatggtgttgataaacagagtccctgtgctcagcagtctccacccacttgtcaagtaagataaagatttttggaaacaaaatttatggctgttatttgctaaagagagtaatacattcttagcacactctgaaaaataaccactatttgctgtatgaatgcagatgaaactcacacaaaaagatttatgcaggactgacatcgggtgtttgcagaaggttctccacgttcactgacctctgatcctcactgcagctctgcggggactgtggcccaaggatgagtgagcgtcaggtcgggccgtgcccttaatcccctggctgcccctcaccaccaggcagagaccttgctgggacccaaggagttaaagtgtattcagagatgaaggtgtttaggaaatgttctggaaccttccaaactgactttaggctgcgtgaggtgcttccagttcagtgcactttgggcccaaaagtgtttcctgtcttgttaatgcactgtgttgtgtgccatcaccgcatggaggttttggccatttttaaaaagtgaatgggccctcccagggtctagttggatcgagagaccactggaaaccctcaccaagctgcaggcaggtaggcaggggccccagagcaggcctaggggaagagtccccccggccccttggagggtctcttcacgtgctgggtgctgcctgattcctgcggtggcatggggaggtcaccccaccttgttctgaaccacagctctgggtgaggaagcctgtcaccaggttaaaggtcatttgggggttggggcgtgagaaccgcagtgccctgctggtagggttgccgcatgggtggccaggctacagcctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacaccgggaccttctgcagacggggctcccagcctcgaccagccccggaacccccagcacggggacgtccaatcttttggcttccgtgggccacattggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcgggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactgggagcattgattttgacttttcttccaagtacttatctatgatttaagtgaaactgagcattcagtgctctgtgggagtgaaaactgcaggcccttgcacttgcccactgattcattcattcacccatccacccactcattcattcaactatccatgcactcgctcatccatccatccactcattccttcatttattcatccatctccatccatccagtcacccattcacccactcactcatctatccactcactcacccacccattcactcatccattcacccacccactcacccacccacctattcattcattcatgtattcatctatctactcactctcattcacccattcattcattcatctgtccatccattcacctatccacccactcatccattcatgtactcactcatctacccactcactcattctttcattcattcatccattcactcacccatccacccactcattcattcactcatctggccactcactcatccacccactcactcattcattcatacactcactcatccatctattcactcattgttttattcattcatccatccatccatccactcacccatctatctacgcatttattcatttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctggttattcacccatccactcacttatccatccatgcatctgtctgctcactcatccatcctactcactaatctatccaccgattcactcatccatccattcattcattcatctgtgcatttatccatacatgcatctatccatccatctatccatctatcaatccatctgttcagtcattcatccattcactcatccatccatccacccactcattcatgcatccatctgcccatccactcatttattcacccatccattctttcacgcactcatccactgtccatctgtcatccatccatgtgtttggtgacggctcatgaggcctctgggggacagtcagcaccaggctcggtgctgggcaggtagatgttgtctttttcctcttgaagcttcagctaacagtgcagtggcttggggtttgctcacttatttttatctgtagctgttcaaataaaacagaagcagatccccggggaaaggatttccaggggccaaatggcgccatttccagcctgggaatcccagcttcttccccctgttgccctcacctaaccccagcacgccaacccattaccataggtcttgctcttcctaggtttagaagaaagagagtcagtgtgtacataaggagctcctggttctaaattccggcctcctgagtggtggcctctgctccatggggactcctgggggtgctgctctggagatatggctaatgcagggcttcaggccaaggtttatggacctgaacaagcagtagtgcagacaggggtgggagggttttgaggacaaagtgctctgtgtttggttctgcaggtcagggagcttatctgggtgcctttactcaaagccatttctgggtcttacatctttggctagaatgttctcaggacaatgtgaaatgtctttatctcaggagtgtataccagaatgttctcaggacaacgtgaaatgtctttctttcttgggagtgtgtaccagaatgttctcaggaaaatgtgaaatgtctctttttctttctctcaggagtgtatagcgtttttaggtttattcatcttagcttttctcttgctcatggtttaaccatctttcccctagtttgccggtggaattagcatatgctttctgcctccattactgtctcaaataatcaaacatgcaaattaggatacagtgcccagggctataaccctgtggtttcagaaaccccattcccataggtgtggcgaactgacaggagattggcatagtttttccatgaataatgcctttttgcaacaataaaacttggtattaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccgccctcccaacagacacgtgagctgcacaccagctcaccctgacccttcctttctcttaagggagtaagagtttaagagcatcccatctttcctagaacacaactttgtgaaaacacatccaagcaggcctcaggagggtgttggcaaggctggggcggggcctccaggctcttcccacaaaaggtgtggcaaggccagcaagtgtgggagagaggtgggaaggaggcagaaaggccatgcagagccagcgcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctgctggccaagtgacaggcaggtggttccaggactcgacagctcacttgtgtcgaatgtggacctcgtcagtgcgctttcatggataagaagacccttcattacagcctccatcctcacccagtaccaattttgtttcaccaatactataagtgcaaatcaatgcccgtgtgccaaaagaaaggtctttggggttttgagagacctttgtgtcaacagggaactaaggtctttgggttttagagacccttatgtcaacagggaactaagagtggggttttacttggaagcattcttgtcctcctgggcaggcctctcccctggacacacctggtagcacttcctacgcagctggaaatggccctgcctttgcttgttggtctcacagcagtcgtgccccggtcacttcccctcagttccccgggtggggcggccctctggctgccccgagagcagcctctgattaaccagctgatgcttatgttgttcagagaccctcgtagtgtgccggtcaatgcttgccttttctttttctttttccacaggattatttttacccaagatacttaggtaagtctcaattacttctctactctggttgtcgtagaggcatagttgggggtgcgtgtttcatgttggaggaatctcctcaccacgtaactcttggaaggaagattcttaatcacatggtgcacgtggaactgtccggaacatgcaggtcagaaacacaagtttctctctttattttataccacagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctctttgagagcatttcacttagaaggagagaaatgtattccagggtcttctttttaatgttgcaaagtgcattttagtaaatgtcctcttaaagggtccttccctgggtccatatctggaacaaacacagtgggtctggcactggcccagaaagcccaggcaccagcgaggactgagttctgaagcagggggtggccagcggtccacagcacacctgcaggaggccttccgctgttcatccgtgccgttctgcgcctggataagcaacagtaacccactgaagggccaggtcgagaggccccgcaccgttctgcacaacctcacgcttcgggttatccctggatgtgcatgtgccaggcctcgcctccccccgccgccctagcgggatgtctgctgtcaagctgtgttcagccagccagagagcatggaggggctttctccaaagcagagtggctttccagttaagcacagcgtttcccaatgggggtccactggaaaatgaagtttagcttttcgagtaccgtcaggaacttactgagcattcccggtgattctcccgtatggcaggaggagccccctcgaaacggcgggcggtgctttacgcacttgactgtgggtgcacaactccgctgagttggtggaggtggtttcctgtttgtcagggttggggctaacatgttttttattaacacaagctaagcggcattgtttctggaggatgatagcaccccaggtaagcagagtaactgcctctccagagcgtctcagaagcagaggctctgcagtccatccggtcttgtaaggatgactgacatccattccctttcttcctgcagactgcatcaacaagtatgggtctccgtacaccaaaaactcaggcttcgccacctgcgtgcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaataggcaataaatgcacatggaacaaaatgtaaatgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcacaggagaccctctcttagcgtgtctcaccttcacgctggcatttccagccggtgcatcatatgaacttagcccatgcatattggctgatgtccaggttatttccaatttccatcatttaaacaaaactggcgtgacatcctcatgcacctgttgcctcccacacgtctgagtgtctgcgggatgcgttcccaaggatggaatcgcagaggcagtcctcatgtttcctttggatacagatactgccaaattatcccagagccagccttagcctccgcccctgcaggggtgaatgaactgtttttttaaacttttgatctcttccaatgtaacaggcgagaaatgacatcagtcatttcaggtttttttttttttttttaactaatgagtaaagctgtccttcataggtttaaaaactgtgtatttcttttcctataaactgttgtttatattttttgcctgtttttctcaatttgtaggagtttgcacattagccattggtagtaaagttatcaaaaattttttcagcttgccacaagtcttttttattattttaaaattatcatgcaataagattgattgttttgggtgtcctgtatgaattttaacataccttcagcacaacccacacagctccccttgcactgggtctgtggtccgctggcgtcacgtgtgtctagttttagatgaaagtccagcttggtgagtccctgtgggcgctgagagcagaggcgtggcgggacggagtcatcctgggagaggcaggagtctcttcccaggcatggctttggagctggatcccagtcagcagaaggagtcagaggtggctcagtcccgctccccaagccccacgcactgtccgtgggcgtctctggcctcccggacttgtatcacagaccccagcccaagagacacaggcagaggaaatgctcagtgtaaacatgggaatgggagggtggccctgccctgtggcccggcctgccctgacctgcaaccatgcacagtagccaggtgccacgtagggcccaatgtctgcatttggggcagaggctcctgcgtgctcagaggagacaagcagatcctgtcacgcgtgttttatcttagtgattgctaaaccagtctcttcttttaaattctgtattcacacttgttatactctcttagttcctgggctttaggcttctccccaagattacaaaacagttacctgctgttaggtgttttcatctgtgacccgcccgtaatttcttttgacgtgatggatgaggtggggatctagactgcaggctcagttcctgccccaacaccacacatttgagtctgtctcaccccagtgcctcacctgctgccgtcctcatatgctgggtatttgggagattttctgccgggtttccacaggccgtggccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcgtcgcctcgcttccttgcatggatgaagaggagtgattgctacatgttcctttctgttcccgccgcccaatagagttatcttgttttggttatttcctttgtggcatcagcgtccccaagtgcggccagctggggagaggagggcaaggtcaagatccttgagtttgttccctgtgtgataggaagagaatctcttgctgtggctggtgccagaggcaacacatgcagtttctaacgggtccacctgccccaggccagaagctccggccactctccctgagccggccctcagaggctgccctgcctgtggcctggggctctcagcttctcctccagagcacgtggctggggcctctgatgttcgcgtgcctcaaaagatgcctggcggtgaagaaggtgctttggtggcctggccacagcaggcagccttgcactcccttgggaaggcgcctcccggaggatgcagctggggcagcctcacactctgttcctgttcattggttccctcgtgaaaattctctgacttggtgctcacggtgctgtcctggcttcagttcactggttatcggtcattgtgaaattaaagccatagccccataaagtccaaattcagccccagacaagcaggcccccagcgggccttgcatgggagcctgcggccctcaggctgtcccaggacccaggcggcacagtggacggagggaggaggcctgggaagagtgtaggctgcgttcccaggtgcccctgaagagcctctgcttccatttctttcctttcccacggacacacccagcttctccactgcgaacgcgcccgtcctgccatagcggccacttggtgcttggatttctcggctcctttgacccatgggtttccccaggaaggtcaggtccccacaggcggtggcccaggcagcggtcactgagccccggctaccgggatcccacccccgccacggggagtgtcccctcgcccttccctcgggcagacagggctctggtcctcgctcgtcaccacccagggaaaggccctggccgcccgcaccggcttcagattccagccacagccacagccgctccctcctgtccttcaacgcagtcatgggccaagctgagataaacccttcacctcctgaacaggcgctggcgcccagggcatgaccagccaggccaccgataccctaggcccagcttgcgggatggggatcagggaggtgggcgggggtcagggaggtggacggggtcagggaagtgggtgccctcgggggcctgcagaggtttctgtctccatcgctttccctgttgtgtggaggaaattccacagatatttgctgggcaccggctgactgtccacccctcaggtgtggttccgtccttgcatcctagaggtatcaatacattcccaacagggaaataaacaaatgagttgggggaggccccggggcaggtggcatgagtctggggaccgcttaagagctgggcacctggcaggagcaggcactgtccctcagcctcagggacagaggtctttccgaaaggcattccaggcaaagtcaagaccgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatgaggaagaagcaaaagcggaaatcctgatcaaccagtcagatctcgtgagacttactcactatcacgagaatagcacgggaaagaccagccaccatgattcaattacctcccgctgggtccctcccacaacgcgcaggaattctgggaaatacaattcaagttgagatttgggtggggacacagcaaaaccatatcacccatgtcccttcctctctccgtggccggtgaccccatgtggacggaccgtcacccatgtcccttcctctctccgtggccggtgaccccacgtggacggaccgtcacccatgtcccttcctctctccgtggccggtgaccccacgtggacggaccgtcacccatgtcccttcctctctttgtggccgttggccccatgtggacggactgtgtccctcccccactcagtagttgcctctgcttgggagctcttgtgagcagtgctgctgtgtgaaatgtagaaactgaggcaggaggagactccctgtaacccaaggtcccaagctaataaggtggggccagtctcaacggacccctgcccagggcaatgctctgaccctgccctcctcagtcacaacctgcagctacactaggcccccacctctgagctgcaggagaagcctgtctcctgtgctgtcccagtgaggcagggagtgcaggtggggccacagcaccccaaaccccccagcaccccctgccccggggccacagcacccccaaaccccccagcaccccctgccccaccatcccctccaccccatctcccgcggcctccagggtctcactgacctcggctgtgcatgggaaccaagtgagggcgggattgggagcccatccctgcagaggaggctgggatcagaaggccccagcggagcccagagagggggttcatcagaccgtgactcaggctggcagagcttggtggccccagacaggatccgtccacatgagacaggtgcacctcgagagcagccgccgcccacactgcaggccaggcattggccggagccctgcgccaggtgggagctgccctgggacctgggggaccctccagccaccacgaaccttgagtcaaattgttcacattctttgtggctgggataaaggataaggacatttttgtggcaagaacaaaactgttgaccttggagttgaatatttttgaacagcttttgactctagacaagattaaaagtcgggaaagatcgatgttgtgtttgggggaagctggtgagtgcagcctcggggaagcactctgatgcccccacaccgcaccctgcgaccgagggctgacatgaggggaaggagggttattcctgtgactttgctggccagagctccagggggcatagactccctgcccagacctgcagttcagcttctctgctgttcgcacccctaggacaccaagaggtgctggtgcctgcaccaggcagcttcgggggcacagcccgagctccagggtgcccaggaaccgcccacacaagaccacggcaccatcggcgcccatagagccttccctgaggtaaagtgagagccctggggactcgggaaatccgtggcacacttttcttcccccacaggcgctcgtgagtgcatctcccggcgctccagaaacctcttggtctctgctgcttgttcagcttcttactcggagccaggcacccacagccctggaggaactgggcggtgatttccagacaggacgccgcacctccggctcgtgcccgacctcccggactggttcaaggccagtcagccctgagaggccaagaccacattctcctggacagcaagcttgtgaggctggattttataagataaaaatgacaagcagtggcgggttcacagaccagagctggctgcaggcctttcagaggcccgttagggcccctgggcccagccagccaccgttcatgtgtggatgtgcgctgtgggccttctgcccaggagcgctggacacaggatgagaccctccgtcgggcagagggaggctcccgggcagcggagggggcagaggctgtgtgagaccctccatcggacagagggaggctcccgggcagcagagggggcaggaggctgtgtctgcacgagtgtggctcccctccaccttatcttttttctcccagatccaggactgggcaggggagaaagtccccgctccacctcccaggtgggcactgttccgtgaagtaagctggagacctcagacccacacgggagaagagcggtacttgtttatcgtaggcacggggggctttgcagggagggacgtgaggccctgagagcggtgaggcctggaggcgccagcttccgaggggagagggagtgactggggaaccgtgagcggcccacagagcagagacggcgacttggtgtcttgtggcacgtctggggagcaatgggatcacctctcgcccgccctcccgccctgggagtccctggttccctgaggatctgacttcaggagttcagagaaagcctctccccacatccaacacttttcaagagacttcggctactttggggtggcgcatcctgaactcctgtcactggggcgcctgtgacccacccgggacccgtgacccactcgggacccgtgacccacccgggacccgtgacccacccggggcccgtgacccacccgggacccgtgacccacccgggacccgtgactcacccggggcctgtgactcacccggggcctgtgacccactcgggacctgtgacccacccgggatgcctgtgacccacccgggacctgtgacccactcaggacctgtgacccacctgagacctgtcctgtgacccacccggggcctgtgacccacccgggacctgctgcttcccaggcgtgctcacccgtctccccaggtgtgcccggcaggtgcatgctgggcccgcggggagctaagctggtttccacagggagtgctgcggccccagaccctgagccaaaggaccccgaaacaccgtcccccaccatcccagcggccaggggtcctgagacaaggtgcggtgagggagaagccgcggaaggacagcggaagcccaggcgccgtagctgggagacagctcaggggaagaccctcgtgccagtggcccaggcagatttgcatccggggctgggaaagacaaccgggcccctggattctaacaactcacaggcggttagacacagcgctgggcgttggagccgaagcgtccttcccttcctggcatacgtcaggagcacagcacgaggggcgggtggcttctgccctgcgcttctccaggacacagatgcacacacgaacgtgtaacgcacaacacatgtccacaaacaagaacacacaggcagggaggccggggctgcactgtctttgcaaaatcataataatagctaattaattaagggatgtgaaaacaccagaacaattgctctcagaggaggaggccgggtgggaactttcagcgccatttgatgtgagcagagcccaagccaaggtgtcaccagcctgggtctggagggccccactccctgcctggttccagcctccctcaccagtgtgcccagggaggaaaggaggggacagacttctggaacattctcccgggttctctaggaggttggccacagaagcgggatttctagaggctgccttttttttaaaaaaaaaaacaaacaagttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgctgggtgcaaggaaggtgatctctttaaattgtcctttttattaactgctcaaaacctcccccaccaagtcactgttccccatcccccactgtctcaagtgggagtattttctgctgctaacgacttccatggaacaccctgaatattttctctccatctctgtggaagcagggcccctcctccattgttcttctgaggagcacatgagcctcatctgatttgccatctctgaaatccaattatcagcgtgcgtatattaagctcccacacatgctggcctggcacaaaggctggctgggccatctgagggccccaggcctccccagaggaagaggggaacatccaccctttgcgtaaacccagagccccagggtggatgaggatggagcaccatggggatgaagtggatctgcccctgtgccccccacgtcccgtaagcccgcgtgtgacggggaggaccaccccccacatcccgtaagccctcctgtgatagggaggaccgccccccacatcccgtaagcctgcgtgtgacggggaggactaccccccacatcccataagcccacgtgtgacagggaggaccacccccacatcccgtaagcctgcgtgtgacggggaggaccgccccccacatcccgtaagcctgcgtgtgacagggaggaccaccccccacatcccgtaagcccacgtgtgacagggaggaccacccccacatcccgtaagcctgcgtgtgacggggaggactaccccccacatcccgtaagcctgcgtgtgacagggaggaccaccctccacatcccataagcccgcgtgtgacggggaggaccacccccacatcccgtaagcctgcgtgtgacggggaggaccaccccccacatcccgtaagcccacgtgtgacagggaggaccacccccacatcccgtaagccctcgtgtgacggggaggaccgccccccacatcccgtaagcctgcgtgtgacagggaggaccaccctccacatcccgtaagcctgcgtgtgacgggaaggaccacccccacatcttacacctccgtggggctcacaggcagggaggacacacctgcctgagggagtcaccagcccctccctccacaaagcctcactgtctccaaggtcccaagtcagaatgcaaacttggagaagccgggcccctcacagccagagcttcagacagccgggccccagcaccagggcggcccaaaccagccctggagccagagaagaggaaggggctgatggaaccacgtgttgtctctcctctggggccctgaggggcagcggctgaggttgaggatggaagacagcatgggccaccgaggctatgctctgggctgcacgttcttggcacccatgcgattccaagtctgtgtctgtgtagagccgcttggggagcacctgcaggcccagcgtccctggagatacctctgcccctgcgggcctcctccttctacccctgcgggcctccagttctgggcttggcaaacttcccacgggagaccaggaggccagagagaagcccccaggacagggctgtggccctgggggcacggtccctgccatgatggggacgtccctggggcaggggcaggaggcttggggaaggatgaagctgcctgtggcaccaagcagacgcgcctgcctgcaggagtgaccactgcagggtcgctggcaaaagctcccgccatctgaccctggggaccacatcttcccccgtcacagaaatggaaaagatgtttccaggccagacctccagcaggggccttgtgttcccagggagcagggccccagctttatattcgaagtgagaggggagactgaggtatgaggtgcagggatccctccacgaggagatgttgtcaggccctggtcatctccactgagcccaacagctgctgtgtcccgggcatggctgaaggtggctgacccaagcaggccctgaacgcgagggacccccagcagccccacaggcccctggaccccagggacccccagacgcaccatctccatgagtgctggttcctgctccctcctcggggtccctggtgcaggtccccaggtgagctgagaaggtcgtggctctcgggccccgctcaaacctgagccctctctgtcctggacgtgagggcagagtgtgcacaggcctcccccggatgtccctctaaggaagatcttttcctgacaacgtcatgtgtcgggagagggtcctcttgtggaatatctgaagacctgtgtcatgtgtgacttcaaaactcacgactccccacgttcaccctgcccttccccgcacagaaacacatcacggtgcctgctttaatctgcagcttcatcgggctgggcctgacacagctctctctgcagaggctgctgttaactcacgcaaaaggacctgccagtcagccgggcatgtgggcagtgcctcccacccagaaaggaagcccacgtttatcaggaccagggttctcaactgtgtccccgggggcacacggcacgtccaggcaggagacacgggacacgtccggagagtttgggttgtcacaccggcggctctgatatgccgcaggcagaggccagggcccaccagcaccctcagcacctagggtgccccagcacagcggttggccagccctgaatgcctacagtgccgaggtaagaaacgtggcccggtctgtttcacccatggccacagcacagagcttcatggcacagaaggcggtcatgcccaggagtggaaatcggacaggcaggcaggggccactgtcctgctcgccccccaccatggcctctccctccgtcatctccaaggtcaatagcatcatgtcaggatgaaccctatgatgtctccacgtctgcgggtaaaatggggttggattttggcagatccatatggctccacctaaataacctggccatgcccacaggatgtccaccagcagacaaacgcaggagcctccaccactgcagcggggagctgcccaggcctgtgcggggccagccccggggtcagaagagccagctgccggcagagcatggtggcgggtcaccagggccacctggcgcggtccccggccatacttgcagggaggttgtgccctgacggcagggttgtcactgccccccacctcccatccctaatccagaaggtgaggcggctgcaagacctcatcccctccgaccccagccccatcctgtccatcccactgcctgtgaccagcgcgtccaactccagcaggtgatgctggccctacctgaaggggcagagggtaggacgagcaggtcgggacgggctcgggcgtcaggcggaagcctgcgtaggccaggatctgctgggcggggttgtagagggtctgtggtgggacggctgggccataggccagctgggacagaggcacctgccatggagaggagacgggtggtcggcgtgtaccccctagtggagggaagggctgtccagccttcctagaaagcccagcaccctcgacccccgactctcaggctggaactaaccccggcccggcgtgcgtttatacccaggctggagctaacgccggcccggcgtgcgtttatacccaggctggagctaaccccggcccggcgtgcgtttatacccaggctggagctaaccccggcccggcgtgcgtttatacccaggctggagctaaccccggcccggcgtgcgtttatacccaggctggagctaaccccggcccggcgtagctttacactgaggttctctacatcttggtcccagggccccgccacctgctagtcacactgggtgaccgctcggctcgggctctcttttacttttttgattttttggggggggagaaaaaagcactggtttccttctctccgggccccaaagtctgctttttcggcacagaagggtgcaggtggggagggccctctcagcaccgggctgatggctctcgcttccccaagcctgtgccccaaccagcgtggggtttctggggaatgcgaacaaaaccaaagtctcctgagctcccgtccacactttcactgactcactcaggcagttaaaattctccaaagaaggtgctggctccaactcaggccccggccggcctcatcccctacagagggaggggcccatggctcacacaagcttcagggcttccccgggccagaaacgcggggactgggccgagggcacccgggcttcgcctccctccccaccttcacacaggtgcccctccaccttccccagcccccacccccaggttcagcagcaccctggaggaagccaggggaagatggcaaaggcggggaagccaggccagagccgctgcgaggggctggccacggtgacgacccggggacacggtgacaacccggggacacggtgaaaaccccgggacagggtgatgaccccaggcctgaggtgtcctcagacaacggtgctgcccgcacccctggggctgggagggagccccctgcccagcgggcactggaaggtgggaaggggcagggccttctgggcagctggtccttggtccacatgtgcaggaggccgtgcttctgcctcagaccctgcagagagcaggggggcagccgaggtgggcctgggaggttggatgggcatggagggtcgtgctccgtgagggaggggcaggagatttgcagttctgacaggtagaggggtggggaggcctctgagctggcggtggcctgaggatggggccggggcgagtgcacagaaagcagagaacacgggggccacggagtcacacgcggaggaggcccctgagaggctggctcagccgcccgcccttgccggcacgttaagtgcctcccacgcacccatcacaagtaatttgccctcgtctacgaagggcacgtccagcttggaatgttaaggaatgaaggaagcatcttcattccttaacaaaatgtttaaatggcaaaatcagttaaactcacaagagggcctgcttggtgggtgtgaaggttagcaagtcctctccttgctctgcagccctgagctttgggttcgaggaagacttcctggagccggtgtggctctgcattgcgggctggccctggaggtatcacctgttcctgatcctgcactccagcattttatcacgggctttaatgaacacacgagccccttccggaaaaccctggacaccccgggcctgtgtggcgagcatggcgcctgcaccagacaagcgtttctgtgtcctgtctacaatccggctgcagttcctcctgggacggccgctgagaggagacactgagctgccgaggcagagaagcttgcaccgaggagacgccaaaggcgcccggagcccgcgagatcccggcagagacccttcccgaccccagactcccgctcccaccgcaggggccggccggctgtcaccacagagcaaggacccctgggaggtgcctgtcttgtgttggtgtgcgggcgtctgggggcccagggtggggcttggggggccactgggtggggagccagagggctggacctcgggatgccagggtcactctcagcttcaccagttttgtctggaagcacaaaagtgttgagaaaaggaggagctgagaagcagatggcaggagggttcccagctgagctaatttttagtcatggacagcctctgggacgaatagggcatggagaagccgctcaggagtgttttcgctgcctcgctgggccgggtctggcctgcatgatgtgcgtctgcctggtgctgccaggcctcctcatgtgggtgcaagagggggcgcccctcgtccctgggctgccgtttggatactctgggggttggggctccctcactcctggctgcccatcccttacagcttctctgcaagttcagggggcggggtttgctggccgcacaccacgagaacatctggtttgaaacaggcgccaggagagggcagaggagggagaagagagaggacatccggcccgggccagtgatttccctgtggtttcccgggcgagggccggcctttccaggatgggtccagcccacctcccgcgaggggccccttccctccctcctcctgcccaggccaatcctggctgtatgggtctcgcctctggggtttgctaaggcatcagctcagccccagcccagacctgcccatctgaagccccaggcagttgctaatgatgggagcttagtgcacaagggctgggcctccctcttggagctgaacattgtttcttggggacggctgtgcccacctcagcggggaggcaaggattaaatcaggtgattcttgtgacaggcttgggacaggacggccccgaggtgagtcggtgcacgccagctgtcaccctgacaccctgctgacagacgcatgggcttcagtgccccatctgtaaagtgagggctggaggccccccagcccaccccggggaaatggacccggagccccggctcccagtgagcagcgggggtcccaccaaggggcctcaccatgtccttgaaggcccccaggacggcggcggtgatgatgcccaggaacaggcccaggacgttcagaactgcagaggcccagagcaggcggtacaggtgcagcacgtcctggcagccgctgacgccgatgaactcatagtaggcgggcgagggctctgcgctgcacagagagggcaccatggcgtcaccgcacgaggcaagtgaccacccgcaagttaaacttgtgtcctctggacctgagccctgcagggctgggggaggaaatcagggctggagcccagtcaacgcccatccctgcactgctctgggagatcaaacctatgtctgatgggattggcctgtgaggctccccacctggggcccacagtggcaaagagcggcaactgggcctggcgggcccgcccctccgcctcgatggcctggcaggacgggtgtctgggccccggctgagccatctctgtcttcacgccaggatgggaaggccgtcggggtcacgggcccctgtcccaagagggggccatgcctggggcctcagaggccaggccaggtttaaactctcgcccgacacacacgggctgtgtcctcttgggcagatcaacatttcagagcctctgtcttttcatctgtgaaatggactcaatgtcctttcctcatgtaaacatctaaggagtaaaggagacgatgtaggtgcaggggtgtggggggggtgatgtcaggagcagaaggatggaggcctcacccctgcaggcacatacgggggttcccagcgcccctcacctccctcaggtgtagatataggggtccccagcgcccctcacctcccgcaggtgtagatacgggggtccccagcgcccctcacctcccgcaggtgtagatatgggggtccccggtgcccctcacctcccgcaggcatagaggtcacagcagtaacaggtgttgcttctcaccttcagctggcacttgccgtccagggagtgacaggtgacctggggcagagaggccttgtcaggtcacatgccggtgcccaccacctcacccaccccaccaagggcagggctgcctcatgggagctgggagcggccactgaggcccagccaagcagctgcctcccccgactttcccccgactccagacacagaggcttgggggctcgggggccaggacccttcctgcaggaggggtcaggggcacaggctggtcccagaggccggataatcggggctcagaggagaggccttgcttctccatgatcccaggagcagagggaaatatcagggtgcgtgggcagaaggacagagcccaggaggccttcggcgtggggtgcacagaagcctgagagcccggagggcggcagaacaggccccgtcccagggcgctctccccccaggcttgagcactggcagcctcagaagagacacctgccacctctgtgtgacaaccttgaaagccctggccaggggacaccccccaacacacacacacacacacacacacacacacacacacacacagaggacgcctcccctgacacacacacacaggacacctccacacacacacacacaggatgcctcccccccacatacacacatggcatgcctcccgcctacccccccccacacacacacacaggacacctccacacacacatacacatacacacacaggacacctcccccctaaacacacacgggacgcctcctgcctacccccccccacacacacacacataaacacacacacacacacgatgcctcccggcagctgctggagagtcccagacaagctggcaggtgctggccactgagagggcctccagctcctcctcctctgacacgcgtgctgaggatgagaggctgcgtttagttaaagccaggaatccacacagggcaggtgcgagacacacagagagcgccgtcacagagctgtgccctccgacggtcctggcgaaggcggcggccgcccgcgggtcattactccccgcatctcactcacctggaaagagaaatgaggtcacactgccgctgtcggtggctcagggaaatccagaagtttctcggacactgtaaatgtattatccttgcttcttattgcaataattaaattagaaaaatgctaattggaagagccatacagaactggacacgtgcactctgagactgttgtgatttaatgaagcaagtccagaactctgactccagagtgaaatacagcacatcgaaatgtcaaggtcccaaacacagggggcatcaacggttcaccagctgcaggggtgacccccaggaactattagaatcaaaatattcagaccacgcctatgtgcagggaaaaccgcgtggggtcggcggggttagctgagcaaaacccacatgaatctcagtgctcctgctcacctctgtctggtagacatcgtacaagtaccccaccccactggagtaaaactggcatcttcccgtggtgaggggcctcggttcctagagaaacagataaacacagatggaataaaacaggtgcctccaggcgggagaggccagaggcaatttcaggcctgtgggtctcaggctcagggcctcaaggaccaaggccaacaccaacttgagcctcccagacacagaacacaagatgggagactccacgctccctgcagagcagctgggctgctgcatccaggaggccagacagcagaaagccccatgggagggtacctcgggccatgcatattctccatcagtcaacaagggcagcagaagggagacaggtgcttggccttttgaggggcatccctaccaccccacatcacaggtgttaggctcctgcatcgtttcataaaagaaaatattgtctcttctactaggaaggtagcaagaaggatttcagaccaataaactcatccctccaaccatccaatcatccacccacccacccaaccatccatccaatcatccaatcaatcatctgtgcatccacccattcttccttccatcctctacatctatctattcattcatccataatgcatccatcatccatccttccattcatccacatccatccatccacccatctgtcatccatacttcatccatccatccatccatccatgtatccatccatccttccatccatccacccatcatccatccattatccatccttccattcatccacatccatccatccacccatctgtcatccatccttccatccatccatccatcatccattatccctccttctatgtatccatccatcatccatccttctatccatccacatccatcatccatccttccattcatccacatccatccatccaaccatcatccaaccatccatccatcatccatccattatccatccttcgattcatccacatccacccatccattcatctgtcatccatccttttgtccatccatcatccatcatccatccattatccatccttctattcatccacatccatccattcacccatctgtcatccatacttccatccttccatctgtccaccatccatccatcatccgttatccatcctcctatctatccatccatcatccatccttctatccatccacatccatcacccatccttccattcatccacatccatccatccatccatcatccatccttctatccatccatccatcatccatacttccattcatccacatccacccatccatccattcctgtcatccacccattatccatccttctatccatccatccaaccattcagccatacacccatttgtggccctatccaactatcaatccatccgaccatctgcaacattcatggagcagacacagtgccaaatggtaaggataacgagacacagttcttgcccttaagggatttatagactagtgaagaagacagacccataaactgaccattgcaaagtgcttataattgctatggtagaggacagcaggaagtaccaaaactaaaatgccacaaaactgcatcacctgcaaataagctagggtcacattgcccacgtttagttttattagtatttctcaaaggctcctagttctgaaccaagaaaagtattagaaaccactagtaacactgcaacagatgagaatgagaatcactcatcggtcctttgggcccccactggtgaagtactattatggccggatgcgttctaggtgacacagcaatggaggaagcagacacaagtctctgtctctgggtgtttatcttcccctgaggggacagacatgagaccacaggtaacaatgagtagcccaaggggacagaggctccttcctggagagagggcagtgcaccccaaccccacggacagaggctcctgctgggagggagggcggtgtgccggaaccccatggggacagaggcctagcagcacggtgtcctcggcctctctcaacagttggaaggcacgcatctccccatatgacgcccttagagctgtaattcaccatctgtcttcttcctcagcagcacacgaggcagtgccacattttcctcgatggcatctgagctccagtgagtgctgtctgcgcatccgtcctaaagtcagccctgggaggccccggccaggggccctgctttgtttctaaccaagaggctcccacacttgcctagatgcatgccccgcgtggccctccagaatggacaggcgcccgaggtccggaacctggggacacccccgactgcggtcagagactggaccctgctcctcggcggggccacggccacgggcgcctggagcacagtggaaaccaccgtctggaagccatagaatagcaagtcacccagccacccgctgagaaagctcccatgacgcacctccgtgggagtgtgtgtgtgcgcgcgagtgtgagcatgtgggccgtggtgtgtgcatgcgtgcgcacgcacgtgtgttttgtgaatgtgctcccacacttgccttcatataatgaaaccgttggggcagacaaaggcctaacaccaaccttcagtgcctttcagtgtgatttatggaaaaagagggagaaacaatcacaggtttggtctgagagttcatgacaagcaattcggctgctcccggggaccagctgacgcccagatggcgagagcccacccaggagcccagccagggaggaggggggatggcgcagcccaccggaggctgaggacgcacctcaggaggacacagaaacgattccttggcctgcgactttagagaaaacctgttcatttagaggtgaaaagagcgtggtgtggtgtgtatgtgtgtgtggtgtgtgctctgtgtggtgtgtgtgctgtgtgctctgtgtggtgtgtgtagtgtgtgtggtgtgtgctctctgtggtgtgtgtggtgtgtactctgtgtggtgtgtgctctgtgtggtgtgtgctctgtgtggtgtgtgaggtgtgtgctctgtgtggtgtgaggtgtgtactctgtgtggtgtgaggtgtgtactctgtgtggtatgtgctctgtgtggtgtgtgaggtgtgtactctgtgtggtgtgtgaggcgtgtgctctgtgtggtgtgtgaggtgtgtactctgtggtgtgtgctatgtgctctgttgtgtgtgtgctgtgtgctctgtgtgttgtgtgctgtgtgctctgtgtgttgtgtggtgtgtgctatgtgctctgttgtgtgtgtgctgtgtgctctgtgtgttgtgtgctgtgtgctctgtgtgttgtgtggtgtgtgctgtgtgctctgttgtgtgtgtgctgtgtgctctgtgtgttgtgtgctgtgtgctctgttatggtgtgtgtgctgtgtgctctgtgtgttgtgtgctgtgtgctctgttgtgtgtgtgctgtgtgctctgttgtgtatgtgctgtgtgctctgtgtgttgtgtggtgtgtgctgtgtgctgtgttgtgtgtgtgctgtgtgctctgtgtgttgtgtgctgtgtactcttatggtgtgtgtgctgtgtgctctgtgtgttgtgtggtgtgtgctatgtgctctgttttggtgtgtgtgctgtgtgctctgttgtgtgtgtgctgtgtgctctgttgtgtgtgtgctgtgtgctctgtgtgttgtgtggtgtgtgctatgtgctctgttttggtgtgtgtgctgtgtgctctgtgtgttgtgtgctgtgtgctctgttgtgtgtgtgctgtgtgctctgtgtgttgtgtggtgtgtggtgtgtgctgtgtgctctgttgtggtgtgtgtgctgtgtgctctgtgtgttgtgtggtgtgtgctgtgttgtgtgtgtgctgtgtgctctgtgtgttgtgtgctgtgtgctctgttgtggtgtgtgtgctctgtgctctgttgtggtgtgtgctgtgtgctctgtgtgttgtgtggtgtgtgtagtctgtgtggagagggaagttcgttgtgtaggaaatgagacttactgagaggagagacagtcactggcaacccccagcgtggagactgacggtgaagccgtctgagctgagatctgcaaaatgaaattgtacttttttcacgtcgactctttcagccccggaaagcgactgtgcacacaatgacaatgtactcacaatgtgctgtgctgcaaatacgccgtccacgatggcgcagcagaaggcggccaccacgccaaaactgataaacacgatcgctgccaccagctgcaacagaaggagaggtgtgggtgcccagcttttaccaaccccggttttcaaacgcaaaccaattcaaagtcccagctcgaggtcggggcttctttcacagaactgcctcttctcacctctacctttcgtcctatgacttccagccctggccaggccggactccaccctgcgggtcgtcctcacgcgtctattccgcaagacccacccaggcgccttctgcacggaagggcgttgccatccccgggccctcggcacgcgcctctgagaagcaaccccagacggcagggcgtgtgcccaaccctaatgtgtgctcatcacacgcacacacatgtgcatgcttgacacaggcctttacagtcatcggatcagcttcacacactgtcgcacaacctgcttttcctacctaatggtcttggagcttggagccaggaatggtttatagtgcgttagttaaccagtgcactctgatggatagttaaacagttggcaatttcttgccactacaaactctgctataaagcggggtgtcctgccctaaccctaaaaactagcagggagtctccatccccgtggacccctgaccagagggcgggtgctgtcattcttttctcggtgcctggcttggtaccacgctgggcagagcagaccctcctgaatggccgctgaaaactgtggccccgagttggcatctcgcttggttccgtcccgatggatgagttgtcggctcgggaaagaggtcccagtgacaagcagaacccatcggtaacagcagagggagggcctgtggctcgggcacatggtgctacacagggacaggggaagcctgagtctgttcggacctgtcctgcgcaccaggcacgagcgtgggtgctcgtccagactcagagcagagccgaccgagcagagtggtctcctcctcacacttgcaaagacgcccggcagaggcaccccgaccttccttctccctggggagccaagtatgtggagagaggagttccatcgaccgtgaccctcacgtggaactgctgtggcctcttcccccgatgtcagcatggccctgtgtgtccatctctgccccaggctgcacacctatcgtcacccgcaacccaaagagaagccaaatccagcccatctgccaaggctctaacgctacccgctggattcgcaggtgggacgcattcccatcaggccccacagcagcagaaggcggggggtgggggctggcgggcccaaacctttcaggccatggaccagtggtggccgcctgcccctccctctccttctgaccctccacaccacaggcccgctgggggtcctccctggaagccccatcagagccggtccagggcgcaccacgctgctggccaagcccttttgcggaggaaagtgcagcttcttttttaaacagtgggcaccctcactgcgagtctgggtgtttttatccttcagcagaggaagagctgtcaactgggggcttcctggtgagcccacgcttggcagtcaccgatgccaccttgcattaaatgtgagtgatgaggcggtagggctggggcagcgggccggagagcgagtccacagaagtcagtgcgtccttgggtgggtcccagaccggcacggtccctgcgtgagtcacagagagatggttctcccacctgctggcacctttcttctcaggtgggtcccagaccggcacggtccctgcgtgagttacagagagatggttctcccacctgctggcaccttcttctaaggcaactttcctccacagcagatcagacgagacattctgagagctcagacatcaagcacgtgcccttccaaaatacatactttaggtttacgagaagaggtaggtctgaacaaagtccgggcagttagcaggaagctggccgacacccctgagctctgtctcccagtggctgtgcgagggggcagagggggacgtggccaccagacccaagggcagcacaagggttctcggggtggccttggaccggagcccttaccctcgcatcccccctccacctccccaggcagagcagagcagagctggcaagctgagtccttccagagcgttctctgaactgctgggctggacttgcccctagtggtccttggttccccctctggaaagggaggtgctgggttcactgacttattcatgagtgtcacggacgctccagcgtccccacgggatacgcagcctggtgctgcaggcgcagacatgagcaaaacaggcacctccccgcccttcccgcgtctcacgtttctggcattttatcatcgattgcctaaaagaaagttgagatgctcccagaagaaagctgtgcagaaaaccatggctgcattagcctgggtctgaaccaaaagcttacttctatttggactttctacaggctgtggcaatttaaaaatctcctcttctgcctaattgctctggttcgactgactaaataatgacggagcccatcgcatggtgtagctgcccagtgtgctggaggaacagacagatgagggaggttccctcttgaacagctgaccccgtctgacggccaccatagcaaagcataagccagggctctgggtgcacacacaaggaaggcctcattgcaccctgagaaagaaggaaggcctgaacgagtcctggaagaataaacagaatttcctcaaggggagacagggaaggtgctgggggctgcacgtcggtgggactggggcccactgaggtggggcagaggccacgatgtgcagggctaggggtgagctgcagccaccatgttacggtcagaaggtcgtcaatgccaaggttgtgtggccgaaggcaagagacttccttcaccttcctattttcctgatgaaactgctgcataaaagtaaaatgactattatgcagagctgtgtaaaaacagcgggcagaaattacacctaactgaaatttcctacattcagttaggtataaatacgtaaaatacattaaaaatgtaattgtttgaacaaatacataaaaacacacacagacggctcagagggcaacatttgaggtttcccagtcggggccaagcccctccaccttcccagaggaagatgaaagccggcctccagcggggccgcgtccccagctctggggcctcccgcagttccgggggatgttcctgtcccgcagtgcacccttctcgtgggtgccggcctggatcagggggctgcgtgcctcgctctagcattgcagggagagcggcgtcacatcccatcatgcctgcagacatgcttccagcattagatgcaagcacgcagaggggccgtggtcccgtcaccactgcacacgctccttaagaactcccacagtttctgttgggcacaattcccaaccaaagaggcagaaggaaaaaagacttaaagatgaagaaaatcactttaaagcttccaaagttctttcgctcgacccatccttctaatccgcacaactgtgacatcatcatcacaatttgcattttgcaggtgcggctctaaggacttggggctctaaacatctttcgctcagacagcgcctcagctcaggagcacaagcaccccttccctgctcctggttgagtcaccaccctcagagccactggtgtccccaaggggacatctgtccacacgacgtcgctcccacagatccctgaggggtgtgtgaccagtgtggtcccccagattcgttggggctgcccaacgttaggaagcccacatctgcctagtgggagccgaagccatcccaggaggatccagcgtccctgtccggctcggcggccggcaggtgccacccgctagatgccccggccactttcagaagtgggtggcaggtgactcatccaggctctgctgggtctctcaccgtaaatgcgtgcagcagagactctgccaggatgtgctggccctagatgttcaccttccaacccagtaacccctcatgaatgccatggagccaggaacctgctgcaacccagccctgggcaggacacaggcccagaccgttgagaggtgttcatatttcacccccacccaatttcacccaaaacatcacagaagcaccgaattgttagagcatccctaaaaattgcagggtctaccttccatcacccatgtttcataaacacattcaaacttggtcatgcataacacttcccaccctgcgaacgtcctcgcagatgtcccagctctgcctggctgtccttcctcccgctctttcagtgtgaaaggtaaaattcagcgagagtgtggccacgcgcagcaagttcagtgctaggatgtctacgtgtccggtcagtccagagctaggatatccatgtgtccagtcagttcaatgctaggatgtctacgtgtccggtcagtccagagctaggatgtccatgtgtctagtcagttcagtgctaggatgtccacgtgtccggtcagtccacagctaggatgtccatgtgtccagtcagttcagtgctaggatgtccacgtgtccggtcagtccacagctaggatatccatgtgtccagtcagttcagtgctaggatgtctacgtgtccggtcagtccagagctaggatgtccatgtgtccagtcagttcagtgctaggatgtccacgtgtccggtcagtccacagctaggatgtccatgtgtccagtcagttcagtgctaggatgtctacgtgtccggtcagtccacagctaggatgtccatgtgtccagtcagttcagtgctaggatgtccacgtgtccggtcagtccacagctaggatgtccatgtgtccagtcagttcagtgctaggatgtctatgtgtccggtcagtccacagctaggatgtccatgtgtccagtcagttcagtgctaggatgtccacgtgtctggtcagttcagtgttaggatgcccacgtgcccggtcagtccagcgctaggatgtccacatgcccggtcagttcagtgttaggatgtccacgtgtctggtcagttcagtgttaggatgtccatgtgcccggtcagtccagcactaggatgtccatgtgcccggtcagtccagcactaggatgtccatgtgcccagtgaatccagcactaggatgtccacgtgcccagtcagtccagcgctaggatgttcaggtgcccagtcagtccagtgctaggatgtccacgtgcccagtcagtccagcgctaggatgtccacatgcccggtcagttcagtgttaggatgtccacgtgcctgttcagttcagcactaggacatccacgtacatggtcagtccagtgctaggatgttcacgtgcccagtcagtccagggctaggatgtccatgtacacggtcagttcagcattaggatgtctatgtacacggtcagtccagggctaggatgtccacatgcccggtcagtccagggctaggatgtccatgtacatggtcagttcagtgttaggatgtccatgtgcctggtcagtcagcactaggacagccagaaacatgaaaatgccaagagcttctcatggtgcttcaacccgagtccaggcagtggtgttgggaaagacattgggaatggcctcctccagctcctctggctaagtccgaaagtcattgccagaaccagcctcacgagagctgcctcagggaacagcccacatccccctggactgcctggctctgtcacgacttttctccaggcattgttaactcttgttcagataaattttttgtgacctagaacgtgcatagcaggaaccagatcaattctccaaagacacaagcaacccactctccatagcccatgaggactgcgcatgtctacggccactgccaggagaaactctgtccctgcactggagccacaaggatctggactgaaggctgtgaagatctcattgcattctgttggggcatcttctcttgagcaaaggtcaccttcaaatgcctctgctctcagagtttacattccaacagaagaaagtagatttacaaaaaaaaaaaaaccacactgagcataaggtcatggtgatcagaggaaaagaaggaaggggataaggtggggagggagagtggcccgggtgcagctacctcaagagggcggctgggtctctgtggtctgggacattcgagcagagactcaacaaggtggagaccctgcccaggccacccagcagcacctgcaaaggccccacagcatggcatgtgggtctaaggagcaccagggcagtcggtcggtggcctccacgaggcaggatgagtggggcaggagggagggagggaggcgcggcgcggcccccgggtgcagtggtcagtgggaggggagccagcttccctggggtttcccagaactctggctggggtgagggcagcggcagggcccaggcaggaggtgacggcgatggtgagggccagaagcgcgagtggagtacacaggtcgagtgtgcagagacaaacgggtggagggcggccacacggtgacaccgtgctgatgacggcacagagccagggcccggatgggcaagagcagccacttccatctcacaggtctgttatcacccacacgatgacggctaagatggctgtgtacgccataaatccagcactaggatggccacgtgtggcaggaggagacacagggagccaccagccgagggcagagaggagcctctgctgcgccagtgccaggccacgcaggcagtgcaacccctgagcccccacccaggccagcagctccacctgcgagaggcacctgatgcagcctctgctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccactccctccgccttcccctctgcggcatggtgcccctggccgacacctggagctgcccatcccgtcttaaccacagatgtcttctcaacacctcctccccgtccatgccctctcctccgcctcgcttcctttagagtaaacctcctggagagagtggacggcacctgcagctggttcctccttcctgggtcaccaagcccaaatctgcccctcccaaggtcaccatgccctgcctgccatcaatccaggggtcaccctcagccccagctgacgcgattcaccatgagcatttgacacattcacggctctcacactcccctccccactgctttcccaggcacaacctaattcacttcacaagcaggtccctgctcacagttctaagccatgtacaatttcagctcattaacaatttcctctccagcttcccttcttcacgtctgacctgcacacctgccatgcgggtgtcccagaaccacaaaactcaggggctccccacatggtcgccactgtctacaccctacactcgcaccatccacaccctccaaagaccctgaactttgacctgctcatttcacctatcatcggtttctgtgagcaaacggagaagagaagccgcaccactcaggtcagcaacaggcagcctctgtccttttaagccttccccacacactgaagaaattcttagaacgtttaaaaactgttttccaacttaaaccaatcaggcattattttagtctagaatacatgtttttcaaatgctaataaataagtgataaaggagagcaaccaaattaaaatccagaccgttggctctgggagatgcccaatgtagctcttccgaaaacacccctgcgcgtgcacgtggctgactgtggagctagcaggtttgcacaaggcctactgtaagttttctctattagagacaaaattttaaaattatttaattatgacatattttcacatgttctgttcattaaagtgtcagagtccaggtatgaaacaacgaacaactagaacctctcagaagtgccttacggggcccattgccaggagtaatgtggtctcctgtgtgaaggcatgccccatgcatgtcacatgtgtaactagtgagcctggaacagggctcactcctcctcaaaaaccaagacgtggcctccttctcagtgaatgagaggccactacagatgatctccaacgccaccagcccagaccgagaaatgagaaatccatcgtaatggtttcttctgatgactcgtctgcaatcccttttcctgcctgctctctgacgtggatgccagggaggaaattcactccccagcagagaggaagcagctgctgctagtgacgacagtgatgacggtgatggtgatgacagtgatgatggtgatgagggtaacgacagtgatgatggtgatgatggtgacaacagtgacgacggtgatggtgacaacagtgatgatggtgatgatgatggtgatgacggtgatgatgttgacgatggtgacaatggtgatgacagtggtgacaatggtgatgatggtgatggtgatgatggtgacaacagtgatggtgatgacactgatgatggtgatggtgatgacaacagtgatgatggtgacgagggtgatgacagtgatgacagtggggatggtgacgatggtgacggtgatgacagtgaagacggtaattacagtgacgacagtgatggtgatggggatggtgatgacagtggggaaggtgacaatggcaatgacagcgaggatggtgacaatggtgatgacagtgatgacaggatggtgatgatggcaatgacagtgatgacagtagggatggtgacgatggtgacaatggtgacagcggggatagtaaagactgtgatgacagtggggatggtgatgatggtggcccatggttctctggctagaatcccgaagtccagagccctcacggtttgatgcttgaattcattttacagcaaagcatgccctggtctgaagaagtccatgcacagcctgcatttaccccacgttgtgtgaatgttcgtgtgctttgctttggaaacacgaagtgggagactgcctcagactccactggaggaatcaaacggtctggcccatccccacgttccctcctaaaatccaaaacactccgagaagcatctggctccgggagtgtccgagaagacacagggatgtgtgagtacgtcaagccactatcccaggtgtttttcctgcctctcctgagcccctgagggcaaccctatcatcccttcatcgagaagaggacagggaggcctggggacgtccagcacccacagtcacgtccagagtggggtctccaagcccagcggcaaccgttcctacttctgaccctgaccaatgacctaagggtttcaaaaccagggaaagctcatgttggggagactgaatttctaaatttctgctgacttagaagtttctttaattgaacttttcagctttccagcctctctcctccggtgggtctatttctctgtcagtggtctaagacctctctttgctcatgcatttgctaaagacaacagcaagagaggtaggacgaggagcaaacatgagaccctagtgccagctgagtcagaaaccgcagctgggggtgagggaagcccgcaagcctccctctctgccctgcagtgttttgcctggagggcaacctctgtcatggtattagaagtgcaggtggaaatcagaaggcaaagccagtgcctgcgtgcagggcagtgaacttcaggaaatgactctcagcctgggcactttgccagtgacagagcaggggcatcaccatcttggacaaacactgccattttaagttccctttgactaaaaactgcctaaatccagccccagaaacatcaacttactgactaatgtcagcatgaccataaaccacaaatgacacctccgaccagaaacattccaaccctgcaataaaactctcctccacccagaaacattctgctcctgcaataagctccccgcttcataaacccttaaatacccttatataagagagaacactcctgacctaaattcaccagaagcccctctcaggtttattctccaaaataaacctctctttgatggttgagccacttttcatgtttctttcctctttaactcttacatttggtgccgaaacctaggacaggtgttggggccagaggctctcttgcaacccaggaagccgtgggcagtggcagctcgtcccaggctaattcctagatcctgagggcctctagccacctgccttgtcttttctctcactttactttctgagcaatttgcataaggaggacaactgacccgaagggaactgtgaggcttgggccggggctactccccagtgggctctcaaaatcctcaggtctcagaaatccacctccaaccgctcacaatgggcatttcactctctaacccttctctccttctcctccttctcctcctcccttctcctccttcttcttcttcttcttcctcttcatatccttctctctctctctctctgtcttcctcacgtggctccagtctgggaggcgctttgccaattccaactggaacatccaacaccagacacaaatccagctgactggtaagatctgccctcccctggctttctcatggtacccaggaaagtcagatctgccgtcctggtcctcagaggaccagtgggattaagctggggaaaatcttgggaactcccagtctcttctcaggttaattgtcctctttataaacaggaatctgggtctctgtctttcttctggagacacctagaacaaaaacagacaccctcggcctcctcttaccagctcacatgggtgcccaacaatcccacatccctacaccctccccgctcggctgtctccttcacaacctcaccaaacttggcttacaggggagcctaaagccaaagcgtttagttttttatggtaacacggcctggcccaattcaaactagataacgacagccaatggcccaaaaacagcatctttgactttcaaattctcagggaccttgacaactttataaccaggagcagcaaatgacaagaggttccctatattcaggcctgcctatgtcatgcttgcacccctcatgaaatccttcttcttaaagaaaaccctccccaggtcttcccttcctccgaaatcccttcctccgaaaccccttctgaccctgcagatgaaccccctctgtactctcaaccctctgcatctgctcctcacccgaccaaaccctccaccctgttggcccctcctacccccaagcctttagccccaaacctcacccatcctccttctccaccagtcacccattcagaaactaccccagccagtcaagccacctctgccattctccctctccaggaagtagctggggttgaaggcactgcttgcgttcatggccctttctccacgtctgattttctccacgtctgacttgtcacagatccaacagcacctggaatctttctctgaaaatccctctcattatcacagggaattcctgcacatagcccaatcctttactttaacttggcatgacattgacataattctaactccaccctcactcctgatgaaaaggagcatatggcattcagctgaggccgacgcagataaactccataatcaaaccctgatataaaacccagtggctaacgatgcaggccccgtagagatccagattggacttaccaacagggagacactggcttcaggcaaagaaaccacgtgatcacctgtcccctcgcaggcatggacaaaaatgcccataaggcagttaattatgaaaaactcagagaaattacataagagccccaggaaaatcctgcccttttcttaccacacctcactgaagcgatgctaaaatataccaatttggacccagaatctagagaaggtcaaacttttctccccctccaatttgtttcccaatccaccaagatatccagaaaaaattataaaaattagaggagggtccccagacatctcagtgggacctcctaaatgcagccttccatgtctttaacaacacaaacgaggaacaaagaattcaaaaagacaaacatctccatataaataccagatgctcacctctgctgtccaaaagtcagctccacaaaaagcctcctgataacccgaaagaaaagtcccccacctctgggagtctgtttctgatgtggcaacgctggacactgggcaaaagcttgtcctaaacccctgcccccaccaaactgtgcccaacctgtggtctctggggacactggaaaatggacggctcccaacagggacaccttccccgttcaggtggggctcataatgaagcccccccctccgaccatcacaggaggaaatctcatcgctgccggcactgacaacggaggactgagggtgcccggatcctgcgcccccatgtccagtgagtccacggaacccagggtaactgggacggtatccggtaggccagaagcaagatggagtcagttcagaccgttttcactgtctcagtcataattgtgcaatggcagtttcataactttaaatgattaccacagttttcataaatgatctaggcaagtgattaaaataattagataaatgtaatgggacaaatatttgtaaacaaacttgtcatcatttggaatctaaagttatattaaattaaactacagctatttcattatttaggtttttccaataaaaatatattgtaggaaagcattctttctaaaacttgtatcctttttaaaggttaaataatttgtgtctaattcaaagcttatttaaaggttttatataaaacaaggtaaaagaaaccaggaaataagagagatataaagaaagttacaaaactaaaaagttgtaaagactgttgctaaaataaaaatatcttcaaaaatgtaaacagttggtctaaattatgcaggtcaaatattaggtttattaaatgcttttagatcataaactggttctttgacttaaaaattgttcaatttattttggagtgttaaattctagataaggcctggggatataagaaattagccatgccccctagctatgcaaaaaggtattaaagaaaagaatatttatataagaaaggatcttgtatgataaatttttgtcctgaagtaaaataactggttgtttgaagacagggatgtttaggacaagtcagaaagtcaaggcatgtggtagcttgtctgcgtagtcataaaagaatttatacaagggaatttatgcaagaaatgatgtagaatttaaaggtgattaggcctcctaaatgctttataaaatgccactatgactcttagctgtacaacttgcctgctttatatctaggtaaggcctgggacacacggagtttgatgctggaatgaatcagaccttgtgtgcacttctgtctaagtcccaggcttcacacctagtacatcatttaaaatcccaaacgtaccaaggtcttcaccaaaagtgaaggttgctaagagttaacagtgttacatgtatttaagactattgaagaaacagtttacatgcaaggtgtgtaaggaaagcaaaatatacttttggtaaaaagattataaggaggcacgggaatgtgaatttttgcctagattaaaaggttaaagggttgttttaagttggataaaataaaaatgaaggtttaagcaagttgtgaatggttgattgtaaaggaaattctatttgtaaacatattggctaaagttaaaggggtatcctccagtttttctgcaaattaagcattaaaataaaagcacaatgggtttctcttagagcactagcctgctctttaacaaaaattgtaaagagttataaaaggtctataaaaatcttaccttatgatcaaacattaaaattgggtaaatatgtctataaagttttattaagaattgggtttaacattaatagtacactaatgtaaaggtgaaattcggcttatttggtataaaaattatacaggaagcattgccaaatatgcaatggtgtttggctttctttgggctgtgtttgtataaatatgttattggtatgtgttccaaagttatgggagacttctataattctgatatattttagtgtacattatcagtaataattatcattgttatgttaaaattattgtgtgccacaaggtaacagatttccttgtcaattgtgtctttaactatggctaccctaaaacattttgtcatccataggcaattgttgtcttgttttggtcctgtttagaaggtggtttcataatcagctataaagttttaccaggtgctcttcaatacaggtttctgataactttgaagactgtgacatcagaatagaggaaaaatgttcaggactcttgaagagctaaaatgttcattaatatcaggcaggacaggaattaactacatgaactgaaccaataggagactggagtgatcattttgacattttgcttaaaatgttgctaatcctttgttttgcttttcagagtcaaggaaacgtcttgcgagctattgacagcttttaacaatttagtatactcccatgagcaaaatttggagcttatttgttcctctctacctgattttctccagaatttggaaagtatttgtgactattcttaagttatggcaatatagtgatttgcataagtgcaataagaatctgttttcttttgtaacaggacacaattggagaaactggttattttaccaagactttggttggaatgatgtgctttcctttaaggaatcaaacttgacttatgaagccaagaaaggccttggaaactggcctcctattctgtgtacacagtccctgcacaggggttctgatctggggtaagtaaagaatgtcactttctgacaggccaggaacctcaacaggagaggaattcacccaactcataggtatttaatggtacaattccatggctgggctcagctttaaaaagtcttatctcagattccttctataaaacaaagttccatcaaagacaatttaaaaggcctatgtgaaaaataattattcttgctgcactgtatacaaataattaagccaagtataataaagtaaaccagtcctaccatgtgtcttttaataaaaatggaaaactggagagagaaaattgtttcaaaaactatagcacacctgttgttaaaattccagtcttgtctgatgtttttcaattgttattattttctacagtttagattaaattctaatttttctggctacgagtctccaaaataatgttttcaatttttcctttttccccacttttctaactggaaatcactgaaacctaagctgtgctttcttaaagccccataagctgaagacgagatgtatcagcagacgctccctctacgcccccaaacagagagcgcttccaggaacaaacccacctcttccactcctagatgtatcagcagatgctccctctatggccccaaaacagagagcacttccgggaacaaatccacctcttccacccctagatgtatcagcagacgctccctctacgcccccaaaacagagagtgcttccgggaacaaatccacctcttccactcctagatgtatcagcagatgctgcctctaagcccccaaaagtccagtgctgcattcagtgccccgtaaggaccactctctctcagcaggaagtagccagaaagaacacatcacccctcgtccttttcaactacagggtctggattgacagagcaagaacatcgccatcttggacaaacaccaccattttaagttccccttgattaaaaacccccaaaatccagccgcaaaacatcaacctaatgtctaatatcagcgtgaccataaaccacaaatgacacctttgaccagaaacatgccgaccccaagataaactcccctctgacctgaaaccttccaaccctgccataaaactccctccacccaaaaacactctgaacctgcgacaagctccccttcctaaatccttaaatacctttagtctgtaagagagaacactccagacctaaatcggcccgaagcccctctagggtttattctccaacataaacctgtttttgactattgagctgcttttcatgtttcttctttcttcaactcttacagccagtggccaggagtgagcatttctgggtgtttctctacgggtcagtttctctatgggtcagtggaggccctgcccaggctagaaaaagatcaacaaaaacctaatgtcaggttagtgaggcagttgagtgaaatccggactcacccagaagatgccacagtaccacaggtgatcatcgtcatatcattacagcaggtgaaatcgagactcacccaggagaagacgccacagtaccacaggtgatcatcgtcatatcattacagcaggtgaaatcgagactcacccgggagaagacgccacagtaccacaggtgatcatcgtcatatcattacagcaggtgaaatcgagactcacccgggagaagacgccacagtaccacaggtgatcatcgtcatatcattacagcagatgaaatcgggactcacccgggagaagatgccacagtaccacaggtgatcatcgtcatatcattacagcaggtgaaatcgggactcacccgggagaagacgccatggcaccacaggtgatcatcatcacatcgttacagcagctgataccattgcttgtcgcagacccagctacaccacaggttcagactctcatcttgctgggagatgacatattgaagctaaagatcccctttccctccctcacatctccacccctgtccaaaatcacgtgattcctgttcggccggctttttatactgcagggttctgccagacaggaacacgcctgtcctgcaccgatcctgctggagggcagcttgttccgagccttcctctacaggaatgcatcccatccacgtctcctgacaagctcaggactagtcttgtgctgtccaccccctcaggccctccaccctggcacaggcagctgtgggctcctctctgtgaccctggccagccctgaccggtccacagtcgtccaggaaacccccagagaccacgcagcactgcccagcaccacctggattggttattgttagcaatggcttcaggtggtgaatgacagggtcagccaaggaggaggcactcagggggaggcagagctgcagcacccacccaggaaggctctgtctgaggccgcccaggctgcacagggcaaaggcagtggcaggaagcgccgccctcgctccccccatgacctagggagacggctcatccccctccttaggacaagggacctggtgcggggaccctggggattcccttcccaagaccatcctcctttgagcaaagcctggtggacccgggcgggagctgttctaggtgctgaagcacgtgcatcccacacaccgcagtccctgccttctgggctgagtctagagtcagcacagcgctgggggagctgcccccagagacacagccggggccaccgcgcctcccctcggccccacagcagtctggggtgcacagtcagcgggtagagctggcagcctccgccactgtccagccctgtactgggaacgggcaggcactccaccaggcttgacaggcactgttggccccgcccaggtcacatagctggcaagaggctgggtctgggttcaaatccaggtgtgctgggtgtaaagagaggcagagagatagagagggagacagagacagagagatagaggagagggagacagagctagagggagacagagatccccaaagtgcaccacatcttctaacagatgccgaggctccggtgacatgtaactccctgcggagtggccacagaaacagatctggctgtggctttccatgagaaattccagggccctgtccaaaaatatgcagatatttggacacagccagaaaatgagttggattttccaaacaagcagatgtggatgcagcttctgtggcagcaaaaatagaaattccaggtgttggtttcagacagggcactttacaagcagacagcccaagcacctgtgaccctaggcgaagctctacctcgtaaccaatgcatccataggcgttggctcctgggacctgtgggtgggcgtcagggatgctcagcatggggtgtagctctgctgcagaacgaggaggagcttttcctgctcaccagggcgtcagcaccaccagctcacgcatcaggatgggagacaaccaagggaaaaccaaggtaggaacaggtcgcctgcgcccactgtgtcgggaagctccaggtcagcgacccctctgagtgtcacactcggccccacgtgtccgggaggctgcaccccagcccctgctaaccaggcgtgcccagggaggcaaggctgctcagacagcagaaaaaaacaggcgtcctgaggcgagggcctgctaggcccccactgtggccgtgggacggagccagcagctctgaggtggggtcacgtgcacagctcacagctcggacagcagcaggtggggatccggctccagcctgtctgggctggacgtagctgtcgggaggacgacaggaagcaggtgccgcccgcagaagagaggtgcgtttaagaaaccagagccgccgagtcagcccctgagtggcaggtgcacgatcccacaggcctccaagctcaggggcctaaaacctgggacttggttgattttcctgtaactagacctagtttccgtggcagatgcccaggcagccagaaaagaaggcagggcgggcggcccccaagtcgctccactcacccacccttgtgccagtgcccacccttctcccaaaattaacccaagtctggagggttcaggtggcagcatctttgagcagagagtgggggacgggacagggtcctctttgaacttcaccccatcccctgcaggtgtggcctgaggcgtttgcatggaggaggtgtggactggtgtcctgggcaggtcccaccacggtccaggaggggcggcccggaagactcagcttcagctcacaggccgcacatggctgcacacagagacctgccgatgccacaggccacgtgcacctggaaaagtctgactcaagccacctgtggggccgcaggggtcccatggtccctgggcggggatgtggggccaccggcctgagaaacaccccccagtgcctgacaggcacggagagctggggcctcatcagggccacaggagcttcagggaaagaggcctcggtggtgaggctgtgggcccggcaggaccaaccccgagctgggtgcccagcgagtgtggccgcctgtgcccatgctccgcctgtgctccactccctcagttattcccccgctgtgggtgaggtcgtgggatccagggttggatggcaagtggatggggcccactcaacgcctgtcctccagaacacccggcccttgtgggacctactcggggccgtggggccttggcacgggctcttgccctgggcagctcacagtgtcctcaccggtgacccgcagagccgcccaacactgccatccagggatcccagaaaccactctccaccagccccacccaaaggggcggagaccctcacagcttccacaggagaaggtgcggggcccgacgccccaggaaggctgatggggctcccacgacagcgaggccctgagcagaagctaagcagggcgcaaggaaggcggccgagacctcaccctccagcacttagaggaatggagaaaacgggctcagtccagaccaaagacttctgtgtgtggtgtgtatagtatgtgtggtgtgtgtggtgttgtagtatgtgtggtgtgtggtttgtgtagtgtatgtggtgtgcattgtgtagtgtgtgtgtcatatatgtggtgtgtgtagtgtattgtgtggagtgtgtgttgtgtgctgtgtgtggtgtatgtggtgtgtgtggagtgtgtggtgtgtggtgtgttgtgtgtgcaatgtgtgtcatgtgtggtgtgtgttgtgtattgtgtggagtgtgtggtgtgtggtgtgtgtgatgtgcattgtgtggtgtgtgtcgtgtgttgtgtgcagtgtgtgtggtgtgagtagtgtattgtgtggagtgtgtgttgtatattgtgtcttgtgtgtggtgtgcgttgtgtggtgtatgtggtgtgcattgtgtgttgtgtgtgtcgtgtgtgttgtaggtggtgtgtgtagtgtattgtgtggagcgtgtattgtgtattgtgtgttgtgtgtggtgtgtggtgtgtgtagtgtgtgtggtgtcgtgtgtgtagtgtatgtggtgtgtattgtgtggtgtgtgtgtcatgtgtggtgtgtgtgtcatatgtgtggtgtgtgttgtgtatagtgtgtgtggtgtgtggtatatgtggtgtgtattgtgtggtgtgtgtcatttgtgtgttgtgtggtgtgtgtgtcatgtgtgttgtgtgtgtgtggtgtgtggcatgcatgtgttttgtactgtgtggagtgtgtcgtgtgtgtctgtgcatgtgcacatacgtggggcacaggagaattgccagttaacactgttttatgcccttccctttcccatccctgtgggacctatgggactgtgccaggttacagagctcttcctgaaataaatgattcatatgtctgtttgggtgaggaggaaacagtaactcattcagcagtggaaaaatacctaaagctgatgtgatttggggcattcttcagatgtcaccggagactaacatgataatgggtagggataatggcgaagccattcctaatgatcagatttcatcccttaagtgaacagagtgaaatctttataaatgaaatgatgccacgtctggcatttgcttctaaacaacataggaagagaagaagcaggcggggggtgaacaggacaagtgatggagttgggtggggggcaaggagggttcattgcgattttcttcacccttgtatgtgcttaaagttttctatggtaaaaatttaaaataaaaataaattgagaaaaaagtgttcacgtgtatctggaagcactggaaatacactcgttctctctgtagctgacgttgacagcctgccttgctgccttttgaaataacttgaatgttctgacatctatgcacttaaaaccagtgtataacaatgaccaccgctttctcgaaacctgtcatgaacaagacattctcatgtgcattggctcaaatgttcccagccaccatgcaaatgaagaaactgaggctgaaatgcttcagtaagtttcctacgatcacgcagcactcacggacagccaggttccagctaccacaagtattaaattaatgtgagattgtgaaatatgggttcaccatacaacatcagcccagaagaatgcctctcctgaaaaggcagaaatgagcttgcacaggcatcacagacaacccctcagaggttctggtctggggcatccgggtgccttcctcaccccagtgagggaagcccgtggacaggtgaacaccacacggctctggcagtggccgtcactcttgggtctttatcctgtcattccagtacccatgtgtttttaccgaagccatagaaatggtccccatgcatccagattgtaaaggaagaagcaaaagtgtttctatttgacatgctccagtagattaaaaaatcctgaggaatccattttttaaagaactactagaacaaagaaatgagttccacagggttgcagatattagatcaacatacaaagtcaacagtatttctaaacacttgcaatggacaacccagaagttaaattaagaaaacaattccactcaaaatagcctcaaaaagaataaagtacctaagaataaatttaatttggtaagtacttcatttgataaatactgaaaaataagtaaatttgatacaaaacttatactctaagaactacaaaacattgttttaaaaactaaagaaggtctaaataactgggaaaacattccatgttcatggattgggatacttaatattaagatggtaacactccctacactgagctacagattcagcacatccctaccagaatcccagctggcttccttgtagaaattgaccagttgattctaaaattcatatggaattgcaagggattcagaattgccaacgtaatcctgaaaaagaacaaggctggaagactcacaagcccttatttcaaactcactctaaagctacagtaatcaagactgtggtaccggcacaagcaaagacatatagattaaaagaatagaattaaaagtccacaaataaaccatatatgtatggccaattaattttcaacaagggtgccaagaccattcaatgagaaaagaacagtcttttcagcaaatggtgcttggacaactggatgtccgtaaatgcatgaacatgggtccctacctcacaccatgaagaaagttaactcaaggtggatcacagaaccagatggaagagttaaaactataataactcctacctcataccatacgcaaaagttaactcaaagtggatcacagacccagatggaagagttaaaactacaaaactcttctagaaaaatctaggggtaaatcttcatgtccttagatttgtaaaacattcttagatatgacaccaaaagcatgaacaacaaaagaaaaaataaattagagttcatcaaaattaaaaacttttgtgcctcaaaggacaccattaagaaagtgaaacggcaatgtacagaatgtgaggaaatatttgcaaatcacatatctgagaagcgatttgtatctagaatacataaatgactctgatgactcaacaggaaaaggcagcccaatgtaaaaatgagcaaaggaaatgaacagacatttctccaagaacatatgcaaacggccaataggcacatgaagagatgctcgacatcactaatcatcagggaaatgcaatcaaaaccacaatgagataccacttatcacacattagatggctagaatcaaacagtcagtgacaagtgctggtgagggagtggagaaacaggagccctcatgcctgtctgtgggaatgtaacatggggcagccactttggaaaacagtctggcagttcctcaaatgattaaacagcattactgtatgacccagcaattccactcctaggtacatgcccaaaagaaatgtaaatgcattttcacacagaaacctatgtacaaatgttcacagcagcattattcacaacagccaaagtctgtaaacagctgtaatgtccatcaactggtgtatggataagtgtggcccatccatacagtggattattattattattatcattgttattattattatttgagacagagtcttgctcagtcacccaggctggagtgcaatggctcaatctcggctcaccgcaacctctgcctcccaggttcaagtgattctcctgcctcagcctcctgagtagctgggattataggcatgtgccaccatgcccagctaattttgtatttttagtacagacaggatttcaccatgttggtcaggctggtcttgaactcctgaactcgtgatccgcccaccttggcctcccaaagtgctaggattacaggcatgagccaccgtgtccggcccatatagtggattattattcagccatagaaagcaaggaaatttggaggaagcttaaagacaccatgcgcagtgccagacaccagacacagagaccgcacataacacgttactgcctccacacacaagcccagagtaggaatctacagagaacacatatcacacattactccctccgcaggcaggcccagagtaggaatctacagagacaggaagttgattcctggttgcttaggctgggtaggtagggtgctaagagaagggtgtgggtttcttgctgatgtgattcatgttttaacactggctgtgctgatggttcacatatctgggaatacactaaaaaccattgaattgtgtgctttaaatgggtgagttatatggaatgtggactatatctcattaaagccatttttttaaaaggaaagaaaaacagacccacactgtccacccatcctgtgcatcgccaaagcccagcttcacacccagcttctgcctctttggggaaatcttatggaaaagtcttcaggaggccttccctcctcaggcccacccaactccctacaggcaccaagcagctccagactctgaagagatgctgtctagagaccatcatgggggcatgctggctcccaaaggtggcgtctgtttccaacaccattctgtgactggtgtgtgtgaggcctttgcccaccctggtcagctgtgacgcccaccctcgggagccaacaacagggggtgggtgggagaggaaatgccgggcctatctctccgtctctttgcaactgctagccaagaacggcagctcaccctgcagtgcacactgtctctactatgcagaacagaacgctttgctccaccagaatcccagtgtctttgcagccacccccaaccctccagggacctcccaccctcacacggtcaggctccatctgcccaagggtcagtctcctgggcagcagtgggagtttgctgggtcccatgcggggtgatatggtttggctgtgtcctcacccaaatctcatcttggatcctcatgtgttgtgggagggacctggtggaaggcagttgaatcatggggggcagatctttcctgtgctgttctcatgatagtgagtaagtctcacaagatctgatggttattacaagggggagtttccctgcacaggctctgtctttgcctgctgccatccacgtaagacaggacttgctcctccttaccttccgccgtgatcgtgaggcttccccagccacgtggaactgtgagttcaattaaacctctttcttttgtaaactgcccagtcttgggtacgtctttatcagcagtgtgaaaacagactaacatacagggttccgagggcatacaccgcggcccagccatctcaccctccctctcggcctgggaactgggaacaggcaggggttgggggcccgacacaggtcatttgcacgctggatgatacagtaacatgacagccggtgcagggaagagctgagaactccagcctgctctgaagcaacaactgggagatgaggcagaaatggcccaaccacctcccctctaaaccctgctcttaaaattcaatcctggctgccaccgtgaactgacaaaattagccagtttttgtttttaaagttatagtccccaaaacagtgcatcaacaaaacagacttccagctgaacctgatcgctgttgccgcgcatacagccacgaacatcatggacaggcagtgtctggatttcactctgcattgctgccatgtgaaccgggggctccctcctggttttatgtctttacctctcctcttagtctgggcaagataaacattaaccaaactcagacgaaaaacaagactctagagccactggttcaaaaggaagagaggcttatgcacatgtttttgcctgaactttacacactaggacttaatttaatttgccacccccgtcccaaacttcatgcattctctgagcttcccaggcctcagcattggtggttgcacaccacgtgaggttgatacaccagcaacccagggccatgctcgcttagactaaggtgtgaatggtactcgctgaaccctgtatccaggactgtgcaggccacagcccgggaacctcagagctggtcctgtagacaccagtgtgctggggaggcagggctgactcttctcagagccccagtgcagctgtaccatcccctgatgagggactcatgctccccaccaccccatgtactttcttaccatttgccttctattctccaccaagttgatgccaataattcctaagaaagatccaaagccgagctaaaaccaaaggaagaacgagagagaaacactcattaacgtgcctagaagcttaacactgacatttaaagcaaataatcccgccctcaaaggcattttatccagggacgaaggccagacatccctacctcaagaacctcaaccactgagcagcaggtgcgtctgctggcgttgggcaggcatctctgcaacatcacctgtcctgtcttctctgctcagaggtttttaatgatgcatctgtttggcttgtgactctggggtaagagaagttcccactcctcccccagagacaacatcttttcgggaacccagggccaccaagcaccaccatctgtcccgtcttctccaggcctgagatgcccctgagcatggctcctgggtaaggtattagggaactacagccgtgtttcaaaagaagggttgccaggcacaagggccaccagtgacccctgctcagacggcctaactctggttgctgcttcgggagagtgagcagggcagaccgttagcagggaggtgccaggtgtggggaaagggcacctgagccaggcacagagggggcacctgggccaggcacagagggggccccgggctgcagcacaggccaccaggggtccggcagagcccccttactccacaggaagccccagctctgggcagaaaatgatactgggatgtcgggaaatagacatgggactgtgctgtcttagaacagaggccaccggccgggcatccgcaccctccacccagggcccgtcctggcaggtgacgcccacctggcagaggaatttttaaaatcagtgtgaagaacatgcatttcagcaacacccaccgaaaatctggctcagagcagccaacatggacctgccaacgaccgtgccgaggcctaagacggctcttgctcccacgcaggtgcgccgggccggtcgcacttcccagtgagtgtctgttggaaggggtggcccgcccggcacagccttggagttgctggggccgtggtgtcaagtttaatgcactggaaaccggacttctttatgtaaatagttttgccttttctgtaattgtctgtgtgtctgtggtgatagacacgtacacatgtggctttcaccaacggtttgagaattctccagggataacaggaatatttcttcatgtgctgagcttcaaaatactgcagttcaactccacacgtcaaaaatatcaaaatttcacttcgatatacatgtattaaaatacatctgttacactacgttttattttttggggatttgaaaaaaaccacacctttcttgaaaatgtggagatgttttcacgttctggccgcttcttctgagatcagcttcttaagtctctacattggcagaaagtctccacagaagtgactcttagccacgtttccttgaagctgcttttatttgttgtctccctagtttgctttcagaactgtctgtactacaggccatttcaatctggtcagcacagcattaattcattgcccagaaggtagattctttacagagcatagcttgggcattagccattgatgtttttcattatgttattctgaggcagctcttaaataagcttgaggacaaaccaaaaaaaacaaccactcaaggctgatcttgatgtttcgcaaatcacttggaggtccctcctcacagccacttgccctctgggctcccctttctgcccaggaagcagaaaagcccctcacatgaggccaaggtccccacaccattggcctcttgcaattttactgataaagctttttctgcatagatactatttgtatatgtttattcataaactatacacaggtagatagtgtagatgtctaaggcacaccctaagatataaacaaaggaaaatataatggtgaaataaacagtatttgtaaaatatttctaaatacttagggccaaaaatctttcatctttgctgattgtcatcaatattattaccaatcttggtagtactttaggtgagagtaatgagattgaagaagccgcattttaaaatcttgctttagcactttatgacgtagcaaccaggctctggggcatgtgaagggcatcgcagctgatccaagccattccaacagaggttcactgtgcagaatgcaggcacttaggagaattcttttactaacgacagaggatgtaatttcatagttcaaaaaaccttgatacttttgaatctgggtgaccaattcttgccaattaggttaccatcaatttacctcgccgccttactgttcaaaatctggcctgacgggtggatgaggtcagcaccaccaccttctggccgttcccacgcgatcacgtcactaatacgatctttgacccacggcttcttggtaggaatcgtttaaagttactttccccttccatgggctatggtggtcgacctggtccctcagggtaaaatccttccaggatgcttggggaggctctgtccggcctttttggacatcctgggctcctggcccctcctccaccttggacatttcctgttgccgggctctggcccccctcctgccctctggtcaccctgtgaccacatcgggccaacccagacaatggagggcacctggccctattttgagatcaacttggacctcaaccccaattcccctctgccttggacctgccactgtcccaggtcctggggattgggaagtgcatgtctgtgggggccataaccctgccgaccacaagcactgatcgaagcctccccaccttcagccccagccctgtgagctggcgtggactccaccctgagagagccacacaccaccctgccctccccggcccaggccgcccgcccggcgcactcacaatgatccctgggtagtagcccccaacggtcacattctccgtcctggtggtggcagccagcccgacggtgactatgaggacggacaccagcagcagagaccccacaaaccagagcgacgtcttcttcctcctcgaaagcccttctgtggggaggaaggcgaggacctgtcagtgagggctcaggctcaggagggcgtcaggccagcaggctctgggccgtgctccgttacccaggggtcctgggatgcactatccccgcctgcctccaggcccacctcaggggaccacccccaacctccattagataacagaataaaatctctggaccataagccactatactggatagcctggtatttgcggccaaacctaattctaactgtcacagaactcaagaaagcaaactagaaaggactccttcctattggctgcctcttcctctatctgactttctccccctggtgtccccaggaggacaggagcatcttttgtttactgttttatcattaccattcgctcacagacacaccctctctatccgcctatcccagccacacccagtgggggagggggctgccaccaggggaggggcagggagagaggaacgcacacagcagccatccagctgtgccatctgttttgctttattttttgaaaactgaatcatcttgatccctgtgtgactccaaacaaaataggggatttaaaaaaccatggtaaggtcttcctactccaagagtttgaaaatcaacatttgtgtgtgtgcacatgtgtaagtgcgtgtgtgcagggaaagcagaccgcacactggagagccgctggcagcgatgacggccgtgcagacattgtccacaccctagaaggtccgcatctgaagatttacacttctgcaatcccatcagcagagctcaatggcaaggcaaggttatcgcacccaaggaagggattgttacatcctcagaaatgagtttcacaaaactataaatcaatgtgcagatgcagaattgctctgctgatctgagagagtcatttttatccagctgacccagcaagggcgtggccttggtcacggccttccttcaaggccctcttggactcagcacagcccccggcacagcaccctgcctgcctcttgacccttgcaaagatacacttgtcccaagaatctcatcctaaatcgctttttaccttccaccttggaggggaccagatcactccattcgccaatgtaataaaccatcggctcccaccagccagccaggctgcccccgtcttggacccactgcaccgaggcggccagtggcactgtccttagtgttatactccaggccgcaggcagtggtttcagcctctccctggttgccccatctcctgcctccttagaggcaggcttgttgcagcatccacagggcctttgtacctgctgtctccagctagacactcgcagcactccctgaaggcctctcttacatgttgctgcatagacacactgagtatagtagccacactcacccctgtgctctccacagttgccccttcacccctgcccctgcagagcatcctcgcatgtgagaggcagaggggacaccagacagacagaggcacacgctgcaggcattggaaaaggccaagttcagtggagaaaacttaagcagggctggggacagggcgctccggatgtgtcacccacaggcagcgggcagagggcagagccttccctgaggggcctggtgatggcacagtgcacccctcagcccagcaccactggtgtggagtgaggccctccttctgaaagccaccctcctgagacaccagaggccgcagcccggtgcgggccagggagcaatccccacacccagcctcaggaacacgccctggggttcggggtccctgcagccagggccacacctgcgccctccgggtccccaaggcagcttctgcaggggtcacactgaataaacctagaggggtgacaagcaggtgggtgcaggggcgggcacagcaccaggagccccaaggccacactggcggcccaggacctggcacctacacatccatcacccagtgtctgttaaagtcatgctcccccagccccaacccgtgtccccgtgtcccacgcccacgccccggcccatcccaccccaggccacacctgccttcctgtgtgcatggagcacgtcctttcttgtctttggatggggaggacactcccctcaagtgaccgaggcccaggcacccgacacctgccctgcatgaggggatgggcgctgcacctgccagccggaacacacggcccaaggcctcctccagctccgcctctcagtccctcgcttctcagcctcaggcttccttcctcctccccacctctaactcgcacagttcttccctgtgtctctcatggtatttctgaactaaaagccaaccctcgttggactggaaaaggttgggaagatgataacgacattcttacaaggaaaagggagacagtgggtatatgttggaaagtgtgatttttacgctgctcagaagagcagagtgattttttgtagaacactcataaagtactgaaaaatgcaaaagggaaaataaaattcatggtaacctaaattaacaagtaggcataaaatcttatggtcttttttcaatgcactatgtactttttaaaacatttttttcttaaattaggaccacaatgctttatagtaattttttcactgaaatcttgcaatttgttaaaaacctgaaaggttatatgttcacggtcgtttgcccgagagacaggagcgatggcgacagatcccgggtctctgtcgggaagtcgaggtgagaaacggcaaacccacgctgggagcaagtgggcaagaggaaggcaggcacctcccgtgggtgaaactccgttctggttgattcgttttagaaaggtaggtaaactttttaaaaatggacacaaaatttaaaaatatatgcaattccacattttggaagttaatgaaacagctattgtggaattacacaaaataatcatattgatgataataacaccatctatggattgggctgtgtgtcgattttcagagcagcctaacttccttatctcatttgatcatgaccagaggctccaggtcaccctcaccagcctccatgtaacacctgccaatgcagccaaatgctaggtgccttcaactcacacaattcccgcttcagcctttcctgcttttccttaggctcccattccaatcttttgactgtttaaatgtattttaagagcaatacaatttctaaaactaaattttatgggactaagtatttgagaaaattatcagacaaacgctgtccttctcaaaggattttgttgtgcgatttttcttaattaaatgcactgcatgcatataatattatgctcaaaatagttaaccagatgactcagcgtctgcttcgacccacaggtagaaccttccgtggggctcctgtcccagcctcctgtgggcgtccgtctgtcaggaaccctgtgactggattctggttcttaaagctggaagctctgctcggttccttggcatgaagagtgggggcccagcaagacccactgggctaactgaccttgtcaagtcaatcggtaacatgctgacttgttaattactatgcgaagagttagacacatctcctctgaaaccacgtaaatcctcctacaaaccattttcaacctaactttgctatgtttacccctctttcctgagtctaacttcccccccatctgctacaaaataaaaagcagaaggtatgagccacccttttatcagcattcctatcacagattcctagattatacaagtctagaaagacagtagaacttacatggggcactgggagcaatggttgcaaatcatctcattcaattacacaatggtgatattttgactccagatataatagagataacaaaaagaagactcccaaccttaaacacattctataaatacatgacacagcataaaaatgagaaaaaaaataaactcaagaaaagaaggtgggatatctttataattagcataagagataattataaggtcagattttcaagagaaaggggctttcacttaggagaaagataattaaaatcacctgaataatttccttgatttttttttttttttcctgtcccggaaatactgttattacacgcactgtgaaaattaaagtgctcctaagtgccccaactattaattaaaatatctaccaataggtttctattgcagaggcagcttacagggactggacccaaaccattctgggtctgtccagacccattgtgtggtcttgggcggccatttaatctccctgagcctgggagaagagaaccctatgagagccaagagctctgtctcttgtttgtcgccggttcccggggctcagatgaggacatagacacatctcctggtacggaatgaatgaaggcacttcagtctcctgacctgtaggatggaaatcatgagaaccacctgctcacccacctcttgagattgtgataagcgtccagtgagacacgatacgtgggctctcatataggtttttgtaaatggaatgcatatgctaatcatcagggtggtgtgaactttaagatggcgtagcggctattcttaaccagcatttctcccactggagttgcaaggaggagttctgagatgtgaagctgaaggggccaacagctacctctctgctatcaagtgcgctgatttttctaattctagtcttccccaggtgcagcccatctaggatatctcagaatatcaccttgtcactccccaccagcccccacttctcccatcccacctgctctccccttcctggctccttccccagccttagctggaggagctgaaccacaggagcctgtgcccacgccaggtcctacctggaagacacgcgaggctggaggtcaggctcttcctgcccctcagacccatttcctctactccacagagccaggaaggggaatgtcacaaagcatgggaggtggcactgcttggaagggttctaagatccggccttcctgccagccggacctggaacgcccaaaaagaagagtgagttccatttaatcatgtggggacaccagtcatggtgtccaagtaacaatcccaggtaaaactgtaatcactcagccgtcaattcctctttcgtcctgattttacacatgcccagggtagtgaacaaagaagggcaaagcagaaaaacccataatcctacccccaggtaccccaaagcagaaagactatggtccacccccagataccccaaagcagaaaaacccacaatctacctccagacacaccaaagcagaaagaccataacccacccccagacacaccaaagcagaaagaccataatccacccccagacacaccaaagcagaaagaccataatccacccccagataccccaaagcagaaagaccataacccacccccgataccccaaagcagaaagaccataatccacccccagacacaccaaagcagaaagaccataatccacccccagataccccaaagcagaaagaccataacccacccccagataccccaaagcagaaagaccataacccacccccagataccccaaagcagaaagaccataatccacccccagacacaccaaagcagaaagaccataatccacccccagataccccaaagcagaaagaccataatccacccccagataccccaaagcagaaagaccataacccacccccagataccccaaagcagaaagaccataatccaccccgacacaccaaagcagaaagaccataatccaaccccagacacaccaatgctttatacattttagtaaaagaccagctccaaacaaaaagacccataatcctacccagatacaccaatgtttcatatactaaaaagaccagctccaagtattgttttaaggtttaaagttctttgtcagaagaaaatctaagtcagatgctatttttaaacattaaggcattctaataatgataaaactagttaataaataataataatagttatcattattaaacaccaatagactaatccacattaatacatttgaccatagagcattttgctttagattggaaggcatatagtggtttcttttagaaagaagccaaattatttgattattttaagtaacagtaattcgtccggttccgaacgatgccgcagtaaaagggttgtgaggttaatccccagaagtttgtgttggattatttctgagggagcggcagagccccctagacaccactccatccctccctccagccgtcagggcttcactttctagggaactctgtttctcttttgttctgaaatctgcccagccctctccccctcaggaagacacccggcatccttccagtcctggccacttcccggcagagcccccgagcccggcttgcgaactggtgaacacgcaacaggtttcctgttttcccagcctttgcctggctccgaggctgcagcgggcttggtctgggaagtggaagaattggagattccgtgaacacaccggggagaaacacgagagaggggcgagccgaaaccaagcaacactgtccagttctgtgagcgcctctgcacgttcaaacaggaaaaggctacctcgctcttccaaacgaagttttcccggaaaatggtgtaggttggaataaacggaagagatggggaaggagcgcactttggggcgcctgttcctcataataaaacgtaacagggagagagagaccaagaggaacggacacagagtcagaggaaggcaaagactgaggaggcagagacagaaagagcgagagagacagagacagagacagagagagagacagggagagagaatgaatgaacgaaccggtaggacgaacgcccgaccccagtgcgaaatgcaaagtgttccaaagacagagctcgaaggaggcggagggaccagaccccgtgccgcgtctccgcgcaggttccgcccgggccggccggggacctgtagtcccagccccggggtccccacgctcccccgcaggagccgagacgagcccccagccccgcgctcacctgcggggtccagcaggcccaggggcccgggcaccggcggctgcatcccgaggccccacccggctctcccggggccacagccacagtcccgccgccaggagccgccctcgcggcgccgccccttccccgccccctgcacctccccgcgctccgcccgcctcgcgtccttcctcgctctactctcccttctccggcgtttcttctcctccctcccccgctgcgcccgctcccccttctcccctccagcggccgcctggtttctggaaatcaggacgccgcggccgggagtggaagccagaccccagatggaaggtgcctggagaggaccctgcggactcggggtcggagccccggcctgggacggtgaccccgggccttccgccgctggcgccacgctcagcccttggcggtgccgctgagtgggtcaccacgggttcgcctccccattggccggtgacggagctccttggggctacagggccagccagcccttgatctctgggttcagagggtggtacatggtgttacaacccagtctgcgaggaacgagtaaatgaggaacaaacgcaaatgagtaaatgaggaacaaacgcatctggcacctcactcagcagccccgaggcagggctgacccgcctctccaaggcctgcgtctttgtgtccacagcactgaagttgttctgagtaaaatctgctgctggaaagaagggcaaggaaacacggggccagaaagggtgcctcgtacagcagcaggaaaaaataaagatccttctaaacgtatttttaacatctttgagtcaaggacatcagcggtcccgtcacaaaagaagatgcttgaacgatcaataaactcagcccccggaattaggggaacgctgtgggaacaagaggatgcgtttcaccctcatcctatcagaaaaccccaagggtcaaacaacttaaagaatgttaatgaaaacgtgggaatctgcattcaccgctgggatcacgcatggtgccaccactctgaaagcaacctttaggaaaattgaagcaagtagatgacaagccagaaagaaagcatatctctttctagatatgcccaagaacacaaacatagatctgctccttcgagccaggagccgtggttctcaaccccggctgtcgttaaagtcatccaggaatgtctttaaaagaaaaaacatttctgcagcactgaacccagaccagatcaattgaaccagaacttctgggaacaaactaatagctaagaattccctagtcattctaataggccatccactgtgagagagaaactaccacaagaagtatgcatgtgctagaagatgcgtacagaatattcctcacaacactgtgtgtccaaagcaccggacacaccctgaatatccaacacggggagaagcgataaagaaatgggcatatacagcgaaataccacatggcagttaaaataaatgagagctacatggatcaatgtggataaatgccaaaaacagaacgcggagcaaaaatgcaagtgcacagtacggcagcgagtacgacagcaagtacggcagcgagtatggtaccatttatataaagttttaaaccatgaaaattaacactgttcactcagtgagcctctcaagacttactaaacatccgcgatataccagacactgttccaggtacttgggatgtatcaatgagcaacgtaaacaaggatcctggtggggaagtgaggccatgaataataatacaataaacaagaaaaatgcacagcatgtcagagggcaacatgctatggaatacacacacacatatacacatacacacatgcagacatacacacatgcatgcacatacacacatacacacacatgcatatatatacacatgcatacatacacgcatgcatgcatgtgtgcatacatacatgcacacatacatacatgcacatacacacatgcatacatgtgtgcatacatacacgcacacatacatacacatacatacgcacatgcatacatacacacttatacgtgcatacatgcacatatgcacatatacatacacacatgcatgcatacacacatgcacacacatacacatgcacacttatacatgcacacacatgcacatacatacacacacatacacacttatacatacacacacatacacacatacatacatacacagccaggtaatgcaggccacagaaaaaggaaagagaggtaaagaaacaaaatagaaagtatagtgtgggagagggagggagctgtggtttttaagtagtgaaaagagagcttgttgacaggtgatgttgaagaccaagcttgagggcgtggaggtggttgctcacccagacatctggggcagagggtctgaggaaaaggaacctccatgcaaaggccctggggtggagccatccaggcccagggggagcagcaaggagaccagggtgccagaggcttgtggggaccaggtggaggacatcaggggtgagccgcagggcctctggcctttgctccgagtgatgtgggggttattggagggtcctacacataggattactggagagtagttgtaggatagcagaatggaagctgagaaactggttataggatatgatgaaacagtaggaggtgattacacggacaccatgagtcatgtttgcagatacacggacaccgtgagtcctgtgtgcagatacacggacaccgtgagtcctgtgtgcagatacacggacaccgtgagtcatgtgtgcagatacacggacacgttgagtcatgtgtgcagatacacggacgtgagtctcgtgtgcagatacatggacaccgtctcgtgtgtgcagatacatggacaccgtgactcatgtgtgcagatacacggacgtgagtctcgtgtgcagatacatggacaccatgagtcatgtgtgtgcagatacatggacaccatgagtcatgtgtgtgcagatacatggacaccgtgagtcatgtgtgtagatgcatggatactgtgtaagtaaagtagaagaacatgctgggggagagtgcatgcttcatccagaactgtgattctctgtctgggtggacaagctgaacagctttggaactatgtctaggggcttaaactctatttgtgaaatcttctttctttaaaaaagttaaaagacttgtaaaaaaagggggaatgttgagataccattaaggctagatggtgtggacagggatgttatattattctctatacttttctggatgtttaaaatagatgattacttttttgtaactttttatttttatctattttcaaacctaaaggtggtttgcagggatagtgcaaggagctcctgtgcatcctctacccaggtgtgcctttgtttgcagtctgtcacttttttgttttttgagacatgctgtggctctgtggcccaggctggagtgcagtggcatgatcatagcttactgcagtctccacctcccaggctcaagcgatcctctcacctcagcctcccaagtagctaggaccacaggcgtgtgctgcaacacccagctaaggtttatactttttgtagagatggggtttcctcatgttgcccaggctgatgtcaaacccctgggctcaagtgatcctcccatctgggcctcccaaagtgctgggattacagacgagagctactgtgcccggccacagtctgttacattttaaaaattaaatggacgaaaggaaaagaaaaggaggaaaaagggcgcctgcttggctctgcaggccgagtcccaccctaagccgccagggtgcccaacctcttccaccactgagagcagcccagggatttccatgtttgtctcattccaccaggctcagggaatgcctttttaaagaggagaaaaagcgcctgcctggcatggggaatgtgcaggggccaactggagcacagccaactcagaacttcttcaggggctccctgagcaggccccacctgcctcctctccccaggcctgcacctcggaagtggctggaacccacagccagcacctgtccttccttcccgccagcaccaccttccttctctactcactcagagataccggggttccccatgactggttcatcctcccctcacccctaactttccgtggtcctcagatctctaacccattcctgcaacatccagtgaggtagggaagcaacagcgctggctccgagagccagggtcagggccaggggctgactcccacactgtcctgtcctgagcattgtccaggcccagagcagggctgggtttggcgctgggctgtggaagcacaggagtgatcactgacctggggccctgatggagctcagaggctgatggagaagagacagaaagactgagccctcccaggtgatgccaccgtcttaagctcagcgctgagaggcagcgggaggtgtcgcagggagggctcccgcaaggagagacacacagagctaagagctggagggcagggagccaggccgctcgggcccttcctggaggatcggatgaatctgttatctctgagcaagctccgggaaacaggagacaggtcgggggctggcttgatgggggcagtggatggggttacccaagatacgctgcgacctgtgagcgtccgggaagggattcaggcttgggaggagtccaggagacagaagtcataggattgccaatctttacagtgggacaggtccttggaggtcattccggttactacaactgtgggacaaatgaccccataactcagtggcttaaaaaaccacatttatttagttggagttgaaatttgggcaaggccaggagtggacaccctgcctctgctccactcagggtgagctagggtggctcccaggactggcgcgtggctgactgtggctgtgcctgtaacctctccaggtgacgtgggcttcctcatgacatgggggctggactcccaggaacgttgggcaagagagagagccgggtggagtctgtggcaccttctgcaacccagcctcagcttcacgctgtgtcacctctgctgccttctcttcagcagcccggtgacaaaattcaaaggaagaaggaagagcctctccttgtgtgtgggaaatagaaaggtgatgtggtcatttggggaaaatagaatttgccacagggatcactgtgtcaggacaggaccctcactacagggaggctggaaggtgaacaagcgataataaagataacgaaccttttcctcttacttcagcagatatttcgcagctatttgggcagcttggaatgggaactggtggtcttcctagaccacaggtaatgaggggtggcgtggaggaggcagccgtgccaggcaggaagatcatcctgggatctgcgatgtgtgcatcggaagcacccagagagaatagaagctgccagaaaaatgcaaggaaacccagaaactcggagagcacaaacgaatcacagtttttattgtgtgaattttcactaaatatcctacaatgaatattcgtcataagaaaaagtcatttttaatgtcatgatttcctggaaatatagaaagaaagaaaaacagaaaaggcacaactgcccccgagcacagcagcagaatcttggtggtgggcgctcccctgccacgcccggggatgctcctgcttcaggagttcacttggctcagttatggcagcaggttctgatgctgcagagctcagagcagaaaggctaaggacgcctgcttagggcccctactgtgtgtgtgcatgtctgtgtgcacgcatgtgtatgtgtaggtctgtgtgcagggctgtgtgcatgactgcacgtatgtggatgggtgcacatgactgtgtacctgtgtgtgtatatgtgtgggtgggtgcgcctgattgtgtgtgtgtgtgcgtgtgtgtctcacgccagattggttctgctcaggtgctctgcatcatttctgcaatctgatttctccaagtctcaaaggtcgaatgtgcaccatcaacagcactgagagcctcttagaaaggcaaagtctccccagaccggatgcactcccagcttccgtgcctggaattagcgtatttcctgcaacaccaggccgggcagagctaggcaaagtcacccaggatctggagttgccagaatgcagcttcggccactgacagcatcatcatggccacataaaaaatcccccaaataaatttccttggaagaagtaaataagttctttgtacttaagtttggaggtgaccagtcctaactggtaactgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggacctcttgaaactcctctttgtcctagcacagctggctggaggtagctgagcgggagggtgggagaagcccacaagacctgcccatgccggctactacccccaacccaggcttcctctcacggacaggtgggacttgaaaccccacttggcttgtccaggaaaatccaccaatccccagggtctctgggctccccgagaggcattgcgggatgtttctagcagtcttttttcgggaccactttatgtctcgtgaggatctttaccttgatgtgacagaggacaggggcccaggaacatcaactcgggtgagcggtgctctggtgctcccggcaggaacccaagcctggctgttggccaccggcttgcaccgagcacacactgctccctggcacacttggctaaaggtgttgactgacttggccaacgtgaaacattccattctagttaaacactgagttctccgttcccaggagcttgcaaaccagcacagccttgtgaggaagtcatgtggcagaggattctccaagccctaggtgctcaggagagccttggagtgagcggattccagatcccacagggcctccagccgcatcggagccgggaatgtttgcggagaccctggcttcccgcagctactccctcttcccacaacacccccttggcccgggattcaaatacaacagggatgattccaaagctttaaatgatgcttgtgatggaagagaccagacctcctcccagagctcggcagagtcacatgggccactccaggcaggtcactcagctcagcccacaggcccaaggggcagctggggaatggggctcttccagggaaatgagaccaatggccgaccacgaggggctgcccccaacagagaagccacgagtggggcccagaggtggagcgcagagcctttgcagaatcaacaggcgtccagggtgcatgtgggctcaaggcagggcctcagtgggtctggaacccagcggattctcactgtgctcttgccggcctctctgggctgccctccgtgagcgctggtctcctgtgctccgcatggcccaggcccagacacaccccactggtgcccccgtgaagtcggccaccccacgtctcccgcatcccggaggcctccctgtgaagtggacgcggcgtctcacacatccgggcacctgtgggtgcacgtggcactgggcatgtcatggagcccaccaagtctgcgaggggtgaggagctgagtccctgcagaaaccaaggccacgtcggactctaccagtggtcagcaaggcccggcccttctcctcgggtcacagggctggaaatgcctcctgctcttctccggcagaatctcagttgtctgggggcagccacaaagctccagggaggatgcgctcctgggccgtggtctcgaaccctgagggtgctggtgcctgggggaggctgtgcagggtggacatctttgccagacaggacaagcggccacacagaagcccggcctccctgctgcggcacctcccatcgtgcagttttgggcaaatccagcaggtgttgagggaaatgtcagccacaatggggctcaatccctccctccatccgaccccggcctctaagtccgcactgtggtggcatcgggcggcattattggagatccactccccgccccaacttaaattcccgctaagcagccttggcgtaacttattcttttgagaactttgcacgtcttgagggaaccccgtggggagggaggtagggtgcagcctcctaactactcacgccccccaaatagcacatatttggatttttaaactcagagaagaacacatatttttacatcattacctcttaaaattgtccccagggcttgagcaagcaaaccccgagtcctaccgggctgtctcacttccacggccccgtggacacctttgcgaaggggaggcggagctgccgaggccgcgggaggggaggggagcgccagctcgcagctccgtgtcagcccctcagccctgtgctctgggccagtattcaaggtgtgaggaggtgactgcagcaccatccccaggcccacaccaccgtccgttcggcacacctggaaacatctcagagtggcgagtgtggaccgacacaggggcagcctacacgtttcgcggtttagaagccaaccgtgtcaaacaccagctacgcaggttccttgctggtgggtgaggcccagagctcctggcagggacccaggccctcaccagggccttcttgcaaacggggcgcctggctatgatcctcccttcaggcatcggctggcttcggaggcccatgagggtcccaggcctgccctcctctcacccctcccgcccttggctgtgcccggctggagcccccacagctccgccccagcagcgcaaggccttcccagcagccctgggtgggttacgggtgtggacctggagtgctccccacttccacccttagcgttccgagcacagggcagcgggaggcaggaggcccggcccggtccctgctgccggtggaaggaaaatgaatcttgggccctgaatcactgagctaaggggaggagtaaggctgggaatgtgtcagacaaacctgcctcccatcctcttcctaaacaagagctgcagagataaacggccacaggcctccctcatcattcacccacgaggaaattccttgtgagccttaagatctctgccctaagcagttttgtggagtttcacgctgggaatgcacgtggacagctgaccgtcaacaggcgcaggacagggacagagatcacggtcctccctctgctcacctgagacaagtgtgtccgacagctccctctgggctgctcatgaaaaaccgcagtcacggagccggacgaggatacaagtgactctccctctagtcccctcacgtgtaaattgtgtgttcagtgaaaggctgatcgagacccaaagaatgcagccctgtgtctcctctacctacgacctggaagcccctcctgcttcaggctgtccctttccggacagaaccgacgtaccccctcacaggtgctgattgatgccccacgcccccctgcaatgtatgacgtcaggccgtgccccgccttggacacacgtcgttggacctcctggggctgtctcggcgcatccctaaccttgggaacttcctagaactttctaactgggctgggctctgacgcaggtactttgggttcagtgcctggtgggacagccgcgccgtccacccgctccccgcggccccacagcccctacccagctccttgtgaggcttcctagggcggctgggagggtccccctcgggctgcaggcctcccagactcctgcttcgctgaagttcagaggcctcactggccgccttgaggtgcccaagggccactcctgagggcagggccctgaggccgggccggtgcctcctgtgtgtggtccccgtgtccttctccatcctccagcccagcctcggcttgagcacaaggctgccaccctcacacccagccgtcccgcagggagtagtcaggaggtgctgggagtgcgttgccatgggtctgctgtgacatcactgtaaggtcagaggccaaagatcagccgatccctggcagcacagcgtggctttcctgcaggccggggctggggcgggttctgcgtcttcccttcttctttcccgcaggccggggctggggcgggttctgcgtcttcccttcttctttcccgcaggccggggttggggcgggttctgcgtcttcccttcttctttcccgcaggccggggctggggcgggttctgcgtcttcccttcttctttcccgcaggccggggttggggcgggttctgcgtcttcccttcttctttcccgcaggccggggctggggcgggttctgcgtcttcccttcttctttcccgcaggccggggctggggcgggttctgcgttttcacatctctggtctctccaccagggagggcggggaactggcaccagccctagcagggcctgcagatgagacgccggtctccctctgtgacagggtatttgaatctttctctccctatcagggcaaatgggacacagatcaactcaggaagacaaaggcagcccctgcaggcagtggtggggtgcaaatgctgccggcccagcgcctctccccacccacacggcgccaggacgaaaccctgatgtggccggggctccggcgagggctttccgggccgacggtgtgaactgcacaggtcagcgtgggtttgctggcactcccaggcaggcggcttaaacagcgggagctcattccctccggtgctgggggcaaggtgtctcgcagcgctggttacccgaggcctctctccttggcgcgaagatgacgtattccgtgtcctcacgtggtggtcctgtgtgctgcgtcctcgtctccccttctcatgaggacgctggtcacactgggtcagggcctcgctttaccttgacaatctctacagctccacgcccaagtgcagccacaccctgaggtcctgagggtcacagggtcacagctccagcatgaggatttgccgggacagagttcagcctgtactgagccgaacagaaaatccccggcacgctgtctcctccagcctccagaccacggtgggtggggaggcaacattttacctcttggggttttttggtcgggcctgataattaaaatcagcagatgagctggagaaaggcacacgcactccagcacggtctgtgtggccgggaatggcctttccttcctgaaagaggaggtaacaccccacggggaagacgctctccagagccagaagaaagcagcgttcttatccttgtggatggctgtttcagctcaaaacaacccttacaacagtgtggcttatttgggcagccccttctgccccttgacaggcacctcgcgagccggcgcacccccccgcccccaggacccgcttcccgcacccggggctcctcagccagggggaagcaggtgtgacccccaggctgcaggctcccctccttctgatctcttcttttgaagagcccacagcctctcagcacccaggaggcctcagctctctgggcaagtggtgggtgcagggtgggggccttggcctcacacacgctctggcactgcctggcctcctgggacggttcctcagaggcacctgctttggacactctgatgtcgggagccccgcggatgctgccaggatgggagaggaggccgctgtctctctccaacaagtgctgggtcgtctggagcaacaagggcaaatgggcgtcactggggtctccacaaagccacctgcagtctcttggtgggtgtattagacagtttccatgctgctgataaagacatacctgagactgggtaatttataaagaagaggttgaatggattcagttccacatggctggggaggccctgcgatcatggtggaaggtgaaaggcacgtcttacatggcagcagcaggagagaatgagaccaagcaaaaggagaaaccctcataaaactttcacatcggatctcgtgggacttataccacgagaacagtatgggggaaccgccccatgattcaatcacctcccaccaagtcccacccaccacacagattcaatcacctcccaccgggtcccgcccaccacacagattcaatcacctcccactgggtcccgcccaccacacagattcaatcacctcccaccgggtcccgcccaccacacagattcaatcacctcccaccgggtcccgcccaccacacagattcaatcacctcccaccgggtcccgcccacaacacagattcaatcacctcccaccacacagattcaatcacctcccaccacacagattcaatcacctcccaccacacagattcaatcacctcccaccgggtcccgcccaccacacagattcaatcacctcccaccgggtcccgcccacaacacagattcaatcacctcccaccacatagattcaatcacctcccaccacacagattcaatcacctcccactgggtcccacccaccacacatgggaattatgggagctgcaactgaagatgaggtttgggtggggacacagccaaaccatatcagtggagacgcgcaggggcttccggcccccatacactcccacctcccactgccctgtaggactctcctggctgttccagaaggggcttccattctccacgttccctggggcctcgtcctccttgcccttctacttcctcttggaggggctgaccttggccctcctgggctgaccccagcacagctgtgcccagagtgtgaacggagccccctggctcccgacactgcctgaggccctgccgggaagtgtggctccaggaggacgggctggcctcccggggaggatgcccccacctgcaagggtttgtccaccacccatagccactcctggactggggcagaccccacacctcagcatggactaaggaggccggccaggctgaaccaagcctcacccttccctgggagaaaggcctgggttggtgtccccaaagccacacctcctcatttttctcataccagagctgactcacaatagaattaccaaaaaagaggaattcaaatggagcaaggaaaggaataaagaaatgaggcaacgtatcatggagtcttcacccagagccccccttaaccctctcctgcctggagggacagcagccacctgcctagaggcgcagtccgttctcttctcccagggcctccaagtggcctccccctctgcattcctggagatggcagcacgtggtggtctgtctgcccagcactccttgagtggacacacctttcctgaggttatcacagggccggactctcacctgaggcaccacaggtgaatgccactgtcagagcagcgctgcccatcaccaaagatgtcaactgtcaccagtgatgtcacctgtcatcagggcggtgccacctgtcagagcagcgctgcccgtcatgaggcgtcaactgtcaccagcgatgtcacctgtcacctgtcagagcagcgctgcctgtcaccagagatgtcacttggcatcagcaatgtgacctgtcatcagggcagtgccacctgtcagagcagcatcacccatcaccagggacgtcacttggcatcagcaatgtcatcctgctccccaggtgccaccctcctccctgtaccccccacccctaatgcccacatgtgcaattcccagtgggtaccactggaaaaccaaggcagtcctcagaaagaataaaacatctgttttaattggccagtaaaatacattgcaaatcattagtattttataaacagaaacattaagttataaatccatgttaaaaattgcagctcagtgcagccccaacagctgtgtgtccaaaagtctatttttacaacattttcctccagtatttttgtgacaagaaagttcctatctgccatctagatcaagagcctgaactacagtattttcaaacaagaaccgggagaagtcggtacaaggatacgtcgtgctgtgtatttaaacggcgcttcccacacacctgccgtctgcatcccgggaggacgccctttgggaaaggcctcctcggcagtgtgaggtctggaggggtctgcctggaccccatttttaggatgctcccctccccaataaaacagcagcccccgcccctgccctgcacagcatctgggggttcataacacaggtgcaatactgaccatgggccctggagggacgtctgcaccccgaagcccctgtacctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacatttctatttttaaaatcttcaaacttccacggggggtggcaaatgttaattctgattttaaaccccattcaacagcaaaacgatgtgggcttcaactgtgggctccgcagacgcctggagaagctggagcccacacctttccctccaagggactctgtggacagaacccgtatcccccaagcaccaaggacatcctcagactgggacttctgtgtaattctgcacctcccagccataaaactgacccctcagccaggaatcaaacgaacctcgaaagtggaacagggaggccgcctcccatggctgcctggatggcaggcacagtgggagagtaatgctctgaacctcccaatgtgatgaagccgaaagccgaggcggggccagcaggcctcccgggcacagagccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtgcacatctgcactgcaaagagtgtgctcatgtgtggggagcatgagctccagggacacagatctgtcccagtgctgggacactcagcaggcgtgggcacctcctccccacatgcacacctccctcataccatgtgtgtgcacctcctgccatgtgtgtccactacctccatgtgtgtgcacctcctcctacgtgcctaccacctccatgtgtgcatctcctcccacgtgtgtgcacctccttccacgtgtacctcctcccatgtgtgtgcacccctccgtgtgtacacctcccacgtgtgcacctgtgtgtgcacctctgtgtgcctcctgtgtgcacctcctcccatgtgtgtgcaccacctcccacgtgtgtgcacccctctcgcatgtgtgcacctcctctgtgtgtacctcctgccacgtgtgtgcacacctcctcccacgtgtgtgcacctcctcccacgtgtgtgcaccacctcctcccatgtgtgtgcacctcctgctgtgtgcgcctcctccatgtgtgccttctcccacatgtgcgcacctcctcccacgtgtgcaccttctgccatgtatgtgcacctcctccgtctgtgccttctcccacatgtgtgcacctcctgccatgtgtgtgcgcctcctccgtgtgtgtgcctcctcccacgtgtgcaccacctcctcccacgtgttcacctcctccgtgtgtgcacctcctgccatgtgtgtgcacctccacccatgtgtgtgcacctcctgccatgtgtgtgcatcttgtaccatgtgtgcctcgtgtgcgccttctactacaacaaacagcatcatgcttcgcgcattttcaacctgctggcttttggccatgaggttgatggacctgctgatatcaacgaggcaacatatttggaaggcaaatggggctgtctccccagaagggtgtcgagagggatctgatatgatgatgtcagaggtgaagtcacagcactcaggaggtgttgcaggctcagtcccctgagcaactcggtccaagtccgggccacagggacctgtcactctcctggagcctcaccactgcccttcccagaccagacccgcatggtggaaggaaggaggggttaagaaggaaggaagggaaggagggagaagaagggtggaggaggagagagggaggatcgaagggagggaggaccaaagagaggagtgagcaggaggatggaagtgaggaggaggctgtacagctacacagggctctagggcttacccgcccctgaatgagcccgtgtgggggcttctgccatggtggacctgggtacccactggatggagagagtgacacagacacatctgctcactccaggctaagagccagcctagcactttacatagtttaagtcaatcttccagcaactcatgagggtcttacaaccctctgttccatggagtgagggggagtggagcttagctaagcgccacctagcctgcagctggtgactaagctgaacgtactcaacctcgccacacctgcctcatgagacaagagtgggtttcgtccagagctggccctgctcccgggcaccatgggtggcctggagagatgccagagggtgtgccactgaaccaaggcagaacaagacctgggcctagagactgccagagcacgtgacaccagtatagcagagaggctgggaggaagcaggtcagggaggcagcccggacgctggctgggggcctggagagcaaaggcagcacctgctctgaaggagggaccagcagcgccgggccacgtccactgactaccgccaggtgccagcccggtgcaagtgggactctcctcccaggcggacacctgagcacgggcggccccacccgggagctccctgcagccccacccccactgcaatctcccgcccactacactggccgtccagggcaggcacgggagtggcactcactggcttccatatttcgtcttcttgaacttgtccctcttatactgggcgtgctcctgctccaaagccccaaccccagcgatgacttgctttagcgtcttgtaggtctcctgggggtcgtcaatgacgaacgtcgaatactcctcctgctccgggccgtcatacacagatttgctcccacaggcctctgtggagggcggaggggtcagcgcagggcaggagcccaggccaccggccccgtctccacacagctgcgtcgctgcaggccccacccacagtacacatccttccaacgcaagctcctccagaaagggctgaccaccactcgtaaacgcagacggagatagaaaccattcccgcaggtaggcgagttgtgcccacactgagcccagggaaagcccattgggagctggatgctgagcaacctcattcacctctgagggctctgctgcccctagctcccagccttgtcaccaatcagccattctcacagggggatgtgcacatctctgcacgccccaccagcccgcccagccagaaccaggaggagagacacctgcagctggacgctgggctggctcatgggccctggggcagccctgaagagtcagctgagggagtgagcacgatggggttcagcacatttcacacccagctgccactgagcatgtccagccaggacaggcctagcccagggctggccgagcacagggcggacaccagtctgtgccgcagcttctaaagaccactgccccggaccccacctacgcaccggggccaccttcctaatcggaccacatcactcctgctgaaggccattctggtgcctcgcccctagcggacagccatggaacccttgagccagggcagggccctgtgccacctgagtccaaacacctgaaccaggtacacgtctctgcctcactgctcacagcgcctgggcacgcactcccggagccagcaccgatgccctgcagctgtgtccatctggatggaatgaatgtttgtgcccccaaatctgtgggttgaaatcctaactctcaagggatggcatcaggagatgaggcctttgggaggtgacaaggcgtgagggtggaacccttgtgcaggggatgggcgtccctatagaagacaccaaggaagctggcttgcctcttccacatgtgaggacacaatgagacactggcgggctgcagcccagaagaggacccgcagttaaaccagcactgctacgcccggatctcaagcttctcaggccttcaatctgggaagtgaattcctgctgtctgtaaccacccagcctatggtacaatttttacggcagcccaaactcaccaagaacttggtactgagaagtggctgctgctgtaccttcaaatgtggactggctttggaactgggtgctgggcgaaggctgaaggggtttgggggtgcagagcggaaaaggcatggctgccatgaatgtccttaaaggacaatgctgggggctcgggagaggagagctgcagagaagtcctgtcttaggggatatctaagtaaccctgaacagaatggtggcatgagcatgggtggcaaggctgttctaacaacatctcagacagaaaggacggccatgctactggaccgtggagaaaaagccatcctcgtgacaaagtggacctgtgttcatgccctcgtgttctgggagggtggaactcgcgagtgatgacatcagacacgtaattgaggagatttctaagcaaaatgctgtgggagcggcttggttcctcctgaccgctgacagcaaaatgtggggagagagatgatttgaaggtggaattgttgagcaaaaaggaaccagaactcaaaggctggttgagttaaaagatttgagaattaaaattccagcctacccatatctcaaaaaaaatgagacagcatgtttggaagagaccattaagcaggtggctgtgtggctatctgataaggagacaagtgtggggctgagccttggacttgaccaaccatctcagcaacagccgggagcagagaaggaaccgcaccagcagaggcactgccagaagaaaccaggaaacagagaaaacaggatgaaatgaaggcaggctgcggtgtcttaagccctacaagccaggccatagagctattcagctgtgaacatgtgccattcttcaagacgagggaagaaggaccctgaagcgggtagggccatcagaatgccactctcacccagaatgagtccatggaccatgtatcagatgcaaaattctcagctggaatattgattaaaaaataaaactggcaataactagaaaaaaaatcgcaataaggaatctgtccacccagccatcactcacccatccgtccatccacccatctgtccatctacccattactcacccatccatccctccacccatcactcacccatccatccatccacccatgactcacccatctgtcgatccacccatcatcactcactcctcggtccatccacccatcactcacccctcagtccatccatcactcacccatctgtccatccatcactcacccatctgtccatccatccattactcacccatctgtccatccacccatcactcatccctcggtccatccacccatcactcaccctatccatccacccatcactcacccatccgtccacctacccatcactcacccatccgtccacccattcatcactcacccatctgtcaatccacccatcactcacccctttgtccatgaactcaacactcatccatctgtccatccacccatcactcacccatccgtccatccacccatcactcacccatccgtccatccacccattactcacccatccatccatccacccatcactcacccacccatccatccatccacccatcactcaccctttggtccatgaacctaacactcacccatctgtccatccacctatcactcacccatccatccatccaccatcactcacccatccttccatccacccatcactcatccatctgtctatccacccatcactcaccctgtccatccatccatcactcacccatctgtccatccacccattactcacccatccatccatccacccatcactgacccacccatccatccatccacccatcactcaccctttggtccatgaacctaacactcacccatctgcccatccacccatcactcaaccatctgttaatccacccatcactcgtccattgctccatccacccatcagtcacccattggtccatctgcccatcactcacccatctgtccatccacccatcactcgcccatctgtccatccacccatcactcaccctgtccgtacacccatcactcaccctgtccgtacacccatcactcacccatcggcccatccacccatcactcacccatctgtcagtccacccatcactcacccatctgtccatcaccatcactcacccatctgtcagtccaccgatcactcacccatctgtccatcaccatcactcacccatctgtccatccacccatcactcaaccctcggtccatcctctcatcactcaccctgtcctccacccatcactcacccatctgttcatccacccatctacccatccatccatccacccatctctcacccatctgtccatccacccatcactcacccatccgtccatccacccattactcacccatctgttcatccacccatcactcacccatccttccatccacccatctctcaccatctgtccatccacccatcactcacccatccgtccatccatcactcacccatccttccatccacccatctctcacccatccgtccatccacccgtcactcacccatctgtccatccaccatcactcacccatgcttccatccacccatcactcacccatccgtccatccaccatcactcacccatccttccatccacccatcactcatccatctatccacccatcactcaccccagtccatcctctcatcactcaccctgtccatccatccatcactcacccatctgtccatccacccatctacccatccatccatccatccacccgtcactcacccatccttccatccacccatctctcacccaaccgtccatccacccatctacccacccactcagctgcctgccccgccatctgtccagcacacccatccaggtgctaggcacttcctctgtgccaggcccaggaaggtcactgcatatggaagctgaggagatgggagatggttgtgactttggtgacacaggtgagcccaggtgatgtggtttggatttgtgtccccacccaaatctcaggtcagactgtaatccctagtgttggaggaggggcctggaggaaggagaggggatcatggggacagacttccccattgctgttctcgtgatagtgagttctcacgaggtctggttgtttggacgtgtgtggcatctacccccatctctctctcttgctcctgcatgtaggaggtgcctccttccttcctctttgccctcccaccatgatcgaaagtttcctgaggcctccccaaccatgcttcctgtacagcctgcagaactgtgagtcaatcaatcttcttttctttatagcaacatgagaactaatacaccaggctatggggatggtgaggttgggaagcgcctggaggaagacacttccaaggtaaacagggtctgccagcctgatgcgcaagggtgttcccagcagaggaagagctggagctgtgatgcggggcgcacggcctaggaggagctgagcaaggttggacagtggtgcagggagcaagctgatcatggagggcctggtcagcatctttcagaacctgggtcttgtgtgtgatgacctcaccctctccgaggctccctgactctggcctctgctgtgtcggttcctgctatgagagggctgggaagaggctggctgatgccagacccactgtcttggccaccctgaggccttgtgccatcttcacagtatccagggacctcagacccagggacagcacctcgcacacttgctgggggagaagacgctgtggtgggtggtggcccatgagtgtgtacatgtgtggttgtctgcacatgtgtgtgcatgcctgcacatgggcctgcacatgtgagcgtgttgtgttcaactgcacatgtgtgcaggtattgttgccttgcctgtctgcacacacatgtacctgtatgttcatttcacacatgtattgctgggaacatgtgtgtacatggctatgcatacatgtgtatgtgcctgtgtgttagtgtaggcctggaacccacgtacacccagggcatgtggggctggagaacaggcgtggccaagctcacagatgggcagctgcacggacacccagggcatgtggggctggagatcaggcgtggccaagctcacagatgggcagctgtgcggacacccagggcatgtggggctggagaacaggcgtggccaagctcacagatgggcagctgcacggacacccagggcatgtggggctggagatcaggcgtggccaagctcacagatgggcagctgtgcggacacccagggcatgcggggctggagaacaggcgtggccaagctcacagatgggcagctgcgcggacacccagggcgtgtggggctggagaacaggcgtggccaagctcacagatgggcagctgcatggacactcaggcaggactcatgtgtttccaggccaaggcacacttgacacttctgggttaaatcaggggaatgaaaagaagaaaatctaacaggcataactccaggcacattccgctctatttccattctgagtgggactcaagggccctgtcatatgatctccaagagcagatccgagttctaccagacactggcatagaaacaaacgcagctgcttcacccccgtgggcttttcttgtctctgcctctcctgaatcacagacctcaaaccactgtccccatgtggtctaactgggcttatctggattgctatttcaattctgtaaagcaattcaatgtcacagataatgatacatactgcatatagatttgaaacacacggtgtgcctggcactgtttcaaatatatatgcagtatcgttatctgtgacattgaattgctttacagaattagatggcatgtgtgtacccacatatatgcatgctgacacatgtgcccaaagacatacatgcatactcacacgtgccctcatgtttccacacatgcacaaattcatgcatgctcacgtgtccccacacacacatgctcacacatgtacccacacattcactctcatacatgtcatgtccatacattcacacacactcacacacgtccattcatgcactcacacgtgtccacacattcacacatgctcacacatgtccacattcacacatccacactcatacatgtcatgtccacacattcacacacgctcacacatgtccacattcacacgctcacacatgcctacacatatgcacacatctcatacgtgtgtccgcacacatgcaagcacactcacatacgtgtccacacacatgcacttatccctctggaaaacaaaggaatgaaaaaataggtcctctaaagaaacttggcagtacagaggttacaagttaaattccatctaaaaattatctatagaacctattatacaggtaattgtcccccagatagctgcctaccctgcaaaaagcttttcgcatccatccgtgctacaaagacaactacatgtagcccacactacaccagaggctcagaccacaggttttcaccccacagcatgctcctgaggccggggcctcgccagccatcccctcgctgcacagatctgtgtgccgggcagactcaccctgcatcttctccagcttgctcatgtacaagttgaagagggagtagatacgctccgtctcacggtccccatcaatgtccagctggatgttggctgggaggccgctgtccagacacagcaagaacagaaagataaaaacacttatttaaacgatgcttttaataatgacattcatttttaaaatgtcactgaagaaagacaacgattgtgttggaagtgaaattcgacaggatcgatttgctgtccgtctgtgcacagccggtgtgttggcttgctgagcaaggctgacagcgtccacagcagcacggacagcagtgtcaccaggctgcaaaccggaactaactagcaacctctgcttcagttaccattggcctatttggacacgtggcaaaagatccttgctgtttagtatttaaaatgtgcttatcatttgtactaactgacctttcctgaaatcacgcagtactgagttatgtcttgtttaaatctattcctactccagaatcttatcaatacataagaaatttaggaagactaggtgctaaaatccccagtgtaatatgtaatacttgtacatttttagtatcatacagaactcaattcccaggaactatgaacactccagacctcatgtggtttattccttcagtcatttcaaacacagaaggaggctgtgtgcttgtttccctgctcattctatgtctgcttctcctatgttcacaccagcacacgtcaggctggagcgcggtggcacgatctcagctcactgaaacctacgctttctgggtttaagcgattctcttgcctcagcctcctgagtagctgggattataggcacacaccaccacgcctggctaatttttgtatttttagtagagatggggtttcaccatgttggccaggctggtcttgaactcctgagctcaggtgatccacccacctcgacctcccaaagtgctaggattacaggcgtgagccactgagcccggcctcatgtctttttataaatcttactttgtgttattatgaaaaacctccatagccgggtgtggtggctcacacctgtagtccccacacttttgggaggccgaggcaggtggatcatctgaagtcaggagttcaagaccatcctggccaacatggtgagaccctgtctctattaaaaatacaaaaattagccaggtgtggtggtgcacacctataatcccagctgcctgggaggctgaggcaggagaatcgcttgaacctggaaggtggaggttgcagtgagccgaaatcacaccactgcacttcagcctgggcaacagagcgagactctgcctaaaaaaaaaaaaaaaaaaaaaaaaagaaaagaaaagaaaatctacattgtacagaagcacgtctttgatggcttcagacaaagtggcctcacggttaatttcacatttgcacgcaggtgcaaccaacagggagggcctgataggaacgcgcggggctgttatttttagcaaaatgctgccttgtgcagaacgtgtgaaatatgctctttaatttagtaaatactttttaaaaggcagaaatgcttattatagctaaaacaattcttaaatcataaaatttctgaaacgtctgtaattttttccatactgattagaaattgtttccaacttatttttgtttgaagtatgacagtttttcccttttcttcccaacttctcttgtaaaaaaagaagtgggtttctgctaatgaactgatcagatgtcaatactgtatatgccttttgagctgagtagctcagtatttggatacttggtcatttgttttattaggtaattgataaaattgtgtcacttattcatgttcaaccatatatttatgctgtctggggatgggtggttatagttctgtgtgagaaataatttgtcagtcttcaacagcttgtaaaaactttgcagtgagagcttaaacatctaaataaataatgaaatgcatttatcataaaaaaaagaagaaagaagatgaagtgaccaacattaaaacacatccctggccagtcagggagttcatgtgggtaatcccagcactctgggaggccgaggcaagaaggatcgcttgagcccaggagtttgagcaacaccaccctgggcaacatggagagaccctcacagtgagacctggcaacatagtgagaccccgtctctacaaaaaaccaaaatttaatgagctgggctggtggcatcagcctgtaatcccagctacttgggagagtgaagtgggaggactgcttgagcccagaagtttgagaccagtctgggcaacgtggtgaaaccccgtttctacaaaaaaccttaaaacaattagcctggaatggtggagcacacctgtagtcccaggtacctgggaggctgaggtgggaggatggcttgagcctaggaggtcgaggctgcagtgagctgagattgcaccactgtactccagcccgggtgacagaacgagatcccatctcaaagacataaaactaaaaaagcatccccgagctgggagaactgaggctggctgtgggtgtgcgggataggggaggctcccgagctgtccggcctcagcggctggagcctcttgggacccacagatctgccaaggcagtgagcaaactcggcagacgtgttctcatggagataaatggcctggaaggaagcctcctgggactgtgttccctgcacggtcggctgcgggtggggacaggccaggttttctctcctcgtcaggctgcaatgcttcccgctgtcctgggatgcgaggacatgggagagcgctggcctctcctgggggattctggggcggtggccacgcatgcctgagcagcagccaggcccccttcctgagcttcagcctctgtgtccacgaagcaggatctaaggtcccacctctgaggctgtgggaggattaaacggtggcccagcatggagcacagctcatcccctgcagggcccttatgcgaaagcatcacgtggccacaacaacagcgaggtgcatctcacggagcataaccagggggaccgccaggcacccaggcctcctccttaggaccggcagatatgacccaagcctctgtgcaactgccagaggcccggctgatggggggccctgctgatggggggcctgacagggggcccagctgacggggggcccagctgacggaggacccagctgatgggggcccggctgatggggggctggctgacggaggacccagctgatggggggcccggctgacgggggcccggctgacgggggcccggctgacggggggcccggctgacggggggtccggctgatgggggtccggctgacggggggcccggctgacggggggcccggctgacggggggcccggctgatggggaggcccggctgatggggaggcccggctgatgggggacccggctgatggggggcccggctaatgggggggcccggctaatggggggcccggctgatgggggacccggctgatggggaggcccggctgatggggaggcccggctgatgggggacccggctgatgggggggcccggctgatgggggggcccggctgatggggggcccggctgatggggggcccggctgatggggacccggctgatggggggccgggaagacaacgggctgctgcgtcatgtggaatcaaggtgggtgtcctgggccagacgaagctttcagggaggggcttgctcccagcctcctcctagagaagcaggatggccacggcctggggagtcccccttcaccctgacctcccgctcccccggggcagggcctcaggaagaccctcgaaggcctgtggcaccctggagtctgcgcagagccttccagaggctgggccccagatgctccctcgagggaggacccctcgggtgggaggctcctgggaggaggcgagggcagccctgtttatgtgcagcttacaggcaggcatgcactgtctgctggtccctccctactcagccccttggccacatttcctgcacagtgcacgagctgggcaccgaggcacagacctacccagtgcagggcgagcagcccggagccgagtcggatggcgccctacagcacagccagtggccgctcaggtaggcggacgggtggtagacggtgaggcgcttctggttgcactggctcactttggtgagaatgtcgatccagtccttggcctccacgcagttgttggcctggatgtacagcgcacgctctggctggatgacctggaacatctgaggacacaggtgggctcaggacagcgcacatgaggtctcgtggctgagcacgtgcaagagtccaccaggcacctggccgtcctcgccggagtcgtaagaggggacgctgagggtgcacaggcccaaaagtcctggagctctaagccccagaagaggccaaggccagggggtgcatggagctctctgccaccctaaaacctgacagctggggccgtggggaatggaggtgagaactggtgcagctggagatgtggccaggtggccaggaacagcttggccaaggccctttatgtcctggagccttggaggtctccattcaagacaaaagaggggccctgtggcctccccacaaggccctcctgcagctgactgcaggcatcccatccacgtggtgctcgtgctgtgtcagcccaggtggcccggcctgctcagctccttccccaactgaccagcccaggattcttcctcctcctcccagctggggttagggggctgcttcctcttgaagcgtctcggggcagcaacaacctttaccatttattactcattcaacaaacatgactgagcaccagcactctcctatgtcccggagacaaagcctggcatagagtttctactgaacctgcagccaccaagaaagactaaacgagggcaggtgtcagcagaagctggaagtgagcagtcctggtgctgtagtcggcgttgactcaaagttagttaagcagggggtgggggcaaagggtgtcaaaggcagaagaaatgggaggcacaaaggtcctggggcaggtgggacaggggtcctgtgattggagggacaggtctcccggggcaggagtgacagaagccttaggattagagggacgggggtgctggggcaggggggacagatatcctaggattggaggtcagaagctcccagaaggagccggctctgttgcacacagaagacaggttttctgagtaggagactgactggaggttgggagggctctcatgtgggacttgcccttaagtcaggagtcagggggacagtggccttctctaggggacgggccttctgcactcatctggggaggatttgggctccaggtttctggtgaacagctgaggtcttatttacagaggccaggagcctcccgccttgcacccggcacatgtgtataggtctcggactggacgcccccgtgcatggctgtgatcccccatggagggcgtcctggccatcatcccaggctcggccctgccaccaggagcagccttcagaaaggtctccccagctggtgagagcctggcctggcagtggcctcaggggaatcgggctctgaggaagtcagtgggaatgaacagctgggaacaggcggctgaaactagggaattattgggaatctatgtgaagggctggaggtgcttccaggacatgtccacactgcttccttcgagggacggtctcagggccaggttccggccatccccctcagtcagcaggcattgagcccacaccctcctcttcccatctccccctcttcccaacccttctcttcccagccctcctcttcccagccctcctcttcccatgccctcctcttcaaattactctccaaacttatgccttttgcaggatctgtctggactgcctgtgaataacatgctagtaaaattctgccaatggtaaggaacatgcgtcaactttggcacgaggcccagggactgtgccttccctgcaactgttctatgaccctcatgctgcagtcggggcacagaaggcttgtcccagccagcatgtgtcagggtacggggtcagcctcaggatggcacggacggcggggtcactggctgaaggggcactgagtcaccagggagaacgtggccagcggccgactctgggaggccaccacacaatggtgacgccacggacacctctaggggattcccgccagaaatgcatcatcagaacctgccacgtcggcacatccgacaaacccacagggagggatgtccagaaaaccgaaggcctgcacgcctcaaagatgccaaggccaccacacacaaagaaaggctgggagtgtccagtgggccagacggagggggcagcagaatgcagcgcagactggatccagaggggaaggaaccacagccggaagaacgggactggacagcggcaaactcgaatgtggtcgcgccggcgacgtgcgatggtggctgctgtggttttggggactgcacggtgggaaacacacttggaagtgttgatacattcagaaaagcacgggcgggaccgtgaagggagaaggaacaagtgtgactggggaacgaggcgacatgtgggtccgggtcaagcgtgaccggggaacgaggccacacgtgggcccgggtcaagcgtgaccggggaacgaggccacacacgggtctgggtcaagggtgtgtggaaagtacttgttctactcgtgcaacttctataaattcaaaattatatcaaaataaaaaagcttccaaaaggaattccagacggtcccaagcctgcttctgggatgtctttgacagagggccccttgacattggggaccctgcgggggacgccacctgaagcagctcaggccccaccttccggcaggttccaccccaccccggtgaccccgggcacagagagtgtggctgctttgatgcgagattccgacacaaactcaccagcacctggtgaacaacccgagtaacacgaagactctgagaagcctggagtgcagtgggtggggaagggtgagcccagggccaggtacgggaagagagcagagaaaacctggccaggcctcaacccgaaagagaggcttgggggccccacactcacgtttttcattttgaaagactcctcctccagcttctccactgccaggatgttctcgatgggaatgctgtagagaggctggtcccctgcagcagagatggactgtcagtgggtgcgggccccgctgtcccggctggggtccgggtggggctgaggggtctctgccggggggtctcccagggggtctttaccggggggtctctgccagggggtctctaccggggggtctctgccagggggtctctgccagggggtctctaccgggggtctctgctgggggggtctctgccagggggtctctgccaggggtctctaccgggggtctctaccggggggggtctctgccagggggtctctgctggggggtctctgctgggggggggtctctgctgggggggtctctgtcaggggatctctaccggggggtctctgctggagggtctctgctagagggtctctgctggggggttctctgctgggggggggtctctgccaggagggtctctgctgggcggtctctgttggggtggtctctgccaggagggtctctgctggggggggtctctgttgggggtgtctctgctgggggtctctgccagctgggggtctctgctggggtgccctgggccggaggaggtgccccatgttcatctccttggggatgatggctgaatcactgacaggctgcaggtgcgggggctgaggaagcctgggacccacctggccctgccatgcacccaggctgggcccaatgctcgcatcctcacagctgccgtggcctcaggctctgtccccagaacatgttcccgttctgggacatgaacatgggagaaactgctagatatttcctaatctagatctgagccagcagatctgacagcgaggggcaggaggtggtgggaagccccgtctacctcggcggagcggcaccctggccatgacgaggcgaccagaggaggaagggacgtggacagaaaagcaccttactgatgtggtcagctctgcgtttactggttctctggggaagcagatttccctcactttccagcagcaggtctgaaagaccccttcagggatctttgaagggagaaccagaagcagagggctctgggtcaccgcggccccgggctctgcccgcagcactgaatccttcctcccctcagctctccccctgaaaaagcagactcagtcccagggcccagcacgctccagcaagagccagggaaagcgaccttgctccttacctttgcttttgtggtaggtaaattcatggttggtcaagcgaaaccatctcttcttaaaattcttcatcccaaagcgcttccgtccttgggccctcttgatcatgaacctgtgtgaagagcacacagggccggggtccgggcctcagctgcctccctgcacaggtgaaaaaccacaccccccactttctgcgttctgagacctgaggcaggcagtggattttcaatatcttatcattttactccgagtgatgagattaaaattggaaggcaatgcctctcctttgaaaagttgagcgctgactgctttgagtcaccagttggtgatggcaccaggttttaggagatctccaaccctcctgcctcccacactgaactttcaacagtggtgctgccactggaaatgccaatgcgatgctcccacggcggacctgcggccgtgggctcagggtcagggagggcagcggacgcccacacaacacggaggacctgcggccgcggacctgggatcagggtgggcagtggacgcccacacaacatggaggacccgcggccgcgggctcggggtcagggcgggcagtggacgctcacacacagaggacctacggccgcgggctcggggtcagggtgggcagtggacactcacgcaacatggaggacctacaggcgcgggctcggggtcagggcaggcagtggacgctcacacacagaggacctacagccgcgggctcagggtcagggcggacagtggatgcccacacaacacagaggacctacggccacaggctcggggtcagggcgggcagtggatgcccacacaacacggaggacctgcggccgtgggctcggggtcagggcaggcagcggacgctcacacacggaggacctgcggccgcgggctcggggtcagagcgggcagcagacgcccatactcagaggacctgcagccacaggcttggggccggggcaggcagcagacgcccacaaaacccacacctgtgttgtgcgggagtcacgcaccagcgcctctgccagaccaaacctgccccctcagggccagccctgctgtggtagaaggcgccactgggccacgtcctcaggaaacgtggggagcaggagacaggatggccaccgaggatgcaaggcctcagcgaggaggacctcaagccttgccctgggcagggtcctcgaacaccctcccggcagcccagggccctctgaggctcggccttcattgccgggcaggggtccctgaccagaaccggcggccgagctggaggagaagaaagtggccagacagagtgactggaggacagaggtggaagctgaggacgagaagccaagctggagagacagagtggggaggtgggcgggggagacgcacctcgacaagcgcactcagaaatcggaaagaggggctttgagcagcaacacagccagatgtggccagagagctgtggacgcacaccggagggtgtggaagctgctgggagctgttcaagagagaaaagggcggggcgctgggagccgccaggacagcgcagttcacaaccagtggatgccgaacgccgttcattccagggattcacaggcaggaagtcagcccaggaggctgttgaggaccagcaggacccagtgggatgcgcagggcggggcctacacagacgggggttggggggggactgggagctccacgacatgccggcctccttgagggcaacagggcgcctctgagaagactctggaccatgtagcagttagatttgagtagcagtcttgttataaatgttttcggctttaggatttttttaagaaccccaactttctgagggccttcagtggatgaggctgcatgtgaattttatgtgcagtttccaggttaaggcagcactgagtggagagaagccagtggctcctcactgcacagctctggtctgggcgcctggctctccaggagtcggttttctaaccgggcccatcgcgcgtgtgggacggggaggcaggagccacggctaagccggaagcctcaggctgaaagcagctcggccccgcgcagccacggccaactcaactcagcaaacacacgctgcgctgcagaggccccgtccccagtcctgtgtcccagtgggtgaggacacacacagccctgagagacggcagaggtgtgggagcatctcagcacagggtgagccctcaggaaacatggtcatcaccacccccacacatggacgaacatggcaagacacacttggcaccaagggctgagatggcagaaccgaggccctaggacggcccatgcttgcacaaccgagggtggccctaggtttggggatgtgacagagctgaggtgccggaggagaagctgatccaggggctggaaactcgagggcctgatggaccaaaaccttggtgtgagtcgcaggtggtgcagctgctggaaggagctggtggagcctcagctgcatccagggcacctgggaggcgcctgtccttgaacctctggctggtggcacctgggaggcgcctgtccttgaacctgtatctacagcagcttctcggcgtcagacacacaagccctgagtgtcctgtgttgctttagggattacaggatgaatatctgttgctttgaaagctgtgaatttatgaaatgtagaaagtaaaaagtttcctcttcaaagtttcccttcttgttaaagaataaatcataagtgttagaaataatagtttcttttaaagactaacttccttcaagcctccttgctttgtgctaataactctttgttaagctctatcctgtgtagctgttggacgtgcccacaggctcgtaatatattctgtgtccttgtaccttaaccaaggcaattgtgttagacgtactcataggcatgtcccagctcacagcctatgccccttccttatttaaacatattattatttttctacctatttaaaaaagttttaaattattagccaatcaggtcttaatttagattgtgaggtccggctccaggcaatggggacaggacacgacaacaggaacctcgtgcgtaaggaataaatattctggcgtctctttattctgtgtgtgcccttgccattactccttctgccagggacaccctttctgcagaaagtaaaaattgcctcgctgaaagaactttttgtctaaatgctaatttttccttatggcaccgaagaacaaacattttgcatttctaacatgaaatgtgtgtattgcaaatgttattggttaatatatgattaagttaaatgaaggtgattttaagaaaaatagcaatgtaagtaatgccactggggtatggtccaccagtgacccagagatgatccaggtttcagcagatggctctaacagagtatccacaaaaatagacaaatgggacttaattaaactaaacagcttctgcacagcaaaataaataaccaacagagcaaacagacgacctgcagaatgggaggatatttgcaaagcacagatccaacaggggactaacagccacaatttagaaggaactcaaacaacttaacaaaaaaaataaaaattaaaaaaaaatttaaaagtggccaaaggacagggggatagacgtttttcagaagacaaatggccaacaagcatacgatataaagcccagcgtggctcatcacctgaggaatgagagccagagctgcctgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatggaaattagcgcttaaggaaacccacggagatttctcaagaagctaaaggcagagctgccattcgatccagcaatcccacaccaggccccacccaaaggaagagcaattaccaaaaagacacctgcatgcgtacgtttaccgctgaaccactcacaacagcaaagacacggaatccacgtgtccaccaacggacgactggataaagaaaacgtggcataaatacaccacgacatgctactccaccatcaagaggaaggaaatcttatgttttccagcaacgtgaacggaactagaggttgttatcttaagggagatgactcagagacgaaaagccaaacgccccatgttctcactggtccataggagataaacacggaggggcggggcgctctgggacacgtattcggaatcacagactgaggcctcggaagggtggaggtgggagcgggagaggaatgagaaattactcagtgggcacaaagtgcccgttcaggtgacggtttcacgagaagccccatccaatacaactgcacttgtgcccgacatgttggcaaacacataaaaaatacaggaacatggtccacaccaggcagagcaaagccccgagcgggagtgggagccgggccacaggacggggttggtggaaacgggcagacgtgtcagttatgtaaggaaggttgatgggctctgatgctccagggacctctgggtggaggttgagggaggacaggcctgtgtcagaaacacggggtggctgtgggacacagacgtccccctccaaggtcaccgagaaggtggcagaggggtcccaggctgaaggcgcaggggccagacccccagggctgtcccctctgactctggttccctgagcaaagagccctcgggagcctggagggaaggccagccccaagtgcgggtgtggacaacacggccagtggtacagaaatcacaaggctgctggccagcaagggaggaggctgcccccgactagggaatcttctggaatgtgctgggtgctctggggactgggggcccccatccctttctcccctccggccctgccggatgccaccttacccttctcccccctcctgccctgccggacaccaccttacccttctcccctcctgccctgccggacgccaccttacccttctcccctcctgccctgccggacaccaccttacccttctcccccctcctgccctgccggacgccaccttacccttctccccactcctgccctgctggatgccaccttacccttctcccctcctgccctgccggacgccaccttacccttctcccctcctgccctgccggacgccaccttacccttctcccccctcctgccctgccggacgccaccttacccttctcccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctccccactcctgccctgccggacaccaccttacccttctccccactcctgccctgccggatgccaccttacccttctcccctcctgccctgctggacaccaccttacccttctccccactcctgccctgccggacaccaccttacccttctcccctcctgccctgccggacgccaccttacccttctcccctcctgccctgccggacgccaccttacccttctcccccctcctgccctgccgcccccctcctgccctgccggacaccaccttacccttctcccctcctgccctgccggacgccaccttacccttctcccccctcctgccctgccggacgccaccttacccttctcccctcctgccctgctggacgccaccttacccttctcccctcctgccctgccggacaccaccttacccttctcccctcctgccctgctggacaccaccttacccttctcccctcctgccctgccagacgccaccttaccctccttacccttctttaagcacgatgggctgctcaacactcttggggtctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcaccgcatcagcatatttctgctcattgaagaattcataaaatgtagccatgtaggactccttaaaactcgcctaaaatgaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagacctgccagtgcccgtgaggtctccaagcaccctttggcatcagtgactccgtcctggccccgggctgtccctcacacctgggtcccaggctcatgaagaggtacgttggggcccagatgtggctgcctgggaacctggagtcataggccagggtcccagagcccccacgcccatctctcgcccgtggggcataagggccgctctgaggtgggaagagggggcagggacctccatcacacggggaagtggaggcacccagggattcgggggggcctttgcagccaccattcctgaggctcgaccccaagttcctgttgtttccacactgaggtcactgcacagttccctggctgtgaaatgaggtgggtttggtgcagacctcggaggaggctcaagtgcctgttatggagtttccagcccacagcgcagggcctggctggtgggaaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagatgcctgagggactcctgacctggtggcaccagatccagtctgaagggacgaggatggaggacggaggttcatatccacagggagagaggggccctgggaggagggggccgcgtggggaggggagcgccacgttgggaggaggcggccgcttggggaggaagcgccacgtggggaggaggcggctgcgtggggagggaagtggggaggagggggctgcatggggaggtagtgcagcatggggaggagggggccatgtgaggaggagggggccgcgtggggaggtggggaggagggggccgcgtggggaggagggggccgcgaggggagtagggggctgcgtgacgaggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggggttcactttaggaggggagaggtgagcgggacggggacgctcaggtcctgggtttcaagagaggatgtggtgccggctttgattcttgatctttatcttacgactctctcaaatgtgggaggtttttcacgtgtattttctgaagagagaaaagaatcagttgtccctaaaaagagaaaatgaagaagagggactcacagatttggacttggacaggctgccgagggtctgaacggtcttggagatcaatgtcagcgtcctggacgtctgggggtcctggggaggcgggagcaagaaaggtctatgtcagcatcacagaaatgctgtgactgtcccagatcgaggggacgaaatgcaggagtcacctcagagctgctgtggcttgtgcatgagctacggagaaacaggggtagcgacgcagatgggactggagggggtgggcgtcccacagtctcaggagctgctgagaccatcccgcaggcaacatccgacggcaccgcggtgacccactctctcggcccagcgtgcagggtgcatctcaaagtcgaaagcatcaggtggggtcatggctctggggcgctgagtctcggggtgctgagtctcctggccctgcctggggctcatctcagccttcacagggtttgaaggttcaactcagaagtgctgggggccgggcttggtggctcacgcctgtaatcccagcacttcgggaggccgaggcaggtagatcacttgaggtcaggagttcgagaccagcctggccaacatggtaaaaccccatctctaataaaaatacaaaattagctgggcgtggtggcgcacgtctgtaatccaagctactagggaggctgacgcacgagaattgcttgaacccaggaggcagaggttgcagtgagctgagatggtaccactgcacgccagcctggtgacagagcaagactctgtctcaaaaaaaaagaagtgctggggaatgggcaatccctcacgtcctctcgccctggccatctccttccagctctgccacccgcacgtgcaacacggtcaccccagatccctgtaccctgagagctgcggccccagcaaccacattggggcctggagaaaatcagtgctaaataggaatctgttgactcaatacacggatgatacgccgatcatcaatactccatatgtgatgggcaggggaggagagcagggcggtgaccagcagctaaaaccctggacaaaccgtccactgcttttgtgacactgtctcgactcccccagaacgtacacagcttaaataggtcggtgaaccacctgcaacgaggacgttccaggacccagcgcatccaccagcactccccacgcaccgtccacacactccacacacactccacacgcactccccattccacacaccttccacactccccgtgcaccgtccacacactccacacacactccccattccacacgtcttccacactccccactccccatgcaccgtccacacacactccccattccaaacgcactccccactcactcattacacacactccccacgcattccacacacactcctcattccatgcacactccccatgcattccacacacactccccattccacacacactcctcattccacgcacactccccactcactcctcattccacacacactccccattccacacgccttccacactccccacacactgtccacgcactccacacactcctcattccacacacactccccattccacacacactccccactcactcattccacacacactccccattccacatgccttccacactccccacgcagtccacgcactccacacactcctcattccacaaacactccccattccacacacactccccactcactcctcattccacacacactccccattccacatgccttccacactccccacgcagtccacgcactccacacactcctcattccacaaacactccccattccacacacactccccactcactcctcattccacacacactccccactcactcctgattcctcacacactccccacgcattccacactccacacggtcggccccctacagccacgcagatgccccaacccaggccggcgtcgcaggacagctcagaaagcctcggtccctcagccggtcactcaccgtgtggtgcggcgtgagctggaagaggttgggggagagaatggcgggcgcaaagaacctcaggaagatgaagctgctcactgcagtgtacctgacgtccgggtcatctgcgggagagagaagcagggtgaccgttttcctcgggcacaatggcctcgtggggacaccatgccccggccccctgagggtccgcagggaagtccagccacagtcctggctctatctccacctgtgtctgtctctctccctctctctgtttccctctctccctctctctgtttccctctctctctccatctctctgtctctccccctttgtctctctccctgtctctctccgtatctctgtctctctctctctccctctatttgtctctctctcatctctctgtctctctccctctctttgtccctctgtctctctccctatctctgtctctctctctctctctccgtctctggctctctccccccctccatctgtctctctctctctccatctctttgtctctctccctctttgtccctctccctgtctctctccctatctctgtctctctctctctctccccctctctctctccgtccgtctgtctctggctctctctctctctctccatctctctgtctctctccctctctgtctctctccctaactccatctctctctccccgtctctttctctccgtctgtctctctctccatctctctgtctctctccctgtctctctccctatctctgtctctctctttttctctctttctctgtctctctctctccgtctctctctccctgtctctatctctctgtctctctctctctctctccgtctcgatctctctctccatctctctccgtctgtctctgtctctctccatctctctctctccgtctctatctctctctccgtctgtctctgcctctctctccgtctgtctctgcctctctctccgtctctccctgtctctctctctctctccttgtctctctctgtctctctccttctgtctctgcctctctctccatctctccctgtttctctccatctctcatcaccaccacacagcgcagcccctttggtgtctcattccacagtggtctgtgctcatctgggtgagaggatgtgttttatctcttcacttccaccttgttcaaagtgggtctggggctgggatgtgcttgggaactgcctcccccagaaccctgggcccctcggccggcgctgtctgactgtctgatgtcctgagaatcaggggtggggacagcgtttgtctcctggggacacagaagcgtggacggctctgcaggaccatggccaccccggggtgtctgcagctgtcccgaggccacaggacacgcaaggaagagaggagccggcagcaaggccctcgctgagcctctcagcgccccatacatagcctgagtcctggcggggtcttgagtatcgcaggtgatgggtgggtgcaggcacccagctcctccctgagggtcggcaaggttgagaagtggggtttgggtgctggatgcccaggtccctaggggatctccggcttgggggtttgaagaaagggcagctcccccaggggtcctgtctcttcgaagacacgggcaggcagagcccccaacaccactctgggccctgccagggtcggccacaaaaagaaaccactgggaaaacccaggggtccacatcaggaaaattcacattccaccccgacaaagcctggccacccttcccggcccccccagagaccactgtggtcgtgaactccagggctgggcccctctagagaccactgcggtggtgatctccagggctggggtcccctggagactactgtggaggtgaactccagggctggggtcccccagagaccactgcggttgtgaactagggaacactggcccgggcacaaaccccggaaaaatccagcatcggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgtgcctgcccaaggcaaagagctctgtcatttacatacagaaatgacgaaacagcacgctctgcaagaagtatcatgtgaagtgactaaaatgttggagcaagttcaacatcagggagttttgctgttttaaaacgcagtacacagctctggggacagcctggggaggcagggaggccatcctgtcctaggaaaagggaggggcaggagccattgcccaagggaaggaggagccggggcggaggcagagctggtcaggattgtccaggggaggcagagcagggtgtgcagggcagaccctccgggggggcagagctggggcatgcagaccggatcactccaggggaggaagagctggccgggaccccccaggggacgcagagcccggcacacaggccaggccaaaggtggtggctgaggcctcccagtagtgcagccagcgtactgcagccgggtgaggcgggtatccccacgcctggtcctgctcccaccccaaccggggtcacggggtgagtcagagcttccaggcagccatcggctgaaaaaccccaagcaggtgactggctttggttggttcatgaacaaaacctaccatgttgttttcaaggttttctccgtctttcaacttcacagggtcgatttcacagggtttgtggctctggcatatctggggagaggtttaagacagggctctgtgagtgggttctgggggcacaggcagggagggtggaaggggtctcaggcctggctgagatgtagaccctgagcctcatccagaaaatgccacgacagctccccgaacccggccactggcacggaggggcacggtgaggccggactgcagggccaccgtggggtggtgtcgtcccgagcctcagctgcaagggggcaaccctgggcctgtgtcactggctgcggagggacaagtgagaggtcaggcgcaaacactaggcacggggcccagtccatggccgcgatcagacgagccgggctctctcagggagcgatgtgcgcccgcgatcagacgaatcgggctttctcaggagtgatgtgcaccagcccacacggactaggcctcacagggctttaataatatttttacttcaaaatgctgccatgattttgcccacagagcaaaccagaatgctatgttcaattttctcacatttgcaaagaacctgtttacaaacccgctcataaacggggggcacagcctggcgggcatcagagggtcaggtgaggagtgggtgtgcgggcatcagagggtcgggtgaggactgggcgtgcagctcaaacatgccacgcagccagggcccaaacacaggggactgcaggacatgtggagaaagaaggtctccctgggaagagccaggcttttcttgcatgttctcctttgtggagtggtggattttcttatgtatagttttaatttgggagaatttggaaggttctggagtacacagggaacatcctcttgataaaagtgaatgaatcagcatccccgtggcgaggccagaggggccgacattcaagcccagctcgtggtctggctggatcccagtgcagtgccctctgttgggggaaatcctccccacgcctcgtgaggctgaggactctcggccccgtgctcacctcctcgatggcgggcttcagggtgacatgcaggtaatgcatccccgccagcttcatggtctcgtcgatgcacttggacgccagtgagtttcctcggaagatggtgttggggtccctgggaaatggcgatggggacagcgtttgtctcctggggacgcggaagtgcagacggagcagagcctggccccgagcacctgcctgtgggctgtgaggtcagtgcacgcccatcagtcggcttcctgacattttacaaggagcacaaccaggccaggtgcttggaggccctggccatggaaccgtcctgtgtcaacactgccagagggaaccgttcggctacctgcgtggccaccagctcaggaggagcctggctggccttcgccctcccgccctctcccctctgcggcctctgcctgtgcagagagttgggcaccagaccctggcagcatccaagggccagcagagaagcaaaccctcctgtcagctacagtggctgcaggtgcagccagatgtttctagaacagggcgtccggaaacagcactaggcaggtcctgagggaagctgtgctccatttttgtgggctcccaaagtgccccagggaggggacctgagctgtcctcgagccccaggagccgtttcccctccccactcactcactctacccgggatttcaaaggcaaatgggactttcaaaaaaaaaaaaaagaatcattaactgggtctgtgaaagaaaacctgaatcaacatggtttctggggacccttgaattccctcaagccctgccccaggacacgtggttctcggcgacgaccttgccatccctgtagcgggtccaggccgctctcccccggggcagggtgggcactcactgggtccgcttcacctccgcgctggcgatggcactgatgaatggcaccaccctgccatagtgtaggaagagccgcaccagcgggacggccgcctcctgcttctcccggcaaacctcgcccaggatgtgggccgcagacgctgacacgggctgcggggaggggtgaggtcagtgccagggcccggggtgcaggaaccccagaggcctgtccccaccttggctggggtctcacttccagccacaatagatacggctctttgctgagacagaaacacacacattcacaaaaacaccaaacttcccatttgctgctgcttggctggacccttggaggggcatctgcacctccttctagcgacccccccatgcagccagctctagggcccctgagccggtagagggactctgatgatggggtccccctcgaacaacccggagagtccttagcatcaccaggctcccacggctctaactgtcgacggaccagtgcccccagcaaaggggtccaggcatctggacgggaaacaggccaggctgggaggcgtgggaaaggccccctcagggagaaggtgccctctggggtgggcccgggtgtagggtggggccccaggcaggtggcacctcctgcccacacccacaggccacggcgtggacaagcacctccacatccgcagacttcaacagcaggtcccgcagagggctgtaatagtcagaagaaaacacgtggtcttccgtgtataccacgttcagccgcagggagcccaggtcgtctggctttaggctcttgctaccattgtcccggggctggaggaagtacctgggtgggagggacacatggaggggaggcatgaggctgcatctgccaaggagcagctctcagggaagcccagctgcctgcttgaggtcgactggtcaggagggtgatcctgtaggacccctcagagtgcagcccctggggactccccaccgaagacccccagcagggctggtcaccggggatccccaggaggcaagtgttggagccaaaggcgcaggagtcaaggggggaaacgcggagggggatgggggtggaacgtggcaggaacgggtttccgggaaccggcacagaagtggtcagtgacccgccctaagacccacacccagcagtgtcagcagcaggtggaaatgaaaattatctcaaccaaagtgtgccgtggctcccgatgtcacggggtgggggccttgggctagtgagcctggcaggccacctgggcacctggtcattgtaagagacgttttctgcccggacattcttccatctttggttctaccccacgcagtcacccaggagccctcttctgctctcatttgtgggccaggcagtctaagctctcaggtgggtggagcctgtgtccgaggccccgcccccatcaggtgggtggagcctgtatccaaggcattagcccccgtcaggtgggtggagcctgtctgcagcattagcagcccggtcaggttggtggagcccgtgtccgagacattagcacccctgtcaggtaggtggagcctgtgtccgaggcattagatcccccctcagatggatagagcctgtgcctgaggcattagcccccgccaggtgggtggagcctgtgtctgagacattggcgcccccgtcaggtgggtggagcctgtgtccgaggcattagcccccctcaggtgggtggagcctgtgtccgaggcattagcagccctgtcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcccccgccaggtgggtggagcctgtgtccgaggcattagcagccctgtcaggtgggtggagcctgtgtccgaggcattagcccccctcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcagccctgtcaggtgggtggagcctgtgtccgaggcattagcaaccccggtcaggtgggtggagcctgtgtctgaggcattagccgccccccatcgccccaggtaggtagagcctgtgtgcgaggcattagcaccctggggctctctggggtatgtggtggctgccttggctaccagggccagggattcattcagcataggaggaagcctaactcagctcagggggcctgtgcccgtgccgtcttcgtagaatcaaaagacacgcgtgtttcacggtttctgggatggaaacctgccctcacacatggcagagggacacatggggtgcgaggccccggcacacagtccacgcctgggagtgcacgcttcccgtgactccgggccctctcaggagctgcctgtcgctaagggacacacatgaactggagataaaatgaaacaatggcctgttccttccaccaaaacaccaagcacctggagacaacaggaaagaaaggcaggaggcagcaacacacaacatgtcctggggtgggttctgggtcagagccgaccactgaggtctagacgtgcagaggggagtagagaaccctgtaatgcgccctcaacaggaggtgctgccgagggcccagaacaagacccggagcgcagccgcggcgcagccctgctgtgtgcgcattctgggctcctgcaccggctgctgatgccctcccctactggtgtcagacctcacgagctgctcgcggctcagggccccgctttcacccaggatcagaccccacgagctgctcacagctcagggtcccactttcgcccaggatcagaccctgcgagctgctcgcggctcagggtcccactttcacccaggatcagaccccgtgagctgctcgtggcttagggccgctttcacccacgttccctgtcttgttttgaggtgccagccattgtgagtccctgctcagtgtgatccctgctgcctctcctcacctgccatttctcacctgctgtggggcagaaactcatcaagccagagctcgtcagagctacatgcaaagtaagagcaggtgggtgctgggcacagccgaggaccagcacatgtggcctctgtgcctttccactcagaggcagcacgtgtttttgtggctctcagagatgcggaagtctgcaggtgcaacatcatcttaccacgcctcgtaggagctggactgccgcaggactttcaacgggatccttagttctcccaggaattcatctccaaacttcaggttactggcattccagaggtcaactctgaaaaacagcatcaggacagctctagctgacggcgggcagcccgtgtggagcaaagatgacaggccacgctttgttcccccaggagcagaatggagcctgcagcgcctcccagagtctccatcaaggctcagcccacagggcacgtttcaaacacgtcagaccagcctgtggctttggaataaagatgagtgtctcccagtggtaatgggcaggcagaggaaggcggaaggccatgggcccggactcagacccaggctcttagataggagggagcctgggcatcgctgcgtgcacccagaagctacatgaccccaggctcttacataggagggagcctgggcgtcgctgcgtgcacccaggagctacatgaccccaggctctgtgccaggagggagccaggcgtcgctctgtgccaggagggagccaggagttgctgtgtgcacccaggagctatgtggctgctgccactctcagctccagcaccatctgtcccctttgcccacaacaggcccagcaccagcagtctgtgcacggcgggcaaatgtagaaccctgtctccatggattgctcatgatctaggggcacaaagtggattcaggggccatgcacaccacagcggggggagaactgtggccacaaaccacagcacggtccacgaatctccgtgactaccgcaggcccagcattgtgaagcttctgctcatgtctaacacagcagcggctcccactaatgttctgtcctagtgtgggatggtacgtgtcccctcagacctggggctgtgaaattctgacagacatacagcatccccggctgcaacaagtctacagggctggtaacccagtccctcatggccaggacccactcataggcctgaaacacctgaagtcatgcgtggccagccctacccacgggcctgaaaccacacagttacacgtggccagccctacccagggggctaaaactcggcaggcctaaccacactgtgggcatcaggggcatccccctggagggagaagattccagaaggctggggattttgttacccttgcgaatcctgcagggaagtggcaccacagaggcactggcatctgggccggggagggctgacaggctgcacaggaacccacagcgcgttcctttcagaaggaacatgaggggaccgctgatctgcccatggacactttaaaaaaatgtgctgagtggccaggcaggcgcatttgcctttaataagggaaatatttaaaacatgttttgtgtgcttttaaaaaatttaataactaggacttcactcctgaattcaaaacttggtgtaaaaagaaaccaacaatggcgcttccttctcttgaaaaaggggctggtgtgagtccctggggaggcagatctgaccgaccacgtcagggacattctatggttcaggaccctgacccctcaggaggtggatctgactgaccacgtcagggacattctatggttcaggatggagacaactatgggggacggatctgaccgataacatcagggacattcctacagttctcaaccacaaaaccacgcctcccagcagccgtagggcctgagccacgcaccggctccacgtgtcccattaagggtccccccagggcagtgttagcccctgggagggagggtgaccagggatttgatggccagcacattctccaaaatgacctaaagaaagcaggtgcatcccaggctcagggacatcccaggctcggggacatcccaggctcggggaacatcccaggctcggggaacatcccaggcttgggggcatcccaggctcagggaacatcccaggctcgggggcatcccaggctcgggggcatcctaggctcggggtctcagggccggctggggagggtcaggagggagccgtttccttccttctctgtccagcatgggaagattcgggggcttcaggggaggctcatctgcctcttcatagggaatggaggcattcgttggtacagaaggaacagaggctacgttcaaaaataaacaggaatccagcttattttcactgggaggagggaacccgccggggtttgtgaagggcacattctgacgcctgccctccccagaactctgagtcagcgggatcgtggggctctctaaatcctgggcctgagatcgcgtcctgacctgcgtgaacccacaagcgatttccccgtttcccgtgggaggcgttgaggagccaggaaagggcggtgggggctccatgggcaaaggctgaagatgcagcttctatgaccatacacaggaaacatgaacccaggacgccaggtgagagtgtttcactcgagtcaaaggggacagggtctccacagaggccacccagccgagagtttcagcagtgccagtgggtcctgctcggtcagggccaggcgtcgtgctgacccgccaggccctgcgacctctgagtgaggcctgaacccatggaaggcggagggcttagaacaagaccttaagaacggctgcagcccccgtcactccaggtggatgaagccttacggccagagggatgcggacctctggctttcgcctcttcgcaggtattgcaaggtgagccctaacaccacccacaggctgtcacttcaactacaacttctaacatcctgttgtgaaaattaccaagaaaatggaaattcatttctatctatgaccctatatttagtaacaaagaacaaaagagctgaggagtttgggtgaaaactgccaagttggggacgcggagcctggttttctcacctgatttcgagcttgtccacgtcttcctcctcaaagtcaaagtgggacttcttgctgtagctacagggccgggtcacctggagtcagacgagagagaaagcgctgagaccgcggtgccaccaggcgggggtatatgcggacctaggccccgggctgccctaccctctgcgcttacccacacaccactcaagggccacaaccaggaaggcgccaggcgggattcgggattcaggcctggcttcctgagtgccagcatttcctactcacggcgcccctggaggggcagacccaggtgagacctgccccaaggctgttcacggccacggccggactctcccagtggctcctgatgggtgccgggctctgggtacctaaatgtccgtcacctgcgcctgctctgggcctgccaccccgtgagggagggagggtcccctctgccgtggagacgaagccagcgccgccctcccgtggccccacctcaaggctctatttgccaacaggaagtgaaacgcgtgaggtctgtggagcctgaacctggccggccccgaacaggccccagcactccagggagggtcagacggtggaaagtcaagacgctgctaccttcctcctgacacctccgcaccgtgggttccttagaacagaaacggagtgaaggcgtgaagggtcgaggctccgggaccgccccccgccagccagcagggcccttgcagcagagcaggaggccgacccacaggctccaggagacagtggttatcacctggagttccgatttaaccaccatcagccgtgcaccaggtcacctgcgtttacaagaagggctccgtcctgcccggcctccctccctgcccccccttctccgggcctcagcagtgatgctggctcaggagctctcagctcgaagttctgatgtaaggcttgacaccaaaatcatgttgctaaaactgcctaacctctgagcttgcacttcctgattggtaaactgaggtgaagatcacgcaggggcagttctctgcttcgggttgagggctgctgacgcctcctccttcctgacctacacaccactgtccaaaaatttgcttccccccaacttccccatctcacaaaactcaggtcaggcaatgcctcctccaggaagcccccagtgcccctgcctcatgccctctctgcagggcaggtcaggcaatgcctcctccaggaagcccccagtgcccctgcctcacgccctctctgcagggcaggtcgggagctattgtaggggcttgtctgtttgcatccctcccatgctggcctggtgtggtggccttggactcctctgttttctgccacatcttatcaccagctgatcaccagcacggtgctggcacctgacacgtgttgagtgaatgaaggcagctcctaccaaatttatgagattatttaatctcatttagagagttaaagggtcttaatgtgtctagttgttatcctggaagaaaatggtacagacgctgcttcccatagaaacggaacatctgttttcctgggtctgctcccagtaggtggctgtctgaccacagcccgcgggggatgtgctccctccccggggctcagcctccagctgggtcagaagcagctgaagccgaaagagacagagtcctggtgaaagaggtctgctaaggaaggggaggagacggagtgaaaggtcacagagcccaaagagcagggccccgcgcgtcccacacagcagcggtcagcgaggtccgggccttccctggagccccacaggtggtgacgcagaccatggttttcagactgtctgtggtcactaaattgctcctgtaggctgagacccacgtctttacagagtgaaacaggagtgcacacagtagaaacagcatgagaacactgcaagcgtgatgagcacccgtgtgtggccgggcagtgggcgagctctaccccactgtgtgtatgacagctctgtgtgtggcagccaagccagcagccgaggcggggggagctgccacctggaactcggtccatgctgcatgcctcctgcacctccaacagggcccaccctccccctgggagcctggcagctccctgccttccctcgctctggcaaaaccatcttctccgcctgtctataagtgaggcttccgtttgagacagagaacagattccacctctaaagccctcctcacagtggccctgaaagcctggccctggctttggacaccaagttcccacctctgcctgtggggccctttcgagcctcagcagtgccagtgggtcctactcagtcaggacccactgaccggtaggtccactctcctacggtcccctgagagctgcatgcatcgagccccactcagccatcatggctcaggggagcccgcccgacccctcagatgtgactggccatgctcttgccacagaggcctcatccatcctcacatctccagggcctgtgcaccggaatgtttgtggatgggaagaacatctgcctaaaggccctgcacacagctgtccccaaaccgcaccggccacatggcaggtcctcactccacgagatgcagccatcccaaacggggtcacattccaccaggtgcacccttgcaccctccttttcatggattttggtgcttcatgttctgagaggatctctgtgtctgaatcctttcccctttgtttcaaaaccctgcctatttccactggaacaagccttccgcctctcagggatgcttgggcagagcagccaaaaaaacaaaaacccccaaggtcctggtaatttggaaagcattaatctgtcatcttttaactcaaatctgggccagttcgggagacaacgaatgacctttctctcttgggagaggagggaaggtcctgtggccacgggtccaatccccagggctggctggctgggctcgctcctctccggaaggaacccagggccggccggcggggctcgctcctctccggaaggaacccagggccggctggcggggctcgctcctctccggaaggaacttccagagggaagagactgagatcattctggatccagactttctgccaacgtgtctcgggtgcagagtttccacttaacgttgacccatgaagataccaacctcaaaataaaacacttcatcgaactggggattgttggtcttcctcttcactttcgtcttctttgcttctgatctgttatcaagtgagaaaggattgggattaaaacaacactgctgattccaagtctctcagtggtaaaaccgagctctcaaatgcacaagtcacttattggctttatttattttataaatatttctgctggtctccaactccagatggtatgcaaatcaggaacctttactcagccaaaaatacccagcgtgaagagcatgaaggcttcattttctacaaagcaattttggagcaataaagaaaacaaaaggaagtaaaaattcacattctacctcaaagcgcaacctcctgactcctcccaaatgaggcagtggtctcgtgatttcagagctggaccctagccccccaggaccagaacagaaacctgaagcgtgaggcaacttgcctgaagggtcctgccagcgtcacggtggcgtaggggtcacattgcccattcacgatggggaggccctggcactcgacgatgctgaggagagaagcagaggcggcgtcaggagggagcgcagacacctgggcgaatggcgagacagctctgggtcaggcaggaggcctgagttcaagctgtgagatgaggtttcctcaccggaaggcagggagggccacaccagccattctgcctcggtgtgacgctgaatcacgctggccattcacaaaagcccaaaacaacacctctaaggtgagcatgtgctttagcgtggacgccagcagtgtgtgacagcacatctaaagcagcgtcatcgggggggcggggggcaggacccctaaaacagtgtcatcctgggggccaggacccctaaaacagcatcatctgggagccaggacccctaaaacagtgtcatctgggagccaggatctctaaaacagcgtcatcctgggggccaggacccctaaaacagtgtcatcctgggggccagggcccctaaaacagcatcatctgggagctaagacctctaaaacagcatcatcctgggggccaggacccctaaaacagcgtcatctgggagccaggacccctaaaacagtgtcatctgggagccaggacctctaaaacagcgtcatcctgggggcccagaacctctaaaacagcgtcatcctggaagggggccagaacttctaaaacagcatcatcctggggcaacctctaaaacggcatcatcctgggggccaggacctctaaaacagcatcatcctggggccaggacctctaaaacagtgtcatcctggggccaggacctctaaaacggcatcatcctggggccaggacctctaaaacggcatcatcctggggccaggacctctaaaacagtgtcatcctggggccaggacctctaaaacggcgtcatcctggggccaggacctctaaaacggcatcatcctgggggccaggacctctaaaacggcatcatcctggggccaggacctctaaaacagtgtcatcctggggccaggacctctaaaacggcatcatcctggggccaggacctctaaaacggcatcatcctggggccaggacctctaaaacggcatcatcctggggccaggacctctaaaacggcatcatcctggaggccaggacctctaaaacggcatcatcctggggccaggacctctaaaacggcatcatcctgggggccaggacctctaaaacggcatcatcctggggccaggacctctaaaacgacgtcatcctgggggccaggacctctaaaacagcttcatcctggtgggccaggacctctaaaacggcgtcatcctgggggccaggacctctaaaacggcatcatcctggggccaggacctctaaaacggcatcatcctggggccaggacctctaaaacggcatcatcctgggggccaggacctctaaaacggcatcatcctggggccaggacctctaaaacggcatcatcctggggccaggacctctaaaacgacgtcatcctgggggccaggacctctaaaacggcatcatcctgggggccaggacctctaaaacggcgtcatcctgggggccaggacctctaaaacggcgtcatcctgggggccaggacctctaaaacggcgtcatcctgggggccaggacctctaaaacagcatcatcctggtgggccaggacctctaaaacggcgtcatcctgggggccaggacctctaaaatggcgtcatcctggtgggccaggacccctaaaacagcatcatcctggtgggccaggacctctaaacagtgtcatcctgggcagccaccggctctggaaattcttgtgcgttggtgtgaaaacccctgtgtgctcctcgggagccagacatgccactcgctgtgcgctcggtctctagtgaggacgtgtcttaccgtgtggcgagcttgtggcagacgaccccagtgtctgtgatgacctcgctcagccgcagctccaggtgcactttgccctgcaaggcacaaggatggggtgtcagaggctgtggcgctgctcccacaggccactagggccgcgcgcccagggaaagcctagagggcaaagggagcaggcggccccgccctgccctggccaatgggcacgtccagcccctccactccacccccgggacgcagggtcccagctgtggcctttctccaggagagctgcttgcctgactgctcagccccatgtggctgcccaggctcctggctctgctgagagcaggtcgctgcctcagaagtgaggggtccaaccgtgtaggagacggtcattcagtgaagcagacccccaaaggctctgatgctgcaggctgctcgtgtgtccgtcgggacaaaccagaggggaagcacagctgtctcccaagcaggggccactgcctttacctcccctcgggcgaggccggatggaggcccgcaggaacctcggagagctcacacagagggcaaggctcacacagagggcaagactcacacaggaggcaagactcacgcagagagcaagactcacacagagggcaaggctcacacagagggcaaggctcacacagagggcaaggctcacacagagggcaagactcacacagagggcaagactcacacagagagcaagactcacacagagggcaagactcacacagacagcaaggctcacgggggcttctagcagagcagacagcaaggctgccctgcgggtccacctgtctctctagatcagtctgtctgtgtgtgctgctgtgtccatccacctgtctgtctgtgtgcacggctgtgggtgtgtgtccacctgtctgtgcgtacaactgtgtgtctgcctgtgtgcgtgcggtttgtgtgtgcagctgtgtatgtgagcatgctgctgtgtgtgcatgtccacctgtatgtgtgtccgcctgtgtctgtgcatctggctgtgtgtgtgcagctgtgtgtcctcctgtgtgtgcggctgtgtgtctacctgtgtgcgtgcaactgtgtgtgtctatgtgtgtctgcctatgcatgcatgcgactatgtgtgtccatctgtgctgctgtgtgcgtgtctgcctgtgtagctgtgtgtccgcctgtgtgtgcggctgtgtgtctgcctgtgtgcgtgcaactgtgtgtccatctgtgtgtggctgtgtccacctgtgtgcatgcgactgtgtgtctacctgtgtgtgcatgtgattgtgtgtatctgcttgtatgtgtccacctgtgtgcatgttcgcctgtgtgtgcatgcagctgtgtgtgtctgcctgtctgtgcatgtggctatgtgtctgtgtgggcgtgcgattgtgtgtgcgtgtccgtctgtgtgcacacggctgtgtgtctgcctgtgtttgcatgaaactgtgtgtgtctgcctgtcggtgtctgcctgtctgtatgtgcatctgcctgtctgtgtgtttggctgtgtgtgtccttctgtgtgtgtgtgcgactatgtgtgcatgtctgtctgtgtgcaagcagctgtgtgtgcatctgcctgtatgtgcatgcaactctgtgtgtgtctacctgtctgtagtgtgtggctgtgtgcatgtccttctgtgtgtgtgcgcgactgtgtctgcctgtctgtgcgcgtggctgtgtgtccacctgtgtatgtgtgtttgtccgcctgtctgtacatgcgactgtgtgtgcatgtctgcctgtgtgtgcaccgcctgtgtgtatgtgtgactgtgtccacctgtgtgtgtgtgcggctatgtgtgcctacctgtgtgtgccgctgtccctgtatttgctccagcctgaatggcaatgaatggatgggataaacacagactcatccatgcttcaggggctctgcctggcccggcccttagctctagctcctgaggctccgggaaggccaaggcgtgttccccagggcttgtccctgcctgtgggagggtgggacagacgggcagaatgcctggcgctaagacgtggacggcagaaccgacagcagccctgcagcacgtggcctggtgcagaacctcggatggagcagggacctcgcttaggccccacccacctaaatgattaaaaaaccttcgagttccttcaaaaatatatcagacacctagccagccttgagtggtaaatcacctaacaagcaaaataaataataaaataatagccaaaaaattagtcaggagatatttattccctatacaagttaaaaatagcatcttaacatatgtccctaaattgtttttcaaaaaccgagaccctcaccaaacagatctaccaacacagaccacaaatgcaggggggatcacaggcccgaaccctgaacccggctctattctgaatttcttcctcaggggccaggaggggtcatgcctgtgggccagagccaacattcttttctgctgatctcaattgtttggacaaagcttctcctccttaaccaatcacaaatcaaaaacgctctatatccgacccatgggccacacgtcgtgatgtctgccttctcaggtcaaactgacatacggcctccatgtactgatttatgactttgccacaacctcagcctccccaccttctgaaacccttgcctgtgaaccctcggggtgcctgggtcgtgggcgcagcctgccctgccagggtgcacaccccgaagcccctggtcagggagtggaacataaagcccttcagccctcacttgacaccgcgtcggtgcagccccacggcacccccacacttgatactatgccccacggcacccccacacttggcaccacgttccacggcacccccacactgacaacacgtcccacggcacccctacacttgacaccacgttccatggcacccccacactgacaccacgccccacggcacccccacactgacaccacgccccacggcacccccacactgacaccacgccccacggcacccccacacttgataccacgttccacggcacccccacactgacaccacaccccacagcacccccacacttgataccatgccccacagcacccccacacttgacaccacgttccacggcacccccacactgacaccacaccccaaagcacccccacacttgataccatgttccacggcacccccacacttgataccacgttccacggcacccccacactgacaccacaccccacagcacccccacacttgataccatgccccacagcacccccacacttgacaccacgttccacggaacccccgcactgacaccacaccccacggcacccccacactgacaccacgccccacggcacccccacactgacaccacgccccacagcacccccacacttgacaccacgttccacggcacccccacacttgacaccacgttccatggcacccccacactgacaacacgccccacggcacccccacacttgataccacgttccacggcacccccacactgacaccacaccccacagcacccctacacttgacaccacgttccatggcacccccacacttcataccatgttccacggcacccccacactgacaccacgccccacggcacccccacactgacaccacgccccacggcacccccacactgacaccacgccccacggcacccccacactgacaccacgccccacggcacccccgcactgacaccacgttccacggcaccccacacttcataccacgttccacggcacccccacacttgacaccacgccccacggaacccccacacttgacaccacgttccacggcacccccacactgacaccacgccccacggcacccccacacttgacccagcgctcacagggggaatggaactgggtctgtgctgcccaggcaggtgtgggaggtggggcctccgctgctgtcctgagactctggggtctggaggttgggtgtggccttcccgccctgtggctgcagccccagagcaggtcctgaggggccacaaggatgttgggccgggaaggtgggcatgaaccccacgccagcactgtgggcggggaaaacaggtgcctaaaatgacaacaaagaccccaccaagaccacagctcctcttcccacacccatcagagctcagggctgagcggagtatcgcctgtggtcctcaccgcctggcagcgggcctgctatccgtggctatccatgggctaaaggagtgccctgaacaccagccgggcagtgggcctgctatccgtggctatccacgggctaaaggagtgccctgaacaccagccgggcactgggcctgctatccgtggctatccacgggctaaaggagtggcctgaccaccaaagacaggagaaagtgcctgacccaagaataaccaagaatccccactgcttcatccccgttctcaaatgccgggcgcaaactctctcaggacagaagcgttcagatttgcaaggctgtgcagacggaggtagctctattcacattcgggagcttcaggaagagtcacgactgcatgtggggggtcctggtccccagcagcaggctgtgtggcccccgtgtgctctcccggcccctggcagcaggctgtgcggcccccgtgtgctctcccggctcctggccgggtccaggggcacctggctggtcaccatcaggtcctgaggctgctcctgttcctgcagcatgaatccctcctgaccagctgacttgtgtgctttcgtcttctgctgattcaggagtgggaacaaacaaaacccacccctggaaggccctttctcctgccagaaaagccaatgagtaaatctgcaggtgctggcgcaggctggagaatcccagacatttagaggttaaacaacacagttctaaataacacacagatcagagaacgcaagacaaattttaaaatgttccggaataaacagaaatgaaagtgttactcatcaaaatcagtgggatgaagcgggagccgtgctcggggtggaggggaatctggagtgccggccacacagactagagcagaagggagatctgaacgctgacctgagcttagagcagaagggagatctgaacgctgacctgagcttagagcagaagggagatctgaacgctgacctgagcttagagcagaagggagagctgaacgctgacctgagcttagagcagaagggagatctgaacgctgacctgagcttagagcagaagggagatctgaacgctgacctgagcttagagctgggagactgagaaaaatgagtaaactaaacccagagcccaagaacagaaaacagaagtcagatcggaaaccaataggtaaaaatcaaagccaacggcaaattccttgagagatcaataaaattaataaacctcaaaccaggctactaagagcaaaagggaaaaggcacaaattcccacaggaaaggaacgagaggacctggctgccgaccctggcacctgcctggacgctgcactgaggtccctggcgctgcactcctgcgaactcacagacgcagcaaaggggccccagcgtccagctcctgacaacgtgtggctgcagtgtcacccatggggccctgggcgggggctgctgaggggtgtatggaaactctgtactctgctcaatttccctgtgaacacagaactgcccccaaaacagagttaattaatttttaaaaagcagccaatggtccctatccatctttctcaggaaggccttccccagggagagagcagcgcgcagagccgggtcagggtcctggccccacccaccggttgccgtgtcccccactgagcgggcagcggcccagagagcagccaggacagaggtgccttggatgcaggactgttccacgccggccgcagagaggagacgaagtccgcgggcagatgagacaggatgcagaggccatgaggaaggaagcccagcctcggccgtctcctcttacaaccctggagagatgtgaaagcttgacgacggacggtgactttgtttgctccgaaaatccttccaagaggactgtctgctgcacaaacacaaaattcccagaggctgtagcaggaggctggaatttccagcccagtgagatttcacggtgcaactggaaggctccaagggggaaacacgtaggtgtctcttgggcggatggcagacccaggggtttgctgtgatcccctgcagggctgtgctattttctgaatacgtcacagatgcacttgaaagcctggtttataaacggagctcagtgacccccaggcgcccagatcaccgcggatgcctcgctgtcacaggcggtgccctcgctggcatctgacgctggcatctcccccactggcatctgacgctggcgtctcccccgctggccctgcatcaggggagggtcagagagcacaactctgcataataaagtgatttaacaaagactttccaacagtggccgttccagaaggaagcaagaaaggtttaattgtgtttcccccatttctgtgactcacttgctggcctcccccatgggctgcttctgtgacactcgctgtccggacacaggactgttcctgggaatcacagagcggagggactcatggagccacatggctaccccctgccttcctgaaaatggtcactgtgacatcttatgatgaaacggcggctcctgagactggagttgtggggttttttttcttcttcttcttctttttttgagatggagtttcactcttgttgcccaggctggagtgcaatggcgcgatctcagctcacagcaacctccgcctcccgggttcaagcgattctcctgcctcaacctccggagtagctgggattacaggcatgcgccaccacgcccggctaattttgtattttcagtagagacggggtttcaccatgttggtcaggctggtctcaaacacctgacctcaggtgatccacccgcctcggcctcccaaagtgctggaattacaagcatgagccaccgcgcccagcctggagttgaggttttaaaggttggctggagtccagcagggccactgctccctgtcacgctacgttttgggcggcgttggggctgactgcatcagtgaagcaacgcattggagagcagcgggcattggagagcaatgaccttgcctcctcccttttagacaacagctcgcatttgccttccataaagtgcaaattcccgggagactgacaccactcggttcaggatcctcatgttccggacagtgagagtcaggcttggaggacgctgggcttggccacgggtacgcagcctcgggcgttaattatgagattccaccagctgtgagatcaacctgcggcattcttatttacagctttgtggagatgcaacgtctgagtcctgatcgtcatggtggttacactatctaccctgtgatgaagttgcaccgactgtcacaacagcccatcggcaggtgactggagcaacagcacacgcttcgcacctcggaccattcctcagccttggaaggaaggaggttctgataccacaagcgacccggaggatgtcacgcagagcgacattagcctcagaaagaccagcagggtagagctcactcccatgagccacggggagtggcctgcgtcagagacagagtgccatggggctgccggtggggaaggggcggacgggagcgtgtgaataaaactctagccaggggacagaggggacggaggttccgttttgcaagatgaaaggagctctagagatgggtggtggtgacggttatacaatattatgaatatattcaatgctataccactgaattggacattttaaatggttaaaatggtaaatttcatgtctctgttttaccacataaaaaactggaaaaaatagcatagaatacacagagagacacacacagaaacacgtgcctgtgaactggtgaaatctggataacatccgtggactgcacaaacgtcggcgtcctggttgacgttgcaccagctgcgcatggcagtgcctggggaagccgggagaagggagcacagccttctgtttggggaagccaggagaagggagcacggccgtccgttcgggggagccgggagaagggagcacggccttccgttcgggggagccgggagaagggagcacggccttccgttttcagggaaaggtgggaattcgcccctcgccactcctgtgtactgttttgatgccttcctatagatctataaccatttcaaaattaaatcagtaaaaaaaaaaaaaaggcaagaaagaggaaaagctacacctgccaataaaaccaaacttgaatccgaggcaaacgacgaggccgcactctgccagctgctcagaggccgttgtgacggagaccccagcgacggcgggtatcccagaatagaagagctggggaactcgccgacacgcaggcgggagcggcccagtcaccaagccccgtctcccgggcagcacgtgggaaaccccgcctttctgccgggacgccaaggtccgtgggagcagcacgctggggcccttgtgctccggggatgcgaggacagtcattagttctgcagtaatcacagcgtccttcactttccacagcacgtgtgggttccccagccagtgctttcccaggaagcagagttaattaagtgtgacgcacaattagcacaggtcccttggggcagggccatccccagggcttcttggctccactccttaatttccgtcaagggcctcaccccacccccacagctgggctcatggtcaacttcatgaatgaaccctttgctggccatgggcgtgtgcacagctcatgaccttggcaaatggcaaccttgacccagtgaagcgcagaggatgagggttgccagggcaagacggttcccagaggacgagggttcccagaggacgagggttcccgagggatgagggttccaggaggatgagggttgccgggggacaagggttcccagaggacaccaggccatccagtcccccagcccaaatttgccctgaacttgcgggcacagagcctccatccgacccacccagttgcctctgctgaagtctcaggcgaagtcctcacaaggaacctattttggggatttgtccaggatgccagcctccaggtgtaaaaataaccatcacagccaccaatttacgatgcgccaggtgccttcgagtggcacacacgccataccagcacgcttcacaaacccacccagatgggaaaactgaggcctgcaaaggacgttggcaacaatccgatgagggagctggctccgagcctggcggcctgtgctgggactctgcactcagacacacactgtggtaccagctgaggacccaggaagccctcccacatcccagggccgctgtgctgcaaccccatactcagacactcaccctcctacgtcccagggccgctgtgcagcaacactacactcagacactcactgcggtcccagctgaggacccaggaagccctcctgtgtcccagggacgctgtgcagcaaccctacactcagacactcactgcggtcccaactgaggacccaggaagccctcccgcgtcccaagggcgctgtgccacaaccctacactcagacgctcactgcggtcccagctgaggacccaggaagccgtccggtgtcccagggaccctgtgccgcaaccctacactcagacacttactgtggtcccagctgaggacccacttgggaaaccctcccacgtcccagggttgggccacggtgcctcttgcttgtggcctttgcagctgctctgtgtcacagaccagggctcagggtgaccccacaggagctggtgcaggcttgggctccggtggactgacccccactgctccctctgttacaggcaagcctggagcagctgttgccgggcagctgggcaccgtgcgtccgtgagcagctgtgaacacaagggtctgggacatgggccccagcactggagcccccggtcttgcgtggggaggtgggacaagctccccccactggacaggaccggggtgagccccagtcagcacacagtcccggcaagccagggtgagcccctggccactttcgacaatggacacgggagaccagaacgctctttcagctcagacccttcttggtgccgcgtgccaggcaacagcccgcccagccaaccgtggggaagtgagggtccctgagggctgaccctggctcggcccttccccacccatgttttctcttgggcctcaatgacgcgtgcctgtcctttcccaccgtgtttgttttcacagcttcctcagttgtgcatgacaaagggcggcagtaggcaaagggaaaacccaaaatccatgcacggagcccaggctcactccgagcacaagtgggcgaacagacacaatgcaaaatccatgacagagcctgcgctcactccgaccacaagcgggtgaacacgcccaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcggagcccgcgctcactccgagcacaagcgggcgaacacgcacaacccaaaatccatggcggagcccgcgctcactccgagcacaagcgggcgaacacgcacaacccaaaatccatggcagagcctgcgctcactccgagcacaagcaggcaaacacgcacaacccaaaatccacacgcggagcccgcgctcactccgagcacaagcgggcgaacatgcacaacccaaaatccatggcagagcctgcgctcactccgagcacaagcaggcgaacacgcacaacccaaaatccatggcggagcccgcgctcactccgagcacaagtgggcgaacacgcaatctgctcatcgttattcccagtcaaggccgaagcccgatctacgtctttagccacagtcggagccgggcccgtctcgaagccccatggtgtcccagggctctggtttccggggctgcgccgagagtctcacctgcacttccgagtcagcgtccacgtgctgcagctggaaccaggtgtccctgttgtggtacttctgcaagtcctccttctggatggccaccttccctgcaacacaagcagagaagacttcaccacgggcacaggccccagagccaggacgcctgtgagcagaagccagcccatcatcaccgcagcttatttccaacagtttaattcagaatggggcaccggccgggtgcggggctcatgcctggaacccccacgcttgggaggcccaggggggagggtcgcttgagaccagcctgagcgatatggtgaaaacttgtctctacaaaaaataaaggaatgagccgggcatggtggcactgtatctctaaaaattgatattaaaaagtcaaaataatcaggtgcagcggtaagtctccactgtgtcccttccagtaaggcgttccagaggcttcgctgtgaaggcgcgaacgtccgctccatcggcaatgtgcgcctcactttcactgtggtccgtggccagttctcacagcaggaggtgcctcggagctggctgcaccagagctctgatctcacaaatgaacaccccgtgcctcacacaccaccaaggcagcagcatcacgccacaagagacacgtgtgcacccgtgcgagcgacagcctgaaacacacgtgtgcctagggtgctttccgtgtgtgtggacacgcacgtgtgtgcatgcatgtgggtgctcaggttattcacaggcaggactgagagccagaatgagctgccaccttcccacgcgacgtgggttggtctgaatctgtgcctctaaagtgtaatgaatgagccgccttctgggacccctggagagcctgaaagtgtagattcctggccttctccagacggaggagaacagaggctctggtgtgggctggaatctgcaccaccacaggtccctgggcacttgtgtgggccccaaagtctgggaacgtccactctaaacagtttcccgtgccttaaacaggcttagtactttggggctacgcttccagtgaaaatacgtatcagaatatatttgtacaatatacgtttacctagtatggatttatatgtgtaaattcgcatctgcaaccattattatctgcttatacgttcacctcattccagaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctagggagtcgcacacacatgtgaagtctgagcccatcacagagcacacacgagagcaggagtgaggaaggaaatgttggcagactcctcacgtcttcgttctgcacccagagacacacacgccctccttaaggatcttggtccagtcactgaagtgagaaactctgggtccccgcagacccggttcaccgcagcgtccgcagccacagggtctgagcacattgtgcatgacctgggctcccgggagcggcctgggcctcctacccggccaccctgcctcacgccaggacagcgcagcccagccccggttctctcttccaaggaagatccttttatatttccgtgtctcaaaaaacttccgcaggctcccatcggaacaaccctggcctggcatccagcagccacatgcttgggcctgattctctgtccagcctcagtaaattcgggaacactccactgccagcctctcacaggtgccatctcagtcggtcctgcggtgaccctggaggagcaggtaccactctgcacaccccacagacgagcaggccggggctgcagggagagggagcttccgtccctgccttcctgccagcgttccttcctatgttggcgtccccaccctgcgaggtcccaggacgcatcttccctcaggagctcctctgcctcgcgggctcatgcgagcgagacctctcagcctgactggtccattccgtgactaatctcagagcccgtgggcctgggccaccaggcccctcctttgtctgcaaactcagagggtctgagacacgcccagctcagcaccagctccagaccctatgggacagcgcaaggtcggccacatgatggagcaccacatggccacaggacatggtgggaggtgcggaaggtggaaagaggcacaaagacgctttccaagtgcccaaaggagagagacggaatcaggacagtttgcctccagtgctgctgacacctgccatgcacgtcagcatcttcatctgatgtcctcaggggagccggctgcacctcacaccatccactctgcaaagcaaagcagccctgggaacagccctggaaaaagccccttcccagctccgggacccccgctcacagccagggccggccagttccacagctacccggacgtagatacagcacacaggcactcatgggttcctaagatcagcctggtgacctcatcggctcagctcttgccacacagacatacacaggccatctggagctgcacgggacgctgaaaccaccactgagggcaggcgagagccaaatcaagaaccaagggggccggcacaggaaacaggccccagcacatgtgggagaaggaacaccagggaggctcagagagaaatccagtgacacaccacgtggactccctccaatggcctctaatggcgcagaccacgagggtggacgacagccaggacacctccgcctggcccacctcactcgctgagccccccgccccgcctcactcgctgagcccccccgccccgcctcactcgctgagcccccccgccccgcctcactctctgagcccccccgccccgcctcactcgctgagctcccccccgcctcactcgctgagcccccccgccccgcctcactcgctgagccccccccgcctcactcgctgagccccccgccccgcctcactcgctgagctcccccccccgcctcactcgctgagctccccccccgcctcactcgctgagcccccccgccccgcctcactcgctgagccccccgccccgcctcactcgctgagcccccccgccccgcctcactcgctgagccccccccgcctcactcgctgagccccccgccccgcctcactcgctgagctcccccccccgcctcactcgctgagctcccccccccgcctcactcgctgagcccccccgccccgcctcactcgctgagccccccgccccgcctcactcgctgagctccccccccgcctcactcgctgagccccccccgccccgcctcactcgctgagccccccccgccccccccgccccgcctcactcgctgagcccccccgccccccccccgccccgcctcactcgctgagctccccccccgcctcactcgctgagccccccgccccgcctcactcgctgagctcccccgccgcctcactcgctgagccccccgccctcccaccggcagccctgggcgggcgcctttgacttcaagggtccggagtgggggctctgtcctctcctctgacgaccgctgcgtggctcttgcataacctcccctttcccccacaacacgaacctcagttttgagtctcacaggaataaagccacatgaaagcaaaaacttcttaaaactgagttgggcaatatatttcagtgaaaagggataaatcttcagactccaagacgccttcagctggacaggagggtcagttttgaagtctgaagttttaaatacttgcaatgtcactgtgtcttcacatttttatgagctgaaactgggacgggagaagtcacatatttacgtggataaaaatcttgtaactggcacatgattacaagtctttaattttagaagtacttcacttaattttttaataggtaacacagaaacagaacaaaatccacaacattcaaaaggatttaaaatcccttcgagaagggatccctgcccctgccacctcattcccgacgtggggtcacttctgtcaccagcccccaacctttccttctagaagccagccacattcaacaatggggaccgtggacatttgaagcatgcgtgttcgtatctccagatgctgacctgagagaatgcctgatctaaaagccacggcgtctacttaaatttctctgatgtgcctaatccacagggttgtccccatctatttgagtcacaccgaaaagtttaccgaacactctgggcctccctttctcacttgggcaaaggcggctgccttctcaccacgagaggccggaagggtcactttcttctgctgcatctgtgctggccaggcccgttcagaaaggaggagccaggggtctggagggcatcagacgggggaccagctgcagagggaccagaaaaaggggaaacagccacaggacacaactgagcaagagctgcccgagacagggaatgcggctgaaatgcgcgcgcctccctctgaccccacctgtgtcccagccagggccacgaggaaaaaacaaaggccatacagatcccaaaggaagaaataaaagcctttattcatagaatgtacaaaaaaaaatctacaggcaaagctaatagaactaattggtgtgttcagcaagaacagagaacacaaagtcagtgtggagacgtcgactgcgtttgtacatacaagcaatgaccatgaaaattacacaaaaacagcacctttcacaaaattatgcttttaggtttgtgcttttggtggactacctcagaaatctttaaccactccactaaacacataaaacacagggaaataaatgtttttaaatgtgcaaaatgtgtaggctgaaaacacatcacaaaacactgatgagagaaattggaaagacccaagcgtgtaaagatataccatgtccatggatttgaagactcagttttgttaagatattaattctccccaaattaatctatagatcaatgtaatcccagtcaaaattcctgtgggactattttggaaattgagaagctcattcaaaagtatatatggcaattcaaagcatctagaatagaaaaacaagtttaagaacaaatttgatgatcttacactacaatgtaagacctgctatgaagctatagtgatcaagactgcgtggtattggcatgaggacaggtggatcaatatgacacacagcaggcgagccccaaattggggcttagcctcagagggtctgtagcttcactcaggaaagaattcgagaatgaggtggtggtggaagaaaacagttttatggaggcggcagtggcagctctgaaactgctcctgcacagcaggactccccacgggcggggtgttgacagtctcagccgttcctgcagagaagggttccccataggcagggtgttgagagtggcacctccgggcactgctgcagtcttatttatcctcacttttaactatatgtcaattaaaagattatgcagacatttctagaaaaagggtggtaatttccgagtcacggggttgttcctatggaaaggggtggtaacctccaggcgttgccatggcaatggtaaggtgacatggtacactggcaggcgtgtccgatggaaagctgcttccacccatccctgtctcagctagtcctcaatttggttcggtgtccgagccctgccttcagagtccagtcccgcctcctacctcagatggaagagaatacagaggccacaaacagacccacacaatgcagccaactaagctgtaaatgtgccaaagtcatcaacggaggaagggtcgtctttcagccaagggtgccggaacaaagggatgtctacatggaaaaaacagaatcccgacccttttctttgtgctataagtgaaaattagcttgaaacagatcatggaactaaatgtgaacgctgaaagcacatgctttccaggagaaaaccgccacaaccgtggaataggcaagactttcttagacatgacaccacaggtacaaatcatacaagaaaaaaatgtgataaactggaccatcgaaattaaaaacttctgttcttcaaagccaatggtaagaaaatgaaatacaagccacaaactggaagaaaatatttgcaaagcacacttgtgatagactcgtatccagaatatacagggaactttaaaaagtaacaagaaaacaacccaattaaaagggcaaaagatttgaacaatgtactaaagaaggaatggagctgtcactaagcccaagaaaaggtcctcgacgccactcttcacggacacgcaataaaagccacagtgagacagtacacacctatgggagtgcaaacggtaactagagaataaaaactcacagtcctaagggccgggcaggatgcgaaatacctgctgctctcacccgctgctggagagaaggcagactgggtgaccacttggagacacggttgggtagttttaatgaaagtaaacacacaccctacagtgacccagcaacctcgctcccacgcatttatctcagagtaagaaacagaaacattgtccacacaaagacctatccgagaatgtttacggtgactttattcataattcctgaggattagacacaatccagagggtggatgaggcggctgagctgtgtctgtatgatggaaacccacgggcagtggaagggggcggcctggctcacagccgcacagcgcgggaccagcgcagtggcagagggcacggcccctccagggtttgagtcacgtggcctcctggaaaaggcaactgtgggaacaggcctcagagcagtggctgcccggggctgtgggccagggtaggaaatccaccccaaaggggcccaaaggagtgttccgggctgtgggaacatatcttagctgtgctgctgtctacacaactgcatacactggtgaaggctacacctaacagtgaactttaccatatgtcagttgcagaccacctgatttatacacaaagaacggaggtctcggccgggcgcggtggctcacgcctgtaatcccagcactttgggaggccgaggtgggcggatcacgaggtcaggagatagagaccaccttggctaacacggtgaaaccccgtctctactgaaaatacaaaaaattagccgggcgtggtggcgggcgcctgtagtcccagctactcgggaagctgaggcaggagaatggcgtgaacccgggaggtggaggttgcagtgagccgagatcgcgccactgccctccagcctgggcgacagaaagagactccgtctcaaaaaaaaaaaaaaagaagaagaaaagaatggaggtctcactgcacccccaccccattgggaagcctcagagagtctctaggggctggaggggcaaatggagggggacatggtgctaccagagccggggcccagaggaaggtggaggcctagcgggaaaaggagggaggcgccaggatcgggggcggagaccccaatgctcctgacagcaccgagccgggcctcgcgcatttccgtggttcccgcatcccagctgcggggagccatagtttccggtctgtgctctgtgagggcagcgcccggcagccgagtccaggcagaggccgcctccctgcgcctggaatcccgaaggagcctgcgccccgtgtgtcccgcaggtcacggccctgcagctgggagcccggcttgactgacagttcccgccggcagcagcgctctgtgggccatggacccagggacagaggaggctacggtcacgccgcccgggacccgccgacactggacacttctcctgctcctgctgtggcgggagctgactgcagccggtggaggtgccggggtgggctggggagggctgagggcaggcctttatttccccaagtctcacttgccggggcgccgtatcccggcacggcttcagctgcctttctcggtttctgtcgccaccgccctccccctccaggctgaagatgccctcccgtccccaacccacacccccgaccccataggaatgcacccccacttccttctggcacctgccagtgcacctctcactcctggacctgaacttgcaactgagcacagctgtggctgccccaagggaaacttgctggcaggtggggtttcctcagggcgtgggcggctgctagaaacgagaaccaggagaaccacgcagccaggaagccagtggccaccgcgcacttccacccagaaacgcattccccagaacctggtgtttcatgcccggtaacaacataattaccatcataaagataaatcgttaccggagatccagacagccacccattttcatagctgcgaaagccacagtgaaacatctaagtccagtcaccataatcgtaaagccaccaagaactactagcagacgacgtcaacagaatgattaataaacatcttatttggttattttcagagcatataactccagaactaacttgatcagcttctcttactaaaatgtgcaaaaattttttaaatttctttttccttagggttgtcgctcaaaaaatgtctcatacaccttcgagaacgaatcaagtccctgtggattctcgagtataaacggagctggtgacgaggcctgacacacggtcacacctcaattcgcgcgtggcgcccggcacaggctgagccccgccagatacaccattagcctccgctgaataatctggattccatgcctccctttcttctgagaacacccttggaggcccctggcaggggctgagaacacaggagcgagacacaggcctgccctgcaggaccatgggctccaggaagctctgtccagtggacacagcacaacaggcaagagaaccacaaccaacgagtggggcaggggaggcaggtcacggagggcagcccacccatgccgcggggtcggaggccatctcctgcagcaggccccagtcccagaggtgggcatggcaggacatggggatggagaaggaggtgcctcaggagtggggtgcacagcggctgagcccggaggcaggagggagaactgccagccactagccctggagccgatgccctggtcagagggagagaggaagagggaacccttccgcagcacccagcttgaacgcgacataaagctatgggcctgaacctgagggcctcccaggcagacactgagcaagggggtgcaggggtcacgctggaccctcaagaccatctcaccgacaaggctccatgaagcccagcacagcaagaccctgaaggggggtcaggtgcccgctgcactcagacaccttctgcagccgcatttcagggccagggtgtccgctgcggaagcacccagcacagtgttcccgctcaaaatgaagtcaaatgtcaattatctgagatccatgtgacccattccatgtattttctaaacaaactctggagacttctatgaaaaacacagcagtttctaagaataatcacttgggtacagtgaacaacagtcccaaaaatgtccgggtcccgacccctgcaatggtgagggggcactggccttatcaatgccaggtgaggccctgcccggccccgagggcctctcacccagccaagcccctctcaatgccaggcagagagcaagactggtcaggataggcatctcatctctgtcaggggacttgctgtggaggcccgggacatggcagagtgcagacagcctacgcgttacctactagcccgtttctctcatgccccctctctctctcaacgtcgtgctgacacacactagctgccggccgcccagtggggacaggctgggttttaggacactcaagctctgaggtggacctttggccgtgcctctcacttctgtgtgccaagcactgggaatggatcagatcacagatcctggtccatggctcacaaacagaggaacagggacgatgaagaaagcccacagctgagggacacaggtgagcgctggggaaagggggcagccggcgtggggtggagcggccgtgacacggtgtgaggagccagtgtgagcagcgagcgtcagatggaccgggaccccgcccacgcacagcaccctcgtggcctcgctggcctcctgcacccccgggccctcaggctgcctggggccaagctgggggtcccctgggggactcctcctctcgccctgtcccactcagcatcccggcagccatgaagacgaggagcctgcaccacctggggtctgggttcaggctgtggcagccagtacacactggctccccggccgcccgtcctgggcgtgagctcaggcgccacaggacccctcctcccttcctggctctcccagcgtcacggcgggaattagcctgatccctcagcctcccacgcctgctgcgtgaggtctgctcctgacggggtcctctggctgcatttaggaacaaggagctccccgagtaacctgaagtccactctgcccagaggccccacaacttacaggatgccgccttcctgtgataccaggcagggctgcccatgagctttctccaagagcagccccacccctgctccaaacacaccatctcctggaagtaacagtattgccccaaaaaccagggggaaactgaggcaacatgcccccacccccacccgcccttcctgtgcccacactgtggggactaaagttgggacagggacagccaagacgtggtgaggagggaggccccacatccatgcaaaggtccccccacagatgccccggggaacagccctgggaagttgtctgaagagggccagagatgctgtgctcttgccttgaggggccatggaagcctcgactggcagtgctcactgacctgagcctggtgtgatgctctagcagggaccacagatgccaggccagatcccaagagcagatcaggaggaacacccagggctgctgtgacctcaagccctgcagcgacccctcagcaccatccagccaggctctggactgaaatgctaatactcgcctggtacagaacaggcagaaaaggggaagtaaatgctcattcatcacctacctatgatggaatccctccggaaaacgtctctatcgaaaatgtagaaggacaggtgacgaaagctccgaggaatttcacagtaaaagtcttctccgtaaaacgggctagtgagacaaagaaaagcgccagttagaacacaggccacgcttgcgcctcacccccggggcacacacgtgtggtcttagttttaaacatgccataagaatgccctgcactgtgtggcacgcatgagacatgaacctgcagctccctgtggggtgaagggcctcgtagctgctccccggcctccacctcgagcctttgcactgcacagatgaacttctgtactgggctgcctggcggcccggaagctgagacctccacagagaccacggccactgccagaatgacttccatgctacgtgctcaggtctaggtgcagcctcagggccatcgtgatgtttcgaaggtacctggtttggggcaggcagtggctccctttatgcattaaacataaaacacagcactccagtgccttggaccgctccttttatccagagatccagtacaaagtcctgactgcccagccgccctcactcctcggggagagacccccgctgctgactgtacttagagtcctcgctcctgggggagaggcccccgctgctgactgtgcttagagtcctcgctcctgggggagagatccccgctgctgactgtgcttagagtcctggctcctgggggagagacccccgctgctgactgtacttagagtcctcgctcctgggggagaaatccccactgctgactgtgcgtagagtcctcgctcctgggggagagacccccgctgctgactgtgcttagagtcctggctcctgggggagagacccccgctgctgactgtacttagagtcctcgctcctgggggagaaatcgccactgctgactgtgcgtagagtcctcgctcctgggggagagacccccgctgctgactgtgcttagagtcctggctcctggggaagagacccccactgctgactgtgcttagagtcctcgctcctgggggagaggcccccgccgctgactgtacttaaagtccttgctcccggaggagaggcccctgctgctgactgcccagccgccctagctcctgggggagaggaccccgctgctgactgtgcttacagagtgcatggctcaggccgcccatgcgtgagtcaccaggagatgcagccgccccacagaggagacttgaaataaccacaaccccaataaagaagcagaagccagtgggctttgccattcagcaaaccttcctgttgtcctgggctggcacaggtggggttagtttcctccccacgccggacctgttggcgattactgcggtgcacgcacagctaccaccaactcagaacttaaaacaagcccactttcatgcacattgatgctaaggtccaaaataggaaagatgtaagttattcaaggaggaaccattctgatagaaagcaaaggaaggtcaacgtgctgggccagggggcgtccacacagtcaccaacggcacaggccccaccccagccacacacagaaatgagctcagaccccgcacccatctgtaagggtgtaagggttggagctactagcctctcagaagaaaatgagaatgaacctgcaccctaaagtcaggtaaagatgtcttagatctgtcaccaaaagcacaagtgccaaaagaaaaataaatggaaaatcaaacttcatcaaaattaaaaacattaaaaacttttttgcattaaaagcattatttaaaaagtgaaaagggccagtgctgtggctcacgcctgtaatcccaacactttgggaggctgagactaacgaatcacctaagatcaggagttcgagaccagcctggccaacatggcaaatccccatctctactaaaaatacaaaaattagcagggcatggtggtgggcgcctgtagtcccagctactcgggaggctgaggcaggagaatcgcttgaacctgggaggcagaggttgcagtgagccaagattgcaccactgcactccagcctgggtgacaagagcaaaactcagtctcaaaaaaataataaaaattaaaaaaataaaaagtgaaaagacagactagaaaaaatattagtaagtcagttatctgataaaagacttatatacagaatatataaagaactcttatgactcaataaatgatgacaaataattcagtttaaaaaggggcaaaagatttgaacacacatatcaccaaagacaaatggccaacaatgtattaaaaatgctccatgtcattagcccttgagaaaatgcaaattaaaccaggagatacggcacaggcataagcccaaacctggggcgggcgactgttgctgcccggagcccaggtgggaggggcccagagtccaggtgggaggggcccagagtccaggtgggaggggtccagagtccaggccccaccccttctccctgcagcggccttaatgacaggcatttcatttggatttcactgatttcagtatttttataactgggtcagagactgggtaacatttactcagaaaaccattttttgtcataaaacaatcttccaagggaagcctaaaatgcctaggttgttttaagcattttggaaacacagcagtatccatttacacacaaaagaaacatcactttatctttcaatgaaggcagaatgctcagggacttccaccgactccattgtagcagcatcctggttaatgaaggcccattagaaagtcacgtttcctttaaacacattctcgcgttggtcgttgacgcagcgagccatcctctgatctcctgcgtctgcgtgggcaccgccgagatctgatgtcagggacccccaggggtgtgtgtgcccacaggcatgtgtgtgtgggtgtgtgcacgtgtgtgcccatgggtgtgtgcacgtgtgtgcccatgggtgcgtgtgcccacaggcatgtgtgtgggtgtgtgcatgcatgtgcctgtacgtgtgtgcccacaggcacgtgtttgtgtgtgcatgtgtgtgcccgtatgtgtgtccccacaggcaggtgtgcatgttcatgtgcatgtgtgtgcccacaggcacgtgtgcatgggtgtgtgcatgcatgtgccatgcatgtgcccatacatgtgtgctcacaggcatgtgtgcatgttcatgcgtgcatgcatgtgccctggagcacttgggtgcacatgtacacaaaggcaccacagatgcgccccacacaatgcgctgctttcataacaaggcgcaggggtcgtgaccctgcctccaccctgtgtaaagtcacagctgcaggatctcggggcaggacgcacactccccaggcagcgccctgtggcctccctggagaagcttggtgctctgcggacagcgtccccactggcaggaaaaaccactatcaacctcgaagccaaaagggacaccagacgtgcattttaatattcacgacaaggcctcaggtgacgagctactcacaggacaagcgttaacaattaatagtaatccacaaaacatttgggatttttacaacgacaaaacggcctcttctgtacgtcctagagcaactttcagggccactgaggcctaagtgatggcaggaagccgtggtgtttgaatgtgtgaaagcagcctggacttggcgtttccagccccgttcgctcccggcagagccccaagaaccaagggctggaggcttcacttcctgctccagagtggcaggtgcccaggctgtcctggctgcggtgcatctcacacaagaagcccagcgggagcacgcacagctctgggccttgcggcaaatgcgtaaccaaaaggcgtaaatcaagcttcgttcaccatggaggaacctcagaaccaccggcaccgatagccaagctgccagagaatggaacggacgccctccattggcacaaactccagcagccggcttgtcaggaagctgcagcagcttcagagcaacccaggcctcggggttcacctggcgcgtcaccgtttcccgagagccccccgcccccgcacaggcactgaggaccccaccacatgggcctgtgcctgcctggcaggaaggcagggaggaggaagtgggtcgggctggattgcatgtctgatgtgtgtccgatgaatgtccagtgcgtgtccaatgcgtgtctggtgagtggtgagtgtctggtgtgtgtctgatgtgtgtctgatgcatatttggtgcgtgtccggtgcgtggtgaggggcggtgagatgaggatgccagcgctaagcacaccccacaaacgggcgccgcgcacctggcatttaaccctgcacacttcctcaccaccctgatgcacagggtgggaaaccgaggcactccaacatctgatgaaacgaaactaaccccagggcttgggcagcagggctgagagtgcggcgtccctgggcgctgcccggtagcggggtgttcagttgctctgccaaaggctctgcacaagtggctcctctctctgtaactctgcttggcagtggggggctcggtggggggaggcccgtgctggctgggcacctgggagggtcccgtgaggcttctggtggtgctgacagctgtccgtggaaattgaggtgcttaaaattcataaataaaccagaaatccattcaataaaaagagataaaaatagcagaaagaggaagctacaagaaaacatacgaactccataaaattatcaccacagactggacgtgcccctttctaaatgtaaaagcggtttatagcaacacagcatggccctgctgcactacccctggggagcaagacctcctccagcctccacccaggaatttctccagcaatggctttagaaccttgctcctgaatcgcagcaggggaggcagcgctttggggccctctgtcaggctgccccccctgctaagaggagctgttgtccttgggaaccacgggtcccccctcctgaagaaggggaacgtcacactcacagttccattttacacatttgcagctgagaaccctggagccagaacaggctccagcacaggcgatgggtgagtgttttgcatgtctgatgtcgtttattctagtggttccaattgcctattttaatgtttttcttcttatttcatataactttttaaacttaaagtaataaagttattactaactttgtttcctgcgggtcacctcaagtctttcaggaaaccaggcaggacatctgcaggcggccggccagccttatcaacggagctctgagccaccaaccactgtgaccaagcttcattcccacgagctggacgagcagaaggcattgcagggcagtggggtccggagaggcggccgtgctacaggccttgcactcattttaatgaaggctctgcaggatttcaaggaaagctggagccagtctctgtgccagaatagagggttcgttcagcttcttagaccgatgatttatttagggaataagaagggcgattccagggacagtggaggcccccacaggaaggaaacctctccccacaatgactgtgcacagagccagcctgacacccaaggccacgatgccatagccagggagccctgaagaaactcctggaagaatgtaaaacccccagctcaaggaggagagtggaggcggttccccaccttctgggggcagttaacctctgagaatgaacccacagctaaaacccataaaacctccgccaaccacacccagacctggaaggggcacctctggccagggcgctcagcacgaggggacccagaacaatggcttccctggggtgcgggctcggcctgcaggatggaggctggagagctgccatcctagcgcacactgggtagatgcaggtgtttccaatgtgctgaagagggcagggcctggctgaggccctgggaggtcggagtcccggaggtgggtgggggtggtgagttcccaggtcacttccccaggtgtgcgttttcctcactgtcctgtcctattcattcattttagcacggaggccagaaccagccgagtgaagcccctgcctgaccactcaggggtgtgaggacaggggcgaggaccgggatcatcagtcagctcctagaatggcaggtttgtacctgcaaacggagcaccagagtgacatccccccaagacccccgagatgccatgagccccatggagaccacccacccggcaggggccagctccaggtgctgctgctgcggcgaggccgtcaccaccatccacgcgtccagcaggaagagcggattcctcgggcgtgaggctcaccactcacgttgtctgcacacctgcctgacgacctctcccgaacctggattcccaccacagaattcagctcctcgggtgctcaccagcccgtgacttgtggtcaccagaccggacggaaaacacagagaccatttcctgttttgcagaaaatcctgttgggccatgccagtcctagagccaaaacacggtgtccacttgagggtccagacctgaggccacccttgctgggacagcatctccttccctctcagagcaatgccactgatgcccagaccagcaaccatgcccgtcctcgcctgcccgacaatgcccttcccaggccctgctcctcggaggactggtcatgggcaccctggactatgccgacccgcagtccccagggaccaagtcctgctgctgtggacacaggtgaccctgcccctcgcaggggagctgctcttctcctgagcccaggagtgctctgaaacttatatcccaatgagaaccaaaatcaggagtagaagtgggagttgaaggccagagcctttttcgaagaacttccctaagctcttttaaatacctgcatccaggccagatgcagtggctcacgcctgtaatcccagcactttgggaggccatgccagaagcgccacttgagcccaggagttagagatcaacctgggcaacatagcaagaccccaactcaacagaaaatttaaaaattagatgggtttggtggcgcacgtctgcagcgaagcggaggattgcttgagcccggggttccaggctgcagtgagctgtgatcacagcactgcactcctgcctgagtgacagggcgagatcctgtctcaaaaaaccaaacacctgcatctcctgcatcttcagagcacagtcccgcctggaggagccgccgtcaggccctcctgcatcttcacagcacagtccccaggtgcagctgctccccccaacctaattcaggccctggtaagcttcacaaggccaaggggacgttggtctccaccaggaagactatatggcacgtctaaatgtaagaatctgtgacagacgtcgctgaagccaatgcgaggaggcgcaggtacccaggaggcacaggtacccaggaggcacaggtgcccacacgggccttgccgggggaagcacgactttgaagatggggacgtccacgtttcaacgctgccttgccagaggccagttccctcatctctcagcctcaggacaccgccctctccacagtgcagcctgcgggcacagagggcgctcggctggggaagggcagtggctctgcccccaaagcggcctccccaggacacaccactgcctggcttggaggtttcttcctctgccctgcacagtgagacaagcacatggcagggcctcccacacaccaggaccaaacaacggggagcactttcgatgtctttggcccccgccaggcgtggctcactggacccagaaaccacagcgctctctctctccatgactgtttcagctgcccatccccgttctagactgtgggaatagcagccaatgaagcaaagtcctggccccatggagccagccaaagagcacacagaaccacgaatgtccaacgcgggcaaggctggcgggggcagcactgtggcctcgctcgggggacagggaggcttacggacgagtgagcgcttgaacagcgctgtggacggtgaggagacccgcaggaggacaagggaacgcatgaatgaggccatggacggcgcggagagcgcaggaggggtctaggcagagggacaccaggtgcgaaggcctcgaggcagcagggcttgtgtgtggtaaagacgtaggagcaaggagaaggctgacgtggcctgggcagggcacggcaggaccggagcatgctgggagccgaggtcagaggtcagggtgcagccgaggtcacgtggtgcagagcagacatttcaccacagcagctgggaatatgcaggcccgtgcaagacactggatggacggatgcacggatggggcagtgggcatgcagggaggaatcacctgtctcaggtcagcagccaggagctgcccagacctggcacagtggaccaggaagggaaggtcacccaagcctccacaggtggggctttctgcaagcaaggtgcagcggtcagcccgagaggccacggtgccgagcaaatcctggttgtcctcatggggacgacaggaattcagttctggcagagccaagactgccgggaagccagaggggctcctgcaggaggtgacgggcctgcggggacgcgaagggccaggaccggacacgccccgttccgctctgcttccagtgaggcgagaggcgggcaggacgcagctggagccgcgcacgcccggagctcaggccaggactgtcccccagcgctgcgctcgcccgcggtggagctgcagtgttatcagtggtcagctcaagtccagtggcttgaaagggaggcagaggcctcaccttccctgaggctccctgtgaagagcaggaggctgggccctcgggaagaccccagccaggctctgccacctccacagccgggagacggggcctccaaagccggcagacggagcccccacagccggcagacggagccccccacagccggcagatggagccccccacagccggcagacggagccccccacagccggcagacggagcccccacagccggcagatggagcctgggcactgcacacagagacatttcttcttcccgagacctcgcacagaaattactcacttaaaagcacttagagttttttcattttttcagtggcaaatatttcgagggaataccacagaaatagccacaccaaaacccaactcagttctcccttctccacccccgccacggccggggacgctgcctcgatgcgcggggctccctccgccatggccggggacgctgccttgatgcgtggggcttgggttcttcaggtctcttgatgtttttcctcttagaaccgcaaactacggttgcctgaaaaggtttctaaaaaccccaggcgcccaggcccacctcagagaacggctctttaagggtgatgggttatgaaacaggagccctttgggaggccaaggtgggtggatcatgaggtcaagagattgagagcatcctggccaacatggtgaaacgccgtctctactaaaaatacaaaaaaaaaaaaaattactgggcatggcggcaggcgcctgtaatcccagctactcaggaggctgaggcaggagaatcacttgaacctgggaggcggaggttgcagtgaaccgagatcgcaccactgcactccagcctgggcgacaaagcaagactctgtctcaaaaaaaaaaaaaaaagaaaaagaaagaaagaaatacgagctttgaaatctatactagccatggagtctaacacgatccttaagcgaactgctcattacaaagcgtggcaggctgccttctctccagagggtttctggtgccctatccacggaggcggcagtgggattcagccgtcacctgtgcttgcggtggtaactccatctcagactcaacaggggacgtgtctgcacagagcacacggcgcaggggttgggcggggaggacggcaaggtcaagccagctcaggggacatggtgggcagggggctccagatcccacggtgggcagaaaaggcgggggtcggactgacgccgtcctggaccatgtccacgtctggggtctgcaggttccatctccctttccactgtgcctaaccttacatctataacctacatccagcaagacacgattttccacgatgagttgattcgtaattccatttatgtgcaagtttttagaattttcctgtgggttttttttttacttacttatgattttaattttgtttgctttaaaaaaaacacatgcataggaaagaatgcttcctttcatttcaattaaaaacaacaaattgcttttttttaagcaaaaattcattgagggggggctcgcattgtacaaagaaaatcagacccaccgggatggctgtgatcaaagagacagtaacaagggtagggaggtggagatgcgaatccaaacacacaacttgtgcaaaggtcaagtggccacagccgccacggaaaacaggctggcggttcctccgacgttcaacacacagtcgccacgggacacagtggttccacccccaggtgtgcagcaatagacatcacagcccacgtccgcacgcagactcggacacgcgtgctcacagcccacgtccgcacgcagactcagacacgcgtgctcacagcccacgtccgcatgcagactcggacacgcgtgctcacagcccacgtccgcatgcagactcggacacgcgtgctcacagcccacgttcgcacgcagactcagacatgcgtgctcacagcctcagtcatgacagccagacagtggaaacaaggcaggtgggcctcggctgctgagggagcaacagcagaacggtgctcagccctggagaggaaggacgcctggaccctggccccacaccacagcatccacaatgtggtgccaaccaacaggccacgcacacagaggccatgggccagacgcttccactgacacgaaatgcccaagagaggcacagccggcgacagaacggggacccgtgtctgccgccccaggagaggctgcaggccggaaactggaggattacagggcgcgagtgtcgttttagggagatgaaaatgttctaaaattggctgtggcaattgttgcacaactctgcaaatatactaaaaaccactgaattgtacatttcaaaatgggtgaattgtacggtgcttgaattatacctcaataaagctatttttaaagaaacaaaattttaaatacgtaaaaaaatcagaaagtgaaatctggaattaacattccaggaaacatcctcctggagttttttctccaaaaatataaaatagaataaaatatataaatgttataggtttaaaatatacaaaatataaatatatttgtattacatttataacataaatacaatatttataatacaaatataagtatattcatactataatgactcattatattataatacaaatatattaacaataatagtaaatatttatgttataaatatagaagatacgaatggaaatacggataaattttttaaataaaagtgaggttatgttccctgtgacagagtcagctttttcctttcacatcaggccatgggccactttccaaagagctgataaaacgctggggtcagacggcacgtgtgtgcgtggacagcagtgccaggtccccctgccatgtgcacgctgtgtggtgggagcagcaggggtgagcaccctgggaacgcagatctgtgcagtggctgattgtccccgtgggataaattcctccaaggatgtgcactgtcctgaggcctttgaaacacaaagccacagaaccctccagggagtctggaccagtgtccacccccagcatacgccgtcttataaatatttctacagtttgctaaaccggtggcaaaaacctgcttaaattttaaatgtctggctcattggtgaggtggaatgtccatctttttatgagcagttttaaatctcattttttcttgaaatgctctgggcctgttttctattagaatgaccatcttttcatgctcaggatttaaccctccgggaacttctgaatgtgtgttgcaacttaaaagacatattatttcacaacatttaaggaggatcttttttgaactaaaaaaacccccacaaatttgttaaatttgtcaccagtgggtgactatggacctgtgatcagccaactctgaaatgagctccagcagatggacacagcgtcccaggacctgcaggagcagaggctgcgaggccagccacgtccacctcgatcacgtcacctcgtgggcagaatggcctacgccccatgtcctcccagccccacccagaacccacggtgagcacccggcaggaagtggccacagcaccatcactggaggccacgcggagtctgaggacagcagctttcccccctatgctgttgtggggactccaggctcagcctgaggacagggtcagttccctccacacagcaccaacactcccaggtgcaaagcccaggcccacggacagccccccgctgtccgtgggtctcatggtgggggcacccattttctttcatcagcaggaaggtttgtgctttctccttcctgggcagcagagtttgaagcgtattccaaaagaaaaatgaaaccggctgaacgctagggcattcctcccatcccccatcctgttcggtggcctgtgccggacaatctcttctttctgatggactcaaaggggccacacagccaccaggtgccccccttcccatcagcagcttaacctcggggtatctcttggacaggccggctttgtctccagccgaggtcagcagcagtcagatgcgggatgaatgcctggcccaggcggcccccactcaccgcccgagggctctggaactctctttccaaataaagaaaaagtgcggcctgagaggaccaggctcgcctgaaatcctgccatgtggcctaaggaaattaacgcacgcagcagcctctccctctgaggcagagaccctggcaaagtctcctttccctcagtcatttctggaagaagtgcaaatgaagtttcacagaatcaagcaaactttcacggggaaaaaagaaaaaacctcttgcagaaaacagagttgacctttaagtagtggctctgatgaggggaaaccatctgaactgaattcctcctcctcctggagcctggagcaggggctcagctgggaccagcagagaaacccccgccttctcctccctgagtcacttcccagcatctgcgcaaggctggcgctgccccatcccgcctgcggctgctcccatcacgtgatcataagaaaataaacctggtttcccagctctgtgctctgccgcaggctcggggcccatttcccaaacgctggggggagccgggagctgccagggctgccccagcctcggggtagagggtaaaggctgcgtgaagaggaaccaaaccccaaaccgggtctgcgaagcagccctggggctcccaagccagcctctgggctgagctctgcggtcctgagtcactgcctgactcatcctcagaggcgccccacagagaaggggcaacttggccagggaaaatgctccatctccgcaaaggacaggaggcaaaacacacccatcagaagcacatggccagtgcagggccacacagccctggctcccacagaccgcaggctggagaatgggggtccgcggtcagctcatagcccacccgccacccagcactgcagggtcacacagccctggctcccagaggtcagaggctggagggcaggggtccgtggtcagctcacagcccactcaccacccagcacggcaggtctcagcggaagccccacacacactgggttgcagcctcctgtggttcaagatgggtggggttattttgaaatgttggcaaatagagctgtgagtcttcaaacggaacccaaagactcagtgaggaaagcaggcgggctgggctgagactcacagctgcagcggccgtggtgagccacctcacctccccgagcctcagtctccccatctgttcaggggcaccgaggagctgcccctcggctcatgggctctgtggtcgccaggcacgccacacaccacacgccacacaccactgcacgcagcaccccgggacactgtggcctcggctcccgcctctcctgcacatgaggctctttcctctctcccaccccataccccccaaaaaagaaccaccatccttacaaacaaatgaaaatcggctgggtctttagggcccggccacgatgtgtgactgcagcagtgactctcaggaggaggcacaaccagacaccgggtcccctgcagcagctgagacacctcaaaccccaaaccctcagtgaggccctggtgggaaaaggggctctccagggaggtgccaggggcaggagagagggccagcggccgaggagcgggaggcggccgggcgagaggaggcccgggcaggagggagaaggggggacctggcctttgctcctcatgggatcctcggtgcggccccctcgtgacaggcccagcctctccctgcagtggcccagccacagctcagggccaggaggctcctgcaggcacaggcggccgatgagtcccttccaggcctgggcctggggcagcctgccatgtgcagtagacactcagtactcacagaatacgagcaacctcatgctctccgccggctgagttcctgtgcggctgagagaaccccctgcatcattctgacacaggtgcgctcctgtgagccagcatgacacggaaggacacacacatgcaggtggagatggagatgctgggccgggcttgggggtcatacagacaggaccaggggctctgacctgctgggagatttggggccagcattccaggactgagagaacagatccctggcctggggtgctctggggctgaggatgggcccccacctgggctgaggatgggcccaacctgggctgaggacgggcctccccacctgggctgaggacaggcccccctacctgggctgaggacgggccccccaacctgggctgaggacgggccccctgacctgggctgaggactggccccctgacctgggctgaggacaggccccccaacctgggctgaggatgggccccccagctggggcactctggggctgaggacgggccccccacctggggcactctggagctgaggatgggcccccacctgcggtactctggggctgaggacgggccccccacctggggcacttctggggctgaggatgggcccccacctgcggacaccccggggctgaggatgggcccccacctggggtactctggggctgaggatgggtcccctactccagcagttctgggatattctgggcttcaagaagcctccagtcgtgtcaagcaggtttttgtttaagctctaacttgagagtgaaaataaatgttcatgggaaatgtgacttttcatgagtcgcctaatgtcaaagtcggtgtttcctaagtcagcaacttggtttttattaaaagcatctgagagaatgaaccgtctgtctcccaaaccaccaacttcctcctgcccctttcagtttctaaccccaaataacttctcccctcccgaaaaactttggagctgtggagacatttcttggtttagtcatttctactacacaaaagtactattttgggggtgatttacatcttgcagtatgaacagaaagaaacctccctgtctttaacaaacacccactgcgtgcacacaggacgggacgggcttccacccagaagagctcagagcctgcccctcagggctgccaagtgagggtccctggtgatgtctgatgtcctcgtctgcctgggaagacccagctctcctcgctcagctctagaagatctatctgttccttgacttgtaacttctaattgtacataaaacacacaaacaaaagaacaagaactcccccataattccacttctcagaaatcacatcacattgacgtttttgtctgcgtatccagatcattttgggggtgctcatgattttttaaacaaaagaacttttcctacagacacagctttgtaacctaacgcataaccagctttcggagcaggagttcaggccgtggcacctctgggtggagggggcacagaaaccagccacgcctgcagtttcttcctgttgtggccacggccccttctccccgagatgggcatgcaaatgaaccctgcaaaggacgcaggagcaactccacagaaagggggggccagggctccgcgtggggcagagggctttgcccagcctcaaccccagtggcagggggtagggtcagacccagaaccctgaggcagagcctccctgagccaggactgtctgcgtggatgagggtttggggagaggtcagccacgtgggcgcagaggaagcaggcagggacagacaccattccacgtccttacgtggatggaaggaaatgaggacacgacacttactgaatattcttgcaaatgactggactaacccagcaaggagagatttaggttctgttgtgtgtgacgccagctgttcctttctgctggacaagacggtgatttccactgcagcgcagccttggggagcggggtcatctccttgttttagggtcgtgggtgccggcccaggggaggtccagggcgggaagctggttcccaagccccagccctgccaacccaatttcagggagccttttagtttaagtaaataaggaaacaaatagtggctgccctttaaatgattaaaaatgattgctctaaaaggtatggattgtgaacacagttcactctcaacctcagaaaattatttttctagtaggacagaaactgccaaaatcacttccttggagaagggccaaggccagagagaaagggcttgttctctgaaatgtgtccacttcgatgcgttctgaagttaaacctgtgacagacactgcccttcaacctccaccttgaaaaatacagaaaaaagggaagacagaggacgctctccccagacgtcggctcagcactcgataaagaggccccacagactccagggcctcggacgcgcggcccaggggcccgggccacacgcagggaggaggcgtgggggacacaggcctgaggtggagctgggtcggtgacctccttagtgggaaagagggaagaagagaagctgagttccgcctttccttcctcacacattccatttgcagcttcctgctaagtcagacggcgatattgggcaacagcaaatcaaacttgacccaagtgcttctccccagggaatgtgagaaggggctcctgcccggctgcagacccagcggccagagagcaccctggggcccttctgagctcagagatgcagacgtgggcttttttctttccacagcgactttgccaaatgaaccatcagaccttaaaggtgacactgaccttggaggaagcacacggggggctgggagactcagggaccgggagacttggggggctgggagactcgggggccgggagactcgggggaccaggagactcagggggccaggagacacaggggccaggagactcaggggtcgggagactcgggggttgggagacttgggggtcgggagactggggggtgggagactgggggaatgggagattcggggaccgggagactcggggagccgggagactcggggagccgggaaactgagggggccgggaaactggggggccaggagactcggggggccaggagacttggggggctgggaggctcgggggctgggagacttggggggctgggagactcgggggccgggagacttggggggccgggagactcgggggctgagagactcaggggaccacttggggggccaggagactcgggggccgggagacttggggggccaggagactcaggggccgggagactcaggggtcaggagactggggggtgggagactgggggggtgggagactcggggactgggagactcagggagccgggagacttgggggaaccgggaaactggggggccgggagactcgggggccgggagactggggggtgggagactggggggtgggagacttggggactgggagactcggggagccgggagacttggggggaccgggaaactggggggccaggagactcgggggctgggagactcaggcggccgggagactcgggggttgggagactcggggggccgggagacttgggggctgggagactggggggtgggagactcgggggatgggagactcggggaccaggagacttgggggaccggccccaaagtgggtgccaccatggagcaaggagggggcggtggccaggactaaactccccagcatgtggggcagccctgcctgacacctgcctctcaggtggatgtcgaccaatgactaatacaggactctgttaatgcatgtgcaccgatggagggcttccgaccacagatgtagcgtggattccagctgcaagtttatgagagagccagcttttgggttcaagtacctttcctgccaactttttgtatggggtgggttgatttgcgttttgccctcacactacaggggcggccagcccgcacagccctccaaatggacagggctgccagcgtccacactaaacggcgccagtgttacacgtgggcagggctgccggcgtccacgctaaacggctccacagtcttacacgtgggcagggctgccggcgtccacgctaaacggcgccacagtcttacacgtgggcagggctgccggcgtccacgctaaacggctccacagtcttacacgtgggcagggctgccggcgtccacgctaaacggcgccacagtcttacacgtgggcagggctgccggcgtccacgctaaacggcgccacagttttacacgtgggcagggctgccggcgtccacgctaaacggcgccacagttttacacgtgggcagggctgccggcgtccacgctaaacggcgccacagtgttacacgtgggcagggctgccggcgtccacgctaaacggcgccacagtgttacacgtgggcagggctgccggcgtccacgctaaacggtgccacagttttactctcttggaactgtcccacatgggtttctctttctttgctatcagtcttttgttgtgtgtgttttgggtttttttgagacaaggtcttgctctgtcgcccaggctgaagtgcagtgatgtaatcatggctcactgcggcctcaacctcctggcctcaagcaatcctcacacctcagcctcccaaagtgctgggattacaggtgtgagccaccacacccggccagaaccatgatttctatttctaaattcttctgaaatatctgaaagacaacaggcccccatttctcaacctcacctgaaagagaggttcccaaacagattctcctcccactggctctgattcagcgggtctgagaggatcccggcctgagaaagactgccagtaattctccaggcccacaatccataggcctctaacaacagaccatttaaacacagaatggacttttatccagggaagctccaaaggcacttctgaagggctcggtctcttcccattttcttcagaagaatggctgtgcccagtcatcgccatggcaaccccaagacactctcataaagccagactgggcgcctgacaatgcccctcagcctgcagttctttttgacgagttatttcaaagaacccggagcgtgcattaacataacacaaatgactctcactcctcggcctggagggcagctgcgccaaagccttttggaagcactgtcagtgacggagtgatatgagccccagtctctccagggcaggagacccctcacagttttctagtaagtaaactcacccagtcatcagcatgggttgttcattcccacttggaagtagccagatgcaaggatataattctttagctaaacatgttctcaaaatcaaaatagctgttttgatcaaagcacacgacccatgcttctgaactgaacggtgcagtcacagctgcaaggatgtcttctctgatccccaagccgctccttataacccggtggagtcacagctacacggacatcttctctgatccccaagccgctcccttataacccagccgccccatgcttcccccgaggccgcagcactgaggccctgcctggcacactctccctggcttctctcttcccacccccgacataaatcgccatggcttcctgtccctgtgcatcccaccccgtgccatgtcctggtgttcaactgcagtggtcctccgagtacggcctggccacttagctggagcttttcagaaacacaagttctggttgtgctctggacatcctggggtcggcacccacatcttcacacgctcaagttgagggggaaacttgttgattttaagagtttgtttttcttggctgactcctctcttcctcaaatcatatcaataaacactttctaggcctcttacctcagttaacacccatcttctgtatagctattttagaaaattttacaggaagagaaaagctttctcagtatttccccctctcgaaatccttaatttgtactcttttgtggagtgcgagcttcccggttcatctctaattaaaaagcactcgtgcgagtccacgcagggggaccgccgcctacatgcacttcctggacagcgggagcatttagccaacaccagttcacatccacgcaccaccaaggacagaagctcagctgcctgcacaccagagccccagggagcatctcctcctcaaactaagcaggaggaaaatgggaaggtgatgtacatgctcaggacataatctacatacagaaaaattctctacacgcgggaaaataggatggtgacgtacacgctcgggacactgtctacacacagaaaaattctctacacgcgggaaaatgggacagtgatgtacacgctcaggacattctctacacatgggaaaatgggacggtgatatacacacttgggacattgtctacacatagaaaaattccctacacgcgggaaaatgggacggtgatgtccacgctcgggacattgtctacacacagaaaaattctctacacgcgggaaaatgggacagtgatgtacacgctcaggacattctctacacatgggaaaatgggacggtgatgtacatgcttgggacactgtctacacacagaaaaattccctacacgcaggaaaacgggacggtgacgtacacgctcgggacattgtctacgcacagaaaaattccctacacgcgggaaaacgggacggtgatgtacacgctcgggacattgtctacgcacagaaaaattccctacacatgggaaaatgggacggtgatgtacatgcttgggacactgtctacacacagaaaaattccctacacgcgggaaaatgggacggtgacgtacacgctcgggacattgtctacgcacagaaaaattccctacacatgggaaaatgggacggtgatgtacatgcttgggacactgtctacacacagaaaaattccctacacgcaggaaaacgggacggtgacgtacacgctcgggacattgtctacgcacagaaaaattccctacatgcgggaaaacgggatggtgacgtacacgctcgggacgttctccacacatgggaaaatgggaaggtgacgtacacccttgggacattctctacaccaaagaaaacacatcagtgccaagtaaagcaacagaagacattaccagagtgacttttccacaattttggtcctgaaaacctcctcctggtccaggttcaccgtgcagtagcaatccctcatcttgctcggccccgggtaagagggaaggtttttggcttcacctaaaaagtaaaagcgacatacatcatcagcagcgtagaaatgtttgttccctgctacatcgcagacacgtttccagcctttgcttgtgtgcattcactagctctctataaagccttggtttttttgccaccacaagtcaaaatgtggatgtgcaccccatgtgtactgccgaaaggcgagggacatgcacgccaccctctaatgcaagtcccgcaagcagggacctgccagcctgggactcaggattgctgtgtcttgtttacctgcattagtccctttattttaatttttaacatacaattttccatctctgacctgctcgcgtgcacagttctgtggcattaaccacgttcaccgagttgtgcaaccatcaccaccgtcctctctggaacactctcgtcttcccaaacggagactcggtccccattcaacactcactcccatccccctcctgctgtctcccagtggccctcaccccactttctgtctctgtggatctgactactctggggcctcacgtcggcgggatccacaggacgtgtcctttcagcccggctcactctactcagcaaatgtcctccagggtggcccctgctgtggccgctgactggattcccttctattttaaggttgaataacttccatgatgcaaagggacctcgtcttgcttattcatttatccactgagtccctttttattttgaattttattttatattaggtcaaagttggagccagaattaaaggaaagagctctttcttgtggacgtgagttaactgtaaactccagctgttcgaattgccagtaaagagaagcgtcccagagggacctaagctaggtccacctctccctccttcaagcccacagagacgccacctggacgtgcttgaaggaagtggggccagttcctggctggccctgcagaaaacgcccgtgatcccggactccttgtttgccaggggtcagtctggaggtcataactgaaccccagctgcgacttctctgctggaagctcggagcatgccccagcggcaagcctaacggcccagtttactggagaatagggagtgagcaggaagggatgagtgacagctgtcaatccagacagcggatgcccagtttaagtccattctgtaaaaaaaacgcctcaaacacactcgcgcctccccagggccttttctgcctccgtcatttggctctaaagacgcctggcagtggcgtctccacgacgcaggatgagaggacagatgcaggcacaggcaccacgctgagaccacaccaaggctcctgctggcgccactcagggccacatcaccttattcttgttgaaacaaacaaaatcaaaaacgggagcagagtagaagtttctcagaaccccacttccgccactccgcgctgaatgtttcgcgtcaactcagcaagcgcacacgtcatggctcacatggggcagtcggctcatttcaaagatgccagtttgcaaactggcatgccagcaactccaaagggcagagataaactcagtttgaagctttttaaagacttttcatccacaatattaacctgaggcactgtgagaaggagcagaagccccagggtctggacaacgcctcccgtgtccgcgccgcgtatctctgcgtgtggaggcaccggcaggacgaagcctcccgtgtcggcgccgcgtatctctgggtgtggaggcgccggcaggacgaagcctcccgtgtccgcgccgcgtatctctgcgtgtggaggcgccggcaggacgaagcctcccgtgtccgcaccgcgtatctctgcgtgtggaggcgccggcaggacgaagcctcccgtgtccgcaccgcgtatctctgcgtgtggaggcgccggcaggacgaagccgcccgtgtcggcgccgcgtatctctgggtgtggaggcgccggcaggacgaagcctcccgtgtccgcgccgcgtatctctgcgtgtggaggcgccggcaggacgaagcctcccgtgtcggcgccgcgtatctctacgtgtggaggcgccggcaggacgaagcctcccgtgtccgcgccgcgtatctctgcgtgtggaggcgccggcaggacgaagcctcccgtgtcggcgccgcgtatctctgggtgtggaggcgccggcaggacgaagcctcccgtgtcggcgccgcgtatctctgcgtgtggaggcgccggcaggcgttcccagcagcacccgctgctgcccacacggagcagctctcagggtctcactgcttgcggccgtttcccgccagtgcccccaacacacagtctacctctctgggcctcaaagtcctgaactgcaaaagcaagagacacagcagctctcgaaggctcctccggctctgagacgcctctaattcaaaaggttctggaaatttttattttgggaatcattaaggaagcatcaatgataatcggttggtgggaaaaaatgagtatttcctgataggcactggaccctcagaacacctcaacacggcgactctcccgggatgcgccttcttcacccgctgcatgggagaacacagctaggctgctacgaggcacctggctccaggccaggcctcaggtcggtcatcccatgtcagaagacaggctttccgaaggctcccaccgatgtgaagatcccacacgcagcacacgcacacacgcagcgcacacacgcagcacacgcacgcaggcagcaccgcacacacacgcagcacacgcaggcagcacacgcacacacacgcggcacacgcaggcagggtgtgtgatgagttcacaggcacgaaggggagaacatggccggcgagcttctccagagagggaagggagcctgggggatggcagttgaggttcccggagcagacgcagccttcctggtggccgcggctgcccctgaatttgagggcagccgcagcacacccagcaagtcggacaggggcccctccagcctcccggccctgttttggaactgacggcttctgcagcagatagaagtccttaccctcaaacacagcttgactttgctgactttccttctgacacctttacagtgtgacctgacgctgaccatatttcccttgggattttactgggttttttgtttttgtctttgggagttttttgtttttgttttgttttctgggatttctttgttttttgcaacaaatgagtgtagatatttagctgtaagttcctgtgtttcttaaaaggagagagaaaaaagcttttgaaagtcctgtgggagatggtgtttgtggataatacggaactgagatttgttcccacagggcctcaaatcacagcagtaacagctgggtcttccgaaggcggacactgcaggacggaaacacacaagctttctgtggagtccctgtaagacagacgccgtacgacatgaaaaggccggatccccctgcgctggcgccaacacaccagattcatccctccctgcctgatgatgcccagtcccaccgcactggcaccaacgcaccaggttcctccatccctgcctgacgatgcccagtcctaccgcactggcaccaacgcacccaattcatccctccgtccctgcctgacgatgcccagtccccccacactggcaccaacacaccggattcatcccttcctccctccccactcaatgatgcccagtccccccacactggcaccaacgcaccggattcatccctccctccctgcccgacgatgcccagtcccaccgcactggcaccaatgcaccggattcatccttcctccctgcccgacaatgcccagtccccccacactggcaccaacgcaccggattcatccctccctccctccctgcccaacgatgcccagttcccccgcactggcaccaaggcaccgggttcctccctccctgcccgatgatgcccagtcccctggccccaaaacacaccaggttcctccctccccgcccgatggccccgtctttacctccttctccttgctcactgtcatctggggctgagactctttctttttaatctacttttgctatgatgcatttaataaaaaaaaaagtggggggacaaaatgcaagcccatttccctgcctcaggcttctgatgccatcacctccaaggcactggttttgtttccaactgttaataaagcattgaaacagaaaaaaaaaaaaaaaactcctgagaaacatcctggttgctatgacgacagcaacaccagggagcctgctggacgcaccaacatccaatgagctgctcagaccaggagggctggggctgctgcagcacggcctggccacgtcgccccggggcctcgccgtgtgtgccacatgcaccaggaccgagcctctccctgcagccccacagctgagcgggacgggggctgccccagctcccaagcaactgtttcttctccaccgcaccccaaacagttcattcagttaccttcaccaaaggtgcctgttctgtctctcttagaggaaacacgttttctcttttttttctggtgcacagagacgttcatataaaaagacaaagctgtctgtggtatacagtaagtacctaattatctgttgcatgcatggatgaataaatgaattaaaagaaaagtaaactggtttcatcctaacagccaaataagtaacagttctcatgaccacttttcccacagaccatgcctctaaaacatatgcggtgtgttcaccagccggcagactgatgaagacagccaacacagcacctcgcatcggctctgaaaactcaactaacaggagtaaaaggcagcacttaaacacatttaatgtaaacagcataacaccgcaaaacctgatttccaactccagggatcaggcagtgagtaacaaaaacaaaggccctgatccaaagcgtcatgactcccacgcccacggcagcccttctgggccatggagggaagctgcaccctcagggtgagcacaggcccagccctgaccgagggttaggatgcccaggcttccctggaggcccacacagggtctccaagtgctgacagcgagctgtcggggctgcccgcagcacccggagccacacccctgtacccaggaggagctgtgagggcatggggaggtctccacagaccccacccagcactgctcctccctgcaggcatcctggggagggccctcaggcggggctggcctcatgtactgctcaacacagcagcgggcgtctcccaggcgctcagcagctcagctcagcgcccagtgaagagggcggaggaaggaatgaaggcagccacgggtgaggacgagggcccagggctccactgagcaaagctcctggcaccaacccagacagaagacgtcctggagaggccagggctgtgctggtactggccgcgtccacccaggctgggcgctcttctctttcccacgtcatcacggcgttttactcaactacaggtcggcctcactgaaataacgtggaacaggtgatggcgacagccccggtgcatggtccagcgaaagcaaccccgtcccagcaataaagcccagggcctgttggggaaggagaccctgcgggagaattggaggaagtgcggctctcaaggctcccaacctcagccttttagtcgtcccaacgcaaaacattcaaaggggcctaaaaattttgctaggcacacagcgtcttctaacaacataaagtatttaccggaacaatagtcttgtgactaaaatatctgaataaaggatgaagagccccgtctactttgggctatttagaagcctggaacagcgatcccagccctggcccctgggatcctcactcgaacaggtcctcctccaggccctggcagggtctcagtgaggcacagaagcctctgtgccatgcgtgggtagagacccctctccgggctctgagctgctgactgcaaggcccatgtgccccctggctcctgttcgcctctggacacgggggctccgtgactggcctctgagtgggcctgagtgcccgtccgcactggcctccccacccggcaccctccgtgggacgaggctgcacatctcggtgggctgactgcggtgcagaggccataagaggaagaggcgggggggccccgaggcaggggacacagcgtcttgaggacacagcatgaccctgacccccacgacccctggcaacacaagtgccttcccgaagggcctgcgaagctgccagaaataggcagaactcggcgaggccgtgggagtggggtttcctctgggccgagtcgagggcagacggcacctgctctatcctcacgctcaggaggggcagaggccgctgggcttggatggagccaggcccaggtcttgtccagggctctccagggcaccatgctcctccctcaagaggactcctgtgggttatgaatgacagaagcccaggctgccatcctcaagcaaggcaccccccaatcctcctggccgggaggggctgctgggagcccctggcaccagcgggcttctgtgggcggtggaaggaggagagggctgtgcgggctgattccaaaactcactgggtgacaccacctgcccagggagggcccagcactgccgtccagggggtctgcctgtcgtccagtctccttgagagcacctccagctccctccagtctccacggctcttcagagggcacgggaggttctgctgaggggcgggtgaccaggcccagatgttaaaccctcccaaataacgggcatattcaatgtaattgaaacttccaccacagggagaatgagtctatggtgacggggtggcaggaggggtcctagaaggcgcccactgtgcttactggaggcctgaccccgacaacggctgaaacaggggtctcccccaggggccactgaaacaggggtctcccccaggggccacctcccagggcacgcttggatttcactatgggctgtgcaaatggcatctggtgggcagagtgcagggtgtcttctgttcagtgtcctgctgcacacggtgccccagggcacagggccgtccacctagaacaccaatagtgccgtgtggcagagggccgtccacccaaaacaccaatagtgcccctcggcagagggccgtccacctagaacaccaatagtgcccctcggcagagggccgtccacctagaacaccaagagtgcccctcggcagagggccgtccacctagaacaccaagagtgccccacggcagagggccgtccacctagaacaccaagagtgtcccacggcagagggccgtccacctagaacaccaatagtgctgcgtggcagagggccgtccacccaaaacgcaacagtaccccagttacacgctcctggtgcaaatgaccctcctctcgtgcttggtgcaaaggctgttagcaacgggccacacaggagatgctgccacgtcactccagagactcacgcgtcccgagacccaagtgatccctaaacgtctaggaggagacctggccttggagccaggtcagccagaaggttgtccaggccgggcctccccagggctgcccagtctcccgatgcagtataactctcaaggcgcgggggccgcatcacccagcactctggaaatgctgtccgcagaccacggccaccagcacatgcactctcgtggttctgactgcctgtgaatccagctggtctacaatgagccgctggggaaaatacttcaagtcctgagatgaatggagcaggaatgcctctggaatatcctgagaaacacgactccaaaccctgtcagctggttctaactgtgctcactcttataaacaggtaataaaatatgggaaagaaggcgattgcagacaggggacctctcctccacagagacgtgtccaccaggagactgaggcaaatcctatgggttcaaaaccgaagtttcactggcggctgaaaacacccagggaataacgaggaaagagaaggcaaaggtgggctgaaatgaagccgcccttctgagttcacaaaggagcagagacacaccggtgctgcacaggaacccccagggcccccgtgttcctagcgcagcagagcctgccccgcatccaggctgcatctcctggggctgtgactcctctcctgagtccacacacaggacctcacacctgcactcaccggctgcagctgcacacacaggagagcttctcacaggacaaatgcctggaccccacccagagattgccattctttgactaggacgggctccaggcagtaagaacagacattcgtcttgattagaaagcctgcaggtggttctgggtgcagccaggactgagaggcattacttactgctgagaactgagaaggtgtgaagatgcccctacctcctcgccccactcaccggggagctgcgggtctcacaggggcaggcaggaggccagagacgtccacgtctgagacaaaggacatcaccgcaacagcagagccagagctgcagcgtctgcaggtgccctggtttgcctcacgcagtaccaaattgggattgggaacccagtgatgcctgcacacatatcggctgcaccttgggagcagggcctgagcctggggaaccctagtctcttataacgggcagtggcaacaatgctgacatctgcctcggagagagatgctttcttcctgatcacggacagtgggcaaacctccctgtgctccgaggctccgaggctgctccccgggtggacacacgcgcttgaatggagagtgaggaacaaagggaactgggtctttctcccttgatgcgccgcactgagataaaaccatgaagaacgtctcccagctgcgtcccgtctgggggcagccccagagaaggaatggggggcagggaaaacaactttccttaacccaagcaacgtttagttcacacccagcctgtacgcaagaggggaagggacaggcctggggctgcacccccaggtgggtggtcccaacagaggtttaacaacctggttctctaggggaaaaatgcatgcacgagctcaactaggttaagtcatacattgcactagtgtaaaagatgtgtagcacacaactcacaaaaaataatgagatacacagtcctctacttcaaactcacagagctaattgattctcacagcaaactcttgtctctaagccaatcctgggctgcatttaaccaggatttgacaaacagaggcaacgcaccctctgctagctggttctcaaaaagtgcgtcatcactgagtgtgatatgtgtcgaccattaaaacatttctcccactcatacaaattatattaagctgacatctcttctggctttcacactgggaatgctggcgcttcactcattcatcaatgtcacaagcaactttgttgaatcaggtgaagttttaaatgccagaaaaacattgtcttaatttttttgtgctattgcagtgtaaccgctatatacaagattatttaattcagggtagcaagattagatgatcaacaaaacctttgttcaaacgtgagctcaatttcctccgatgtgtggcccatcctgatttctgtggtgtgaacattcctggccgatttcaagcgaccagtgtggccccaaagccagagagaggagagcagggccccgttcagaggcacccacacctccagaagcacccagccagacagcctggagcccagcagcaatggcgtgccgtgaaatcacaggaagtgctgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtggtgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtggtgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcacggggaagtgctgagtctggagtatttattcccttcgtcctcgcggggaaatcacaggaagtggtgagtttggagtatcgattcccttcgtccttgtggggaaatcacggggaagtggtgagtctggagtatttattcccttcgtcctcagcgtatgtgatgggattctgaatgggggctgtgtttatctgggcataaaactcctgaagattggcagcaggagtccacgcagagacctcctggagatgggcgcgctacacgagcttttgaaatgagcaagtttccagagccggcgggattgcgggggcacctgggaaggcaaagtcacctgcacccgctctgcagccccggcctgcgcctctggagggagggccccgggcagtgccagcaggaacgagcctgcctcagagccccaagtctcagtggagctccttccaggctgacatggggctgacggctcccggggccagcagggcgcccgcccgacaccaccacaacccatttcagtgacagataacttcagacaacttatcagagggccttggagggccggaggcagcaacacacacagcctgattctgggagcagcatttccttccaaaaaccttaaatcggataatgagccgggcgcggtggctcttgcctttaataccagaattttgagaggctgaggctgacggatggctcgagcccaggagttggagaccagcctggccaacatagcgaaacctcatctctactaaaaatacaaaaaattagctgggcgtggtggcgcacgcctgtagtcccagctatttgtgaggctgaggtgggaggatcacttgatcccaggaggtggaggttgcagtgagccatgatcacaccactgcactccagcctggatgacagagtgaggccctgtctcaaaaaaaaataaaaggaaagagagacacatcagtcacagatacacacacaacaaatctaaaatagacatgtgaaggcctacacaattaaggaataatattttggaaatgtcaatgattaacgtgcctttagacttaaaaaattctgctgtgtgacttattttctaacacctcagctgcacacccttgagccacagttctgctcactctcagggccacataaggaaggttctcagtcttccccgccctggagctcccagccatttgctctgatcccttctacagcaattctcttgggctccttcaagtgtaagcctcttgccccctagggaaaggaatgcctgaagaatcacacttcgacttccttatctgaaggccatacttgatggatttgaacagatttgcacatttaaattcccaaattaattttttttttttttgagacggagtttcacttttattgcccaggctggagtgcgatggtgcaatcttggctcacggcaacctccgcctcccaggttcaaacagtctcctgcctcagcctcctgagaagttgggattacaagcgtgcgccaccatgcccagctaattttgtatttctattagagacaaggtttctccatgttggtcaggctggtcttgaactcccgacctcaggtgatccaaccgccttggcctcccaaagtgctgggattacaggcgtgagccactgtgcctggccctaaaattcccaaattaattttcacatggtaaaatgttccctggttactaataacaataaataagattatggaaacaaagtagagacgatccgtaagaaataaatagggattaaaaactccaccatatatgaagttcataattaccagcacagcggtgcagggacagcccccagctcctcctcccagggcagcagagcctggcgagtcccgaatccctggtggagctcccctcaagcctcccagcagggctctgtcccctaagccttctgctccttcgctccttcctgctgcactttctgctacttgcacagcaatttctaatagttctcattagaggggcagagcagctgaaaagggtgaagaaaataagagaccaagatggcagggatgttcggaggaggagagaggaggggagacgaggggagacgaggggagacgagcggggaggagggggggaggaggggggagggggaaggggaaagctgcagagaatgaaggtgaggacctggtggaaacctcacagagggtgatttgaatacaacctgatcttccctggcatggagggcaggaggcggccacctgagccccgcacaggtgcccggcaagcccaggcagaggaccaagcagaaggtgctgtctgatccagccgcagaactaaggaacgcctttagcccctgctcccagctgcagaagagttgcccggtgacccaggaagcaggaggaaagggcaggcctgggccagccctgcacggacatcagccctgcacagacatcagccgcgcacggccgccccacagcctgcacacaggtgttcacggcacgtgtgtgggtgtcttgattgacaccacacaactccctgcttttaaagggcacgatcccgtggtttttagtgtattccgagttgagcaaccgttatcacgattgacgcgagcatttccgtccccctgaacgaaacccaccctcctcccccagcccccggcaaccacgagtccactctgtgtctctgtgggtctgcttgtcctggacatttcatggaatgggaccacacggtccttccccttctgtgcctggctgctttcactgaacgtcctgtcttcaaggttcgcccgtgcttagcccgtcacagctctgcccatcttcctggccagatgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaattaccctaggagccacccggctgcctgcccagggccgtgccttcacacctgcctgcaaagcgcaagcgttaccatgtctctacaccctcgtcagcacttgttactgtctttttggttatatatttgctttgagtcagagaaatatctgtctttaattttgttttgttttgttttatgatggcaaaatgggggtacatgattgtggcaacagttttgagacagttaatatttttggtgtaagaccagacagatgaagaaactgtctctgaagagaagggaccgaggctcctccctgcgtggcagcaaaaggtccacaacacatcactttgggtctcctgtcccaggagattccgcttccgaccaggcaggcttgccccctgagctcatcacagcgtgagtctgggttcacattgcccacactggagcatgggctgtgaaactacaagagaaaaacacctcacagcagagagcccacgtgacaagcacacatgcctgacgggcacgggcgtctctgcagcaggctcaggcagtgaacacgcagacccttgcttcctctaaattcacagggctggccctcaggtatgcgtaacaaaaagaacgccagttcccttttcctggagaaaatacaagaggttccagagccttaatctacaactccagttcaaagtttcaagtagaaggtggagagaggtgggaacattctatttttgaaggtttccctataaaatctgttacatacatatatatgtatgttttttggtggtgttattgttcagtaataccagaaatgcatggtagaaaactttcaactataggagtccaagattaaaaattaagagtagccctaaagccccatgcccatctgtagacgcactctctagaaataaccacagttactaatttcttagttttttgagctagcatttcaactttaaataacagtcccattgctatttcttagatcaacttaaaatcagctgctggctccctgctgtgaaagatgaagggtctggggccacatgggtccccctccactgtcatgtcccacatttcagtggaaaggcttccgagatttccccatttggtgtgaggtcgtgtcccagatttcagtggaaaggtttctgagctttccccattcggtatgaggttagctatggttttgtcatcaacaggctctaccattttgaggtatgttcctctatacccaatctgttgagtttttgtcatgagggatgctgaattgtatcaaatgcttttccagcactgactgaaataatcatggtttttgttctgggttatatccatgtgaccgatcacatttattgatgagcaggtattaaaccatccctgcattcctggatgagtcccacctgtcatgctgaatggtctttctaatgtgctgctggcatctgcttgctggtgtcttgctgaggacttttgtgtctgtgttcatcagagacattggcctttagttttctttttgtgttgtgtccttgtctggtttgggtatcaggtaacactaacctcactgcttgagtttggaagtatccccttctctccatttgtttggattagtttgaatataattggtattagttctttaaatgtttgaatgatccatcagggcctgggctttttctttgctgggagattttttgttctgatttctacgtctgttcaggttctgtttctttatggccccaccttggtaggttgtatgtgtccaggaatttataaaatttctctaggttttctaatgtattggtgtatagctgttcataatagtctctagtgagcctttgtatttctgtgctatcagttataatgtttctttttccatccttgattttatttattggggtcttatcttttttttttcttagtctagctagagctttgtcaattttatcttttcaaaaaaatcagcttttcattgtgttgatcttttgtctcttttgtctcaatttcattcatttctgctcggatctttgttatttctttccttctactaatttgggggttggcttcttgattttccagttccttgtggtgcatcactaggttgtttacttgaagtctttctacttctatgacataggcattcattgctataaatgtccctcttagcactgcttttgctgtatcccataggttttggtatgttatgtttccattttcatttgtttcaagaaattttaaattttccctcttaatttcttccctgacccactggtcattcgggagcatgttgtttaatttccatgtgtttgcatagtttccaaagttcctcttgctatggtttctagtttttttgattgtgttgagaaaagagacttgatataattttgacgttttttaattttttgagattgttttgtgagctaacctatagtctatcctggagaatgttccacttgccaatgagaataatgtgtattctgcagctgttggatgaaatattctgttaatgtttgtcaggctcttttggcctagagtatagtttaactccaatgcttcttgttgatttttctgcctggatgaccttcccgttgctgaaagtggggtgtgaagtcccctactattattgtattacagtctgtctctctctttagatatattaatatttgctttatatatatcggggtgctctggtactgggtgcatatatatttactattgttatatcaccttgctgaattgacctccttttgtagccctcataaggcttatgaaaaacattcagtagttataacaagttattaaaactgataccaacttacctttgattgtaaaaaaaagagacaaaaccatgtacatgttaactctcttctcctcccatattttgaatttttggtgtcacaatttatattttgatattgcctatctcctaactaattgttgtggttattattttattaattgtgtctttcattcttcttacaaaagatagaagtggtttacacaccataattacagtattagtatgacaatcacattagcatccttttcctttggtttgaagaactccctttagggcttcttgtaggacaggtgtggtagtgatgagtctcctcagcttttgtttgtctgagaaagctgccatctctccttcatttctgaatgatagctttgctgggtacactatttttagttgacaattgttttcctttagcactctgaatatatcatcccactccctcctggcctataaggtttctgctgagaagttgctgctaggtatattggatctccccaaaatgttgtttgcttcttttctcttgctgcttttgacatcatctctttgatctttgagagttttttgattatagtatgtcttattcttatttgggttgaatctgattggtgacctttgaccttcctgtacctgaatatttctatctttctccaggttggaaagtttgctgttacttatttgaataggtcttcttctgccttgtttttctcaattccctttttaactctgatagcttgaatatttgttcttttgatgttgtcccatagatcttgtaagctttcttcatttcttttcattttttttcttttttcttctctgtgtattttcaaatactctgtctttgagctcactgattcctccttctatttgatcagttctgctactaatgctctctctttcatttttgcatttcattcactgtatttttctgctctaagatttccatttgattttttctattacttcaatctgttaactttctctgataaatttgtaaattcagtctctgttttcttgaagttcattgagcttcctgaaaacagctattttgaatcctttgtctgagagatcacacatctccatcatcatgttagggcccgtctctcgcaccttattttatccatttcgtaaggtcacatttgcctgaatgttcttggtgcttgtggatgtatgataatgtctgaatcccaagagtcccacagagagacttttgactgtgcataggtacagaattcttgttgttgtgggaaatatgagcaggttaccttcaattccaccactcaataaactaaacatagcattaccatatgatccaccaatttcactcctaggtatatacttaaaagaattgaaaactggtgtgcaaatcaaaacaaacacgaatgttcatagcagcactattcacaatagtccaaaaaggtgaaaacaacccaaatgtccatcaacacatgaacggataaacaaaatgtgatatgtcatttgtggctgccaggagatgggaagtgattacttaaaggatgttcttctggggtgattacaaagtgttgaaactagagagggatgatggctgcacagcattgtaaatgtgctaaatgccactgaatcgtacactttaaaattcttaaaatgctgaatttcatgttatgtgtattttgcaacttaaaaaaaacatgtttacctaagtattgatagaggcaacattggcaaatgtgaatgtgtttagtacacatgcatcacattctacctgacatccttttttggagcaagaaagggtataaataaatacttcttttagagcttatatttaattgtattatttttatttatgcattttgttgggctataatatacactcagtaaatagagctcacacgtttagatatgtgcacagccacacagtcagtaccgagaccgaggcgcgggctcccccgctccagaatctcctctcatatcccgccccacctaaagcttagcactcttcagagttctagagtcaccctattcttacatctcagctcaacagaaccatgcagtatgtacttcatctgctgctctagtagggggttaaaggtgatgctattattctacctttcattttaattcatgaaatgaaataattttataagcggaatttactatttagtaacccatcagtgaagttcacacaggaaagtcaggataaatgcttgattattcccttttatttactgggttttcaaataatgacttggctacctatcatcctccattggtgaataatttggggcttttcagtaattttctgcaattattttttattgagatgtaattcacatatcatacaattcaccctttaagtgtaaacacagtggtttttagtatattcacagagctataaaaccatcaccactaactccagagaattttcatgacccgaaaaagaaaccccatacccattcccactcccatctcccctccctacagtccctggcatccattaatccaccttctatcactacagatttgcctgtcctgaacatctcacagaaatggaatcacacatgtggcctcctgcacctggcttccttgatgcagcctcatgttttctagatttttccatgctgtagtctcagggcttcactccttcctgcggctgattaatggagacttgtttatgtcatgcacacaccttcacatgcgtccactcacactcacaagtcatcaaagagctcaagcagcaggcaaggctcaggagaggcactctgagggacaggatgatgggcccggctgtttccaaaaccaggtggcttggggcgactcatccaacctctccaggcctcagtttccccatctgtaagctgagtggctgggcctcaggtgaccctgggtctctttccaactccacaattctgtgatttgagcaaataagtccaatcctgagttttgtctcactttctaatccagtaaaagttaagctattgtgtttacttgactcagcagagtgtgtgggggcagagcaattatgacataaaaccacgatcctctttggtactacaagctaatcaacgttaatttttcacacaacgactgggaaaatctgcctacaggaagatgccaccctgggtggcactggtgtgccgggagggggtgctctccaggtggccctggcggcatcggtgtgctgggaagggggtgctctctgggtggcctgggtggcatcggtgtgccggaaaaggggtgctctccaggtggccctggcggcatcggtgtgctgggaagggagtgcgcaggcccaccccggcgtgctgcctgggagtccacgttctcgaaaatgcagggtgaccctggcgcaggatcgggtctgagagctgctcaccgacccatgcctcctctagcaaatcgcctctctcacagtcacctcaacagcatctcagccgttgtccgacactgggtgattctgcacgcccggctcggaaccctgtgcattgcccatctgtgagccgacctcctgcctgaagccaccttctcatagcgctcagtactggggaccctggccgggaagtttgcacagagtatgagctctggctgaccatccatgtcctgggtacaactcaccctcctccgtgattcaaactgttccagcctggaataacccgattgctcctatgggaacaactgctcctttccagccaaatgacccatttcccaaacgccttccctttccattctctaaatactgtagcaccacactgactagcgtgcgggtctccaccacagttatgaccacccttccctcctcgtcccccaaagcactcaacagctctccagcacccaccgaatgaagcactgacccttcagccaggctctggagcccctacaagcaacgtccgtctgtgtccaggccgatctcgctgctccctcggacgtactcgccctacaccccagccaaacgcactccgtgtttgccaacatgtgcgcctttgaacatgcgttctctccgcctgcagtgccctcctctgtgtctcaatccttcccgtgcaccaggccactctgagtctgctcctccacgaggctcccagatcacccccaaagccaccacacctgtccctgagtgttcatggcgtcacagttgtcactgaggctgtggcacttccccttccaccaggcacagcagctatagttgtgtgcacacatcccctcctgaaccgagcagttctccgcagatatgggctgaccaaatgagcatctttagagctaactgggaactgtccaggggcgagaggcctgggtggtcttagtactgtcactcatctctgcttcagttaacttgagcaataaaataccctgcagataaggtcagacggcaggtgccagtgtgtcctgaaaagccgcaagtctacaagcagccggcaacctgcccggctatgctgtgtgcatccccacagggcgccaggagcaaacacccaaacacccatcctattcccgattcagggcaatggtccaaaagacgccatcgctgctacatgagacagaacgtcacagcgaagaggcaggcagcaaatagatgcctcagggcgtttctcaaagaaaggcatgatgcagcctgaaaaccccaccagaagtgtcttcctgaagcatctaaacgccctctgagttccttctcccagaagagagcagttacatgaagcagcaatcacagaacggaagtgcccggccacaaaggctgccgtccttctcctcgtcccagtccatcttacagaatggctcccctctgcagggccacacagttgcccgggatgcagacgctgagacgggagctgatgtgcaggtttctagggcaagaggcgggagagagtgggcagccgacaggacgggggacgcagcctatgcggagtggatgcctcaggaaggccctgcctgggtctcaaggccccaccatggggtcttgtctcattcgtgaccctgtgcacgccgtgcagcagtgcagacggccggggccccaccacagggggtccagggagaccaccagcgagagagtggatacccctgggaacaaagcgggcccagatggagacctcagacaaaggcagctctcagccctcagctgagcacgccgaggggctacagcccccatccaggcccaggccggctgccagcacagagaggcccaagtggaccccagggccaaaaccccaagtctgggggctgcaggggagcacggcacctggctaaagacacagcacacagggctacagcgggcagcctgtggtcaacagctcatcagcgacgagccaggcccagccaagacagcaggaaaaaaaatcaaacgggaggccatgccctctaccctgggggcagagctgagaggacagagaacaggcggacaaggcaacagggacccaggtgcgggtcagcaggcgctaaggatcccagggtctgcgtgcccagccaggcctcacaccagcgacatccaggggtctgcaccagagccatgggggaacagagacacgaacaggtgaaagttcagcagggctgcaggcgcccaggccagccctgaggcagagacgtgaacaggcgaaagtgcagcagggctgcagccctgagacctggtgggctggggtcaggacgttaagggtgtgtgtgtgtggaatggggctggccggccccctcccaacaagatgtaggaaaccccatggccgggatgaggggaggcaggaagggcaaggggcatggaggccggctgagagtccagaggagagaccagcccagacccagggaagaaggaaccccgtgggatgtcccagacagcaaggagagaggcagtggaaggcacaagggcgggagaaagacctcagaagggatttaaagaatgaagaaataaaagctctgaaatttattttaacagagctttgggctacactctaacctttgcttcagcagcacaagaaaaagaggctgcacagagtggccccgcaggccagaaggcagcaacgcccactgatgccggaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacccctccttttctcaaggtcagaacagcagtgaaggtcagagccagaagcacagcagacgctcccaagccacaggcagctgctgaggcctgagccggggacgaagctcctccctgcatggggacacgcggggctgcagccactcccaggcctccatcacacagggacggtacagaaatagcgtgtcttgtgggtgggtgctgggtcggggagggagggcgactgcctctccctttccaggcacatttggattccccggggtgtccgggaatgactcaggcctctggtcagcgcttctcagacctgtgttcacacagcgcgtctccctcctttccctccctgcctgggacctaagtacggctctgtttaaaactggcccaaatgcagggtcagcgcctgagatgcagcccccacagcagcccccccacagcccccccacagcccccccagcccccccacagccccccacagcagcccccccacagcccccacagcagcccccccacagcccccacagcagcccccccacagccccccacagcagcccccccacagccccccacagcagcccccccacagccccccacagcagcccccccacagccccccacagcagcccccccacagcccccccacagcagcccccccacagccccccacagcagcccccccacagccccccacagcagccccccgtagcccccaccccacagcccccccacagcccccctgcagccccccacagcccccacatgctccactcgatgctcacacgcacagttttatctccttaactctaatgctgtttaaaaactattgtcctaatcaagcaagaaaaactgcaggtttgcaaagcgtctgctctggaagagcggcaggccagggtggagagaccacactgccacacctgaacacagcaaggctttccaaactctgcgcaataggaagacgccgaatggtaaatggaggagctcgcaggagacgcagctctgactctgccccgccccggcccgcggtgctgagggcgcgccgatgtggatgcctctgtgccagcaccagcggctgcccctcggccccgaccctccccactgcgtcctggggcaccctcagagcttcggccatggggtgcacagcaccctccaagcattctgaaaggagattttagactcttgtgcgcaacacccaggagccgcccgcctgcaaagcacttggtcagcgtggcctggaaaggggaggaaggtcctggaggcagggctctgtcaggcggaggacgtgatgctcagagcagccagggacccccgtctgggcccagtccccctgcgctgcgccccacggctggctggaagtttgttctggaaaccacctccaagacaagtgcagcagccggccctagcagttgggaagaaggcggctgacgtggcttccatggaaaatgccagaaagcacatcccacaccaggacacctgggcaaacagcctcaactcggaaaatcccaggctggttcggtctctctgctgcccggacctgtttaaatgtccagccgtttgggaactgtgtacccttcgagaaacactccaaggccccagggacaccggaagccgtggagcccgggccccatgcgtctgtgttctcgccacctggagaggctgctagtgactgacaggtggactgcggggcctcaactgctactgagaatgccacacaattttaaaaactcagaaattgcttatttttagaattttccatttaacatttttggaccacggctgaccacatgtgactgaaaccgcaggtgagggggtgagcgtcagcctgtgtcaggctggacacacctgggggcctgaggagcagccgggggtgtagggacaggggctccccacacccacatggatggcctgtgcagtcaccagcaaggcgggttctgcaggcctgtgtcccggccaacggcagccaccaaacctctctgcacttctgttacagacaagtcagagaggcccagaaaaagggaccaaaattgaagaaccagggaatttcagagggaagggaagggaaaatccaactggcaagcagacccctgggccatgtgctaggaaggggttctgcccagcgaggtctacccccaaccaggacgggtaggcagtggccccagcaccccctgcacccccacggcccaccaggggactgcacctctacaggaaggacagaggcaggaggaacccctcagggctggagagttgccagccactgcccgtgctgggccccgccctgagacagtgtctaagcaccaccccatggacaatccgaacctggaggggcctgatcccggccctgacccatgccaggggccccagccggcactgcacgccggagatccgggctttccttggcaaacacgcttggctgtcctcgtttccaagtcagccctgttggtaaaacagtgaagccagcagtgaaatacacgaaacccgaacagccccggagttggaactggaagcttccagggaagacggcagtgtctaagtgtctcccttaactgctgtggctgcacccggggtcctgggggtgagaggcttgtgggccctgaagtcacctgctggattccaaagtgggccatgccaatgccgtctggaaaacatacggaaaatgtcattcccaggaaatgtggcacatcattcaccctggaccacggcacaaggaaatcaactcaccctggaccatggcataaagacagacggggccctctcatcagaaagtggggagcgggggtctcagtttccaaggaccccacaagcgacgtctacagggtgaaagaccccgtgcccagcaccgaaggacctgcccgacacacagtccccagccttgagcggagacccccagactgcatacaactgtgcaaatgcacttgacctccctttggttgtgagtcacaggactgtcttaaaaagagtgtcttcttccagtgccagaaaacagagagacgggggctgtgaagcacaggatccacagcgggcgggtggtaggcgggcagcaggtgggcggtaggcgggcagtgggcaggcagcgggctgagaagcagagcagagccccagccaggagcccagagggcggcagagcagcgggcaccgaaccagactgtcggacctgtgctgggggagagcgagagtgaaggaggaagagagacggagacagagagacggtgagagggagagggacagagagggagtgagagcgcttcccacaagaagaaccaagctcaggtcccaccctcccccagagcctggtgcagctgcgtgggacgggcaggaggtgcgaggggccctgtctctgacgttttgtgccagcactgccctctacacacaaactctcaggaaccatcacgaccccattttgcaggagaagatgctgaggcccagggcggtgagcaggccacatggccggtggcaggggcagaagtgggactgcagcccaccaggtggtgtcacagccaaggctgcggcgtcactgcctgtcctgcctcacctacccccagggcgacgctcccgactaaaccacctctgtcctatggtctccggggcttcctgacccctggggagggcggcaaagcctgtggaggctggagtcctgtgggctggggacgacgggaagaccaagtcgtctgtataatcgccgtgggcgcagccggcagtgccacccacccacccacaaggcaacacggggcctgagtccagccccaggcaggtgggctcccagagttggggtccctgaaccaaaccacccctgctgctcgctcacccctaagagtgaggctgcgatgctgtcagccaaggacactcacgtgggcagctccggtgcagccggccccagggggagaaatgcagctgtggctgtcgtggaggtggctgtggccaatggccgtgactgttgctgtgtctggcagagaagccaggtgcactggctctgtgcttcaaggagacctagagggtctcccccaagtccaccggaaatgtgtgcacattcgccctaccccactgtgtacctggcccaagtcgggagagatgcccaagagaccacagccagcctcagcacagtgaaggctgccctggcccttcggggtgtctgggaagagcctggcattctctctggggtagctctcacccttgcaaagcacagagaacaccaagagccccagacacacactacatccaaagggaaggtcgggcggctcccagacgggggacggggggacgggggacacagaaccaagccgccgaggagcacctgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgcgtccacactgccccggccacggacacccacccccgatgcgtccacgctgccacagccacggacacccacccccgatgcgtccacactgccgccggccacagacacccacccctgatgcgttcacactgcccccggccacagacacccacccccgatgcgtccatgctgccacggccacggacacccacccccgatgcgtccacgctgtcacggccacggacacccacccctgatgcgtccacactgccacggccacggacacccacccctgatgcgtccacactgccctggccacagacacccacccccgatgcgtccacgctgccacggccacggacacccacccctgatgcgtccacactgccacggccacggacacccacccctgatgcgtccacgctgtccccggccacggacacccacccccgatgcgtccacactgccgccggccacggacacccacccccgatgcgtccacactgccccagccacagacacccactggtgatgcggcctgagatgccaccacaccctggccagaggctcagtccacagcccataccccatgacctgtacccacaaaacctgcagctagcaagaaccggcctctgcctgaccctgtcatcaggggcgggaactccggtggcgggcacacccagcgcaattacagggcgagcatccgatgccctcctagtgggccggccacaaagcctctcatcagccaccccgtggagaaccacagccaaaagcctgaaccgcacaagatttggcgtctcaatggcaccttcagaataggagaaaatagcaaatcgaaactttggttttccgttccttatttacgactcaggacaagactgcctgagagagcagcagactccaagtgcaggctgcagtgcagtgtctgttctggagggggggctaccgcctccccagcccacacatgctcacccctccctccccacacacacgttcacaccctccccacacacgctacccactcccctccccacacacgttcgccccctcccctccccacacacgttcacctgagcattgcccacaccagcgtcagcagccctcacaggaagggtggcccccaggctctcggccccccgagcccagcttccatctcgggccataaacaccctttggccaattggcgcaccctcctccaacagactatgacctccccaagccccagaatccctggagatggagagcacgcctggcccccagtcagggcaggtagtctccagggccaagccgtcacctcagaagggtgggtggggctctccccaggaggagggcaggtccgggactgggaggacgacccccacgcaagcccccaccctgcccttgggctccagcctcatccccagcagccgccagccctctgagatgccagggtgccatggaccctgcactgaggggtgctcactgggcagccgtgtgaccagcaagcagaggcaggttcacagcagcagtggagctctccagaggcaactccaccaaggggtgccgcagagctctgtacccccaaatttatgaggagcccggctttgggaggggacacctaggggaaaagggctcaggaggcctcagccaaggaggagcagcactggcagcccccctcctccagcacggggacagggaccaccggcatcgaagctcctcacctgcctcctgcctgacaaggccacaggcacatccggggccagcactgaccagacgctccctccgcctcgcttcacccagcctgaggctggacgggaggcactggcgtctgcagcacatccacagcattccagaaacgacagaaaccaggccaggctctgagcagcccgtccgttgtcctgacacctgaccatgacggcatatttacggtgtcttctcaatctttgaaaaatatttttaagagaacatgagaacaaatcaatattccagtggcctaaggaagtcagctagctgtgaaactattacggtaagctacacagtgggggaatcagcgtgggggaaaggaagcgggcattccacagtgcaagactctgacacacagagcgtcttgcacccgccctgagctgagcagtcctgaccctaaagagctgccattcctctggggccacggcaggaaatcgcaggcactgagtgggaggaagaggatgaccgggtgttgggatgggtgcacatcgcagagcggcacacggcagcctccggatgggcgcatggcagagcggcacacggcctctgctgtcttttccgatgaactttcaataatacatagaaacatatgggtttaatgtttcctgtgtgtgtttacagatgtgtgtttaatattgaatatgtgtgcgcgcaccgtatctccacggagcaaaataagaatggagagaaactaacgcaaagaaagacgctaacgtgccaggctttcagtggggacaacttctcattcttgaaaacttaaaattagcttttccaaaacatctataaagcaacagaaatgcttacaaatttaacagcatttgagattattgtaaataaaaatgataggtctaatttttcttttgccaacatttccttcgtttatattgacagtcaactcattacgtgtaacaataatggcaatttttcctaatgaagtttaaacataaaatataaaacaatgtaattcggagctttgtaaataaatgcccattttacttagcgtaggtgtagaaattcacacccaagtcccacttagaacacgcttcccgctccggagcataagcccctggcgtggggaggggttgggctctgtctgaactgatcaccaccactgctttattaattgtttttggcttaacacctgaaccagctgggtgcaaactatgacacacattacaaaaccacctgtccatcctccaggcacatggaaggcacacggcccacagaaaccaaactatatgctgcgtcccatttagaaagctctgcgtatgtttaaaattaaaagtcttataaggaaactatttttctgtattttaaaatgttcttaattacaaagaaatagatattcattctagccagttaagtctccaggtagaaaaagttaactcttttccctccctcagccaggcccccccagagccacatctggcaaggacggcttggtgtgcacgcccacacctcctctctcgtgcacggccacatctggatcagatgtgcaggcatttcaacatggcagtctccatccagccacggtctgcggacagcgttcaggctccagccttgaccctgggcaccttgaccctcacggggtacgtggcctgtgtgtctgcctttgtgtcctggtcctcgcaggggacaggcctgtgtgtcccacgttcgtgtcctggtcttcgcaggggatgtggcctgtgtgtccctccttcgtatcctgacccttgcgggggacgggcctgtgtgtccctccttcgtgtcctgaccctcgcgggggacgggcctgtgtgtcctgccttcgtgcaccctgacaccatgggtctgattttcccacgctggaggtctgcttctgaacagctgcatctcctcctgcaggggaagctgtctgttcacccaggtgcctgtcctgtctgagggctgggctcttcctacccaagggttgggggctggcctgtccctcatgacccaggcaggcggccagggctccccggaactccaggctgctgcgggtgtctgctctgccctgggtgaggctctagaagattcctgtggaagcgactgtgtctaggggagcccattccccagtttaaaggacgtccccccccatggctatccacatgcccagtcctctcaggaagttccaggctgccaggatcagaggaagcagaagccgctgtccttcagcaggaccctgcaaaagcaggatgaatcagcggggccattcagaacaaggttcaaattactgctgcacttttcagaatggagccaggctcagtgtttcagaaccagaggctgacgcggatcagctcgcacccagcctgggacctgagccagcccctgagtgccactctccacggccgcctcagagggtaagcctctccaagcctgcttcctcgccggcatggtgggggtggccctgccatcccctaggggctctgcgggatcccctgaacactacgaaaaacctgagccccactcctggccactgggtaaggacctctccgagcctttctccttcccattcactcccacccccaggcaggagcgaccagtgctgagaagtcctatcatcccacaacccatcatcctccgtcatcccctgtccgtcaccccgcagctgtcatcccccatcaccccgtgtctgtcaccccgcgtctgtcaccccatgtctgtcaccctgcatccgtcaccccgtgtctgtcatccccgtccgtcaccccatgtctgtcaccctgaaaccatcaccccatctgtcaccccacatccgtcatcccgtgtccatcaccccgcgtccatcacccccatccgtcaccccatgtccgtcaccccatccatcaccccgcgtccatcatcccccatccatcaccccccgtccgtcatcctccgtccatcaccccacgtccatgatcccccgtccgtcaccccgcatccatcaccccatgtccatcaccccacgtccatcaccccatgtccattatcccctgtctgtcaccccgcgtccgccatccacatcccatcaccaggtgctgttttcttggtgctagagcaaggtgggattcacaccttgtgtgcacagcttctgagtcactgggcggctgggcacagcctaactcaggagcagggacccacggagggtgtggcgacgacacagccctcagcttgctctccaggagttcttctgatacctcgaggacactctggaccctgtgtctgggtcccagcccttccgtaacaacgtggctcctctgaatcagtcacaaggaagatccaacttaacacagagagtttttcccaaacagcagaactggcagcaacacaggcatcctgcagttcagtccactgcatgcagcgtgcaggtgtcggagggcgaggctgccgtgggctcccggcggacggtggcagggcaggcccaggtctctatcacagcaaggcctctccactcggccccctccacctgtttacaacctcaagctgggtcaaaaccccaggggtactcagagggagtgtttctccccaactggattccttaagccagagggcaggcggcagggtcctggcctgacaaacacacacgggcccccgaacacgaccggctccgtgaccgtcacaggacgttcaggtggcttcattttcagtccacgcctctggtgccagggtcttgcttggcacttgtgtgaacggcgaccacgtgaagcctctgtcttgagaaaagtgtaaacagcagctgcctttcaaggcactgaggccttcctcgaactcagctcgtttgtgctgcgtggttcccagtccaaaccctcctgttcacagcctcctcttgcctcaagcatcttagagctccactccaatccacaccccagctgccttttacaaaatcccaagccaatgacagcttgaaaataaagtgagaaaaacaccgaccaacatttactcagcacctacggtgggctgcggacgttgacacagggtcctctctaatcttccatacagatcagccatgagggccgcggagaggagaaaagcacagctgagctgttttctcttaaagcaacataaacgtcaaagcaaaactggagcccaggactctctgacttaagctcatcctccttctgctccatcccggctgtgcacacctggagaccaggccctcgagcctccaaacgccgtgagcagcctcctcctgctgtggcttccaaagagacgtcaccagaggcggggctggcgcagggccacgaggcaggcgactgggtctctttgaccgggggtggcctcgcggcggcacgagactcagcatcgtgtgggtctagctctgggaatcgaggcagcccccagaacacccttggggcgcaacttcccggtgaacgtcccgtctcctcagccacccacagatgctgccacagctgcaccctcagggcaacgagcgtctggcggagcccagtgagagccgtgaaacacagacctcagggccaggccctctccccatcacagaaacctgaccagtcacaggtggctgcagcctgggtggttggtaaaagaaaaattattccttctataaccagaaaaaaatagtgaatcaacagacacagaaatgctcagaataaaacaaaaaatctaagtcagtgggacagaattcagcagtccccaggggggcctggaagctggacccctgctctgggtctacgggcttacatggctgccaggaccagggagagacagacccgggcccctgaccataccctgtgctgtaacgcctgcaaggtagattttaagtaatttaaaaattatcaaaaggataacatttcatgcctgtgaacattacgtgcaactcaaatctcagtgtctgaaataaggtgaaatggatacagtccggctcactggacggcaccgtgcctgcggctgcttccctgcacagctgcatgacccctggccctacacaggacaggttctgcgcactcggccgccaccttccttacacggcttctcaggaaagcagcaggcagctgtggcccagcgtgagccggcaaagcacttccctcccagagccccgtttcctcatcagcaacaaacacaacaagcttcctcccctggctgctgtgaggaccgacagcccctcctggcacctgcacagggcatgacacgcacatcacagccgccttcacccgctcagcctcccgcgtccccacagcccggaccggagcctcagagcaccaggacacacccatccggacaccggcaggtttgacaccacagactgtgcttggctggggagtgagaatcctcctgagagagccacggtgtcccaggtcgggggcagcagagtgagggtctggccgtgggccccggtcgggggctgagccacgctctggtcaggaaagacatcgccagacacctgtcataatccagggctgctcaaagtaaaaaaaaaaaaaacctaaaactgcaacatggaacggcacaaacgagctgcaggccgagttctaacgggctgagcctcaaaccagctgcaggccgagttctaacgggctgagccacaaagagctgcaggccgagttctaacgggctgagcctcaaaccagctgcaggccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagcctcaaacgagctgcaggccgagttctaacgggctgagcctcaaacgagctgcaggccgagttctaacgggctgagcctcaaacgagctgcaggccgagttctaacgggctgagcctcaaacgagctgcaggccgagttctaacgggctgagcctctaaggagggaaacgtcacttcctgcctcacacagagcccagcgtctccatgtccactgatagccttggtatttgcaactatgtccatgaccatctctgtttctccaaaacagcctctagctacataaactgtttagaaaacctcatgcgtaaagcagagtatgtcaaacctccatctgtggtcaggagttaggacatccccagctgcaatttgagcaaagacggcgcttccagaggatcatcggatcctgtgtcttggttggggttggggcccatcaacttaaaatagcttctgtttatgctggtgaaggaggcacagacttcaccctatctaattccaaggaacaggcgagggtgggagctgtagcggaagagacaaaagcaaaaggcagattcgcccctttgtgtggtcccgtaagtgacactgtccctccctctccctggaaacagcagcccccaggcaccccccccagcaactgggacaagggcacaccaggctaatttttaatcagatggatttagtgatagcaaataaagagaaggagaacaaaaccctcagccaggctattgtgaatgggtgttaccaaaaaatggcattagcagggcaccaggggccaggccagctccaggcagccccgcatctgctcagcaatccccggagtcttctagggggcctggggcagccggaacctggccgggtggaggatttctaccacgagaaagtcagggccctccccgaaggagcagaagctctgcgggtgactgtttgggaagctggtctgctcctgatactctgcaggaagagaatcacactctttagaccggggtctcagatttcagccggacgggaactctctgcagggccggtggaaagagatcgccagccccagctctgtaggggtgcggcctgcctcgagcacttcacacgcgtgcccggggatgctggtgctgcaggtatggggaccccgctaggagagccccgggttaagggttggtaactggagaatggggtgggggtatgccagctctccctgcttgccctggtcccacacactcaggcctgtgtggccagcgtggtcctcctttcccacagccaaggtgccccgactgccagcgtccactccccgtggggccgcagggtacaccaacatctgaggcagaggcaccgctgtgggctcatctctcagctcaaagggtttccaagagaatcctcagcaaaaaagcaacactcgccgttcagagagtgaatgagaggccagcagggggctgggaaggtgcttagctcagggagggctggagggtgggactaggaggcactaaaggcctgggggctcagagaaaggcccagcccatcccagcagaggccgaccaggactccagagcccgtggaggccctgccatgcacgggaagcctttcccgacttgggggcaggagctggagggctgggatgatcctaaggggatgctcggccataagccacatgccaagtccagagcccaacagctgctgtacctcctgggctgtttccacggatgaggcttctctgaatgtaagtttgtctgctcagccacaccggcctcctcctggcacatcgtctctcacaggcacctccttccatggagactgggggcctcagacggctcttcccgacagggccctgcacttgggcagatgcacctgtggcttgagctcagcacagcacatagtggctggcaaggaacggaaggagaattggagaaatgtatctaaaatgtcaagcagacctctgctacactcactgggaagaaccatgttgcttctgacgaatttcttaaaaagagagaaagatgccaatgagaaaaccagaggggacaaatgctacccgggaatgtaaaacagttgccatcagagactggctggctcacattgtgtccaccaatccacccaccacggcgagtgatgtccgtacagctcacaccgcatccatcaatccacccaccacggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtatagctcacaccgcatccatcaatccacccaccacagcaagtgtctgcgatgtctgtagtgtctgcgatgtctgtagtatctgcaatgtccatgcagctctcaccatgtccatcaatccaccccaccacggtgagcgtctgcgatgtccgtgcaggggagagagacctggcctatcctcagcacagcccatgtgacgttagaaaggcaaccgcaaattcagctgcggagtgcaaaacgaatttcctcctgtcacacgctaactttctgttctggatttcctggggtttcctttattagacttgagtccagaactcctctagaaacattctctgggatatcttgacctggcacgcagaggggtgaaggaacggggacacggatggatggagggagatgaactaatcagcaaatgctccttgcacatttcctagctctgtcagccaaagtgaggtctgaccacaaaagctacccattcacttgctaaatggtgcaaaatgggcccagaccctcattttacctttacttaaataacagcatattctcgtctggtctttaaaccacacaggccaaaatgagttgagcactatcacatatttaattgactcgtaaaagcaacttgtttttcttcatccttcgccgacctttgtttatgggtaacccttgataacatgtgggcagggtttcagtgtaaacccgagggcaggttaaacacgctccctccaaagcttacttggctttgatttttcaaccacccgccctcatgtgcagggacagggcagagtcgtgaccaacagtggaaagacccatagctcccagctccagggacgacgcgggggtgctaagctggtaagctgggaaattcccgggcacgacccctggccgtgggtgaaagcacccccagccccacccccagctgtgagatgctgcaggttccccagccccacccccagctgtgagatgctgcaggttccccagccccacccccagctgtgagatgctgcaggttccccagccccacccccagctgtgagatgctgcaggtcccggcaggagaaggcttctccacagagaggccgctgaacaaggcacagggccaggtctggccgtgtaaaaatacttggaacccatggggggctttgtgtgtggtgtcatcggcagcttccattatgtccagcggtaacatgtttacggtccctgtgccgccgtgcggtagcagttttcccgagtgtctcctggctgggacggctggtgaggatgtgagttcaatagatgaacaccccaccttggtgacacagaggctggacagtcacaccgacccttggcccgggcgaggccacgtgtcccacaaaacataaggcttgggttagtgtcgggcacgcgggggaggtgcctgcctgcgtgaagactggtcacaagacaacttcccagtttagaaaatggttaactgattcattaatactcacttcctgtcgcaagagactcatgccctagagataaagccgtcggaggcagagtgcaggcctcgaagcagctggtcatgtccacgccctctgcaggcctcgtgtccccctcgctgtcgcctgccgatttggtggctcctctcataacacacagcctcctgtgtatgtttttaccctacaaacgctctctaaccggtccagaggtcagaaacagccgcagtctcctacctctattgcttctcaagggaaaagcacagcctggaatgatgaggagcccccacgccttctcagtctcctgtaacgacgttgctacagatgtatgtgtttgtgtgaagctgtatttaaatgtgagattattcttcttggttaatattttactttctgtcataaccagcaggcttaaagaagaaacccaaacgctctgtgaatgggacatgtgctcagaggcgtctgcagttgaggcgggtgacgttctggggtccctgggaagttgtcatcaccctgctgacatgagtgtggatgttgaggcctggagggtgacaggtcacacagccagagcctggcagcagcgcaggggcggaaccccgggtcccctgtgggcctgtgccctctcggccagccttgcaacgcgcagctaacgctcttcaagaaaacattctctggaggaatcctgctggtcctgaagtttttggccttgagaaggtcatcacagacacccctcccctcgggccaggcctgctgtcttgtctaaggggccctattttatctgaggtgatttgcaactctgaaacacacatacataaaatagaaataccgtcctcactattaacctagagacccccatccctacccctccctatgaatgctttttcataaacatgccgcattctgaggaatccgaaagactccagcgtaggacagaccgctgttccaagccactgggaaaggggaaactggtgactgagcggcgcccgtcagagccattaaaacgtgagggaaaactgcaccttacggcacacgaacccttagaagaggcaaaacactactgagttaatgcttaatttatttgtaatgataaaagtttttatcactttaaataaagttatttgaaaaaagttattcaatggcagcctaataattttgcttaatgaaaaattaactctgcaaatacagtttccactattcacatggagcctgcaggtttggagaatcctctgcatcagtgtgggtgagcacgtgtgtgaggggtgcacgtgtgtgaggggtgcacgtgtgtgaagggtgcacgtgtgtgaggggtgcatgtgtgtgaagagagcacgtgtgtgaggggtgcatcagtgtgggtgtgcacgtgtgtgaggggtgcacatgtatgaggggtgcacgtgtgtgaggggtgcacgtgtgtgaggggtgagcacgtgtgtgaggggagcacgtgtgtgaggggtgcacgtgtgtgaggggagcacgtgtgtgagggatgcacatgtgtgaggggtgcacgtgtgtgaggggtgcacgtgtgagaggggtgcacgtgtgtgaggggtgcatgtgtgtgggggtgcacgtgtgtgagggatgcatgtgtgtgaggagagcacgtgtgtgagggatgcatgtgtgtgaggagagcacgtgtgtgaggggtgcacgtgtgtgacagatgcatgtgtgtgaggagagcacgtgtgtgaggggtgcacgtgtgtgaggggtgcatgtgtgtgaggggtgcacgtgtgtgagggatgcacgtgtgtgaggggtgcatgtgtgtgaggagagcacgtgtgtgaggggtgcacgtgtgtgacagatgcatgtgtgtgaggagagcacgtgtgtgaggggtgcacgtgtgtgaggggagcacgtgtgtgaggggagcacgtctgtgaggggtgcatgcaatgctcctgtatgcacatctgtgggtgagcacgtgcgtgaggggtgcacatctgtgggtgagcacgtgcgtgaggggtgcacatctgtgggtgagcatgtgcgtgaggggtgcacatgtgtgaggggagcacgtgtgtgaggggtgcatgcaatgcttctgtatgcacatctgtgggtgagcacgtgtgtgaggggtgcacgtgtctgaggggtgcatgtgtgtgaggggtgcacgtgtgtgagggatgcacgtgtgtgaggggtgcatgtgtgtgaggggtgcacgtgtgtgagggatgcatgtgtgtgaggagagcacgtgtgtgagggatgcacgtgtgtgagagcacgtgtgtgaggagagcacgtgtgtgaggggtgcatgtgtgtgaggggtgcacgtgtgtgaggggtgcatgcaatgctcctgtatgcacatctgtgggtgagcacgtgtgtgaggggtgcacgtgtgtgaggggtgcatgcacacacacctgtaagcatgtgtgtgaggggtgcacgtgtgaggggtgcatgcacacgcacctgtgtgcacatgtggatgttgccgtgtgcacgtgtgcacaccaagtgtccgtgagtgcacgggaacagccgtttagaagtgccttaatcttcccgagcacaatagtagctcacctctgcaaggaggctgaaaattctcattatgagtctcataaatacgtggccacgttcatgggtttgtcttatttatcccttactctataataacttggaaggcacagccaatatttcccttatatcctgggacagccccagttcatggctcccgacgactgcagctgcctcctgggaaccccaggggggcaaactcaggcccacccccgcctgtgtgactcaaaccccccagccaagtgcctgtgggaggacattttagtgggtggggaagcttctgaaaaatcactttactctaactaatatttgtaattaacacatcaagtaaaactaaaagcttttgccttgccgttgttgccttttggtgggtgacctcaaaaagtcatccatctcacactgactctatcacatcccaactctagccccaaatcctaataaacacaccagttaagaatgcatggcacatttttacaagcctcacaactttctgattagatgcatagaaatgtcccaaatatttctgaaatattttatttgaaaaccgatgtcaccgccacttttaagccacaggcattacactaaaatctggactagcgtctaagcaagtggcagcttttgagctccgcacactccgtgtgaccatccacaaatctatgatgaattattaaccagaccaggctagcccactgcctggccttctctgctgaaagtcagcagctgtatcctgcctgaaaaacaccagcattcttgtgttcataaaacccgctggttccagtgcagctacccagagggaagccttgggtgtgggcagcgacaggggtgtgggtgccaccgtggggtcccccagaaggaaaccaggggagcacagaactaaatggtcacccatgacaatgaatcgtgatctggtgggaagaaatcaaagtgcttttatttggagatgaaattggctgcctgcccctccctctccaccccccgctttcctcctgacccacccaccccagctcttttccccggcctgggaagggcacatggagggcagaaagggcttccctaaagaaaacacagaaatacactttataaagcaaaataaacttaaaaaaaggcacttagcaaaaatgtagtgagaagtgttttttcctttccagtctttcattttcactcagcatttccataaacacattcttgggtccaaatgctgagaaactctttctctaaatactggaggagcgctaaatggagcaggaaatgatggagagagaaaggaatgccactgattccagacggatgggaccagctggggaattcaggaagcggtacggaggtcccggagacaactgctcacgcctctgaggggccgatcgctcaggatcccccagcagcagcgagagaaccagcagggcccccctcccctctccagccaggcgtcgatcagtgcccccctcccctctccagccaggcgtcgatcagggcccctccctctctccagccaggtgtcgatcaagtcctcaccttctctccagccaggcgtcgatcagggcccctccctctctccagccaggcgtcgatcaagtcccccccttctctccagccaggcgtcgatcagggccccccctccctctctccagccaggcgtcgatcagggccccccctccctctctccagccaggcgtcgatcagcgcccccctcccctctccagccaggcgtcgatcagggcccctccctctctccagccaggcgtcgatcaagtcccccccttctctccagccaggcgtcgatcagggcccctccctctctccagccaggcgtcgatcagggcccccctcccctctccagccaggcgtcgatcagggccctccctcctctctccagccaggcgtccatcagggcccctccctctctccagccaggcgtcgatcagggccccccctcctctctccagccagacgtcggtcagggcccctccctctctccagccaggcgtcgatcagggcccctccctctctccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagacgtcggtcagggcccctccctctctccagccaggcatcaatgccgttcaaggggtctggaccaacaagccctggtggagaacaatccccacagagaaactccgtgtgaccctgccccacagataacacggaaagggacttttcatggtcagaacctactgatctagaagtgatcaaacactctcttctcctgacttcctgtcaccaggcacgggtgaggaggaacaccagcaatttcttactaattacggctcaagcaccaatgtttgtccaccgttttcttctcacacagatctaagaggatcaagatgattcccagagtaacatctgtctcatttgaattccagtgtgcttccccgagtggcacagccgagctagtcttgggctctggaacagtccaaagactggggactcccctgtaacatgcagccacctaagagaacaggtcagtgacaagtagggggaaaagctattaggaaaaagaacaagttgtgggcctaaaaacaagatgtttcttatacaaatacaaaatactagaaaattgcacagcagttgccagaaaagatcccaagttgtggaaagtagaaaggcaggtgcatcccagcactgcggccgggggcaggaggccacccgcggggcattcggacccccgtgccccaaacacatcccgccgagcctcctgggaccaggcccctgagagccacggggctgtctggagagtgtccccagcctcagccatgtggggtagaataaaaatgattaagaactgcttgagaagttttaaactgcatgcagcctactcagcacagattggcccgtgtcttctgccacggatctcggctaaaggaaaagccaacagaagcccaccggagcctcccttacctccacccaacactgcacatcaagccgtgcaaccctgccccaaacggtcccagggtcatgggtgtgcatacatgtgcatgtgtgcaagcatgtcacaagaggagacctccgaggaacataaggatgcggactcctccctcagcctgaacctctgtctctcaggcacagctcgacctttgaccttcggcttccccagagaaagactttgaacgcttcactcctctgtagccctgaggacgcgggcggccagaccagtccctgagtgcggcaccatggccgtgtgagtttatggcccattgcgctagccctgtacagtgaatgagatactagttgtttacagctgtgagcatacacaggccccccgccacacgctcaggaaggagcttctcggaatctctctcctgcctcgcaccatgcagccgggctagcaggtttgtgggccgagtgcaggagcctgctcccactgtcactgcaggtgactggctgaggggcacacagggcccagaggctcctacctccagccaccgcccctaaactaatgaagattccagtccgtggggcccaccgcaaatcccagaatctcagcagtcagtcttggacattagttgtcggggagggagaggatctgggaggccaggcgtcccttccaggctgcgcagccggccacggcggcagagcttccccaggctgctccagccttcagggcccctccgcggtcagccccacccccggccagcaaggcttcctgagaaggctgagcttggcacctacagactgggggggatctggaattccccagaaaagccctcatcccaaagcccatgggaaaaccagccctgttggagcatcccacccggacctcggaggagagtccggcatggccagtcccctgggctctgcatgcagatggttttcccagaaccggttcctcttcctgaatctctgctaatggccctgtccatcagtctgaccccagccttggaaacccccatgcagcctgggccagaatgaagtaggcaaccagaggctcagggtgcttggggccgaaccacccccagctccaccacctccttcctgcccccgagccgtgccttcccccgctgggtgggcttgctctgcatctgggagcacctgggcccgggggtgcaggtgggttcgcccctgcccattggagggaaatgttctgacatggaagcagagggcacagcattcaggagaaccagtggggcctccacacagggggacgcagctaggaagggggtctccggccggtcggccccgagtgagggacgcagctaggaagggggtctccggcaggtcggccccagccctgactccaggcctgtgcatctcactgctgcccaaagcaaggaccactggctgccatgacagctgccacagtgctgagcaggcccagccaacgctgcatgagaaagggctctaggaaggaaaaggccgcggcagcacccagcctcctttctgaggaagcgattccacgagccacaaaagcgcctgggctgtggtcatcagagtccaccacaagacaaccttcctgggtccctacaccctggacacaccttcggtgcgtgcccggcatggagacgctcctgctgccggcatggctttggggacagcactttgctcctggagcctcagaggaggggggccggaaacatgtgtcctgcacagtcaccaccggacgccgaggtggccgccccagcaggggccatgggctgaggctggtcctcaggctcccagagcaatggctgctctggggaagagaaaacacagaagtgacaagatcaaggcaaactagctgctccagcacctcgagggtttggaaccaaaacaagaaatctccagagctgaaaagaagagtgaaaccttttccttcagaaggaacacagctaaagagaagatttaggggtgcacgcaagggccctcaggtactctgtgcagcccctcaaagcagggaaaaggccaggaatgaaacctaacgcagaaatgggaactggctccaacgccacacgaacagccagcctgggtctatcgcgcccagttcagacccgggctgcagcttggagacgatgacgtccaaaaaccaagctccaggaagacacaacaacaatcacccttaggctttgtcaggcatcccagagaatcctccgtcctaccctgggcacgccatgcgcaccaggcagggagggtggctctcagcaaggggctgaggactctggcccatcctggggcgagggaggcacccacggggtgggccatgcggggctgggagccacggcccccatgcaggtcctaagtggacatctgtctggtcggtggtcagaaaaaggatccccacggtgtctaggaaagactcagacctcttaccaacctctggaattttatcctatgggcagtcagggccaagacagatgattctttacaggttggaaattattcggataacataaaagaaacaatgtaaagaggaaagaacaggtgcaggagtcgttcctcgatcaattccaggtcaaggcaccggtttcggtccccagtgcggctcctgtctcctgacccagccccccggcccagcccccagaagcccggcacggtgtctctcgggacccaggacacgcaggtcagcgctgcagccgttactggctgtgttgtgataccagcagggcactgactgtccccagaaggaacaaaactgagacttaaatttgggtgattgttccaaatgtgggattcaagcttatttgaaaacgaaaactaagaatgccaaatttcagggtggctagagctacagccccaggaatccagccctgtctgcagaaacacacctaatattttcagacactcatagaacaaggaactactatttttgagaaaatactcacagaaaaacaaaatctcccagacactctgatgccgtttgaccaataacccatggggaaactcacttccggggatccaggcccgacgagggcgttcccgggcacctcggtgactctgaaactcatatctacagcaaagcttgaacgtttgtaactgttcactttggactctgcgtcacacccagagagaccctgaaccatctgtcacaggtgacgtaaccctcagttccccttcacctgtgccagagcctcccagacacaaaggctggagccccaaaacctgtcaggggcctctcaggggccagccacaactcactccgcctgtcactgctggacgcccgctgcggcctgacggagccgctccttcacctgtccacatgcatttcccacacagcacattgtcttgaatgaaggcaagttattttctttctcggccttggcgtcctccacagccgacactgttcttgcaatctgtgaagggatgatttctaagctccgcctttgttcttcactcactcacccaccgtatacatagttgcacattgatgcataatagacatatacttgctgctacggaaggccttgtattcctgtctctcttcctaccacagcactcctgccatcccacaggtaatccaattagcaggctgtgtgggtcttatccctgatctgcgcacactcatctgatctgtgtttatcattcttctagggggtggtgttgggcgctctcattttgcttcttttgaatcttatgccgtggaacttcctgcgagtcatgtggtttggcctgggcttaatatgttccttgaaagccacagagcagcccacatgtggatgcacatgacataatcaccgtttcagttggcgattactcattgggctgttcttgcattgctataaagaaacacctgagactgggtaattcaaaataaacgaggtttattggtcacggtgctgcaagccgtacaggaagtatggaggcatctgcttctggggaggcctcgggaagcttccagtcatggcagaaggtgaagggggagcaggtgtctcacacggcgagagcgggggcaagagcgcgaggtgggaggtgtgccaccggatctcacgagaactcactcactatcgtgagaacagcaccaaggggatagcgctgagctgttcatataaatccaccctcaagatccagtcgcttcccaccaggccccacttccaacgacggggtgacagttcgacaggagattggtggggagaccccaactcctcaacattgcttctactgtttgctatttgctcactcagccactggccacaggtgctgctgcagtagacacgtctgttcatcgccttcacctatggttcaaagctagaagctctggttgcacggcaagcccctcctttcctgcgtgaacacagacccctgctctgacccgcggctgcgtaagacgagacgcgctcagtgagctgcctccccgacccccaccacagttccacaacggctgtccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgcggggcatgacaccacatccccacgggaccccgtgtggccccttctgtcaacccatcggccagaggcccatccacacgtcccactggcccctccagctaacttatctgggcccctcaaaggccaggccgtgcatctcataacaccagcccaacccaaatgattccttcccttcctgagacctcactctctcttcaggggcaagttcaaagctacccctcccagaccccctccaagatgacagccaaaaccaaagccacctctctcttcaggagcaagttgaaagccatccctcccagacacccagatgacagccaaaaccaaaaacaaaagccacctctccagagtgtgagctctcccggatctcaacaccctcctacttattaaagtgtagctctttttcaaattatatatttgcttacatagaagtccagttcattacagacgaacagatagcttcaaattctgctagaataatacctcccatctatgaagatctgagcgggggaagtgcctggtgcatctaagtcccattaatctctgcaaaagaaggccttggcctccactttcacaaaccaagaaaccaaggcagagagaggttaggggtcatctaaaatcaaagaattgtcaagaaacgtggccagcacgcagtctcgggtgtctgattccaagtgggttcgctacgtccacgtctcccccgagggcccccaggagctctcctcctcaccaagcccctcccaccatcgctcagcagccttcactttcaaaaccttagcagccatcactttgcttgtggctgtttccagccaatacgtccacctcctttctaaacacacacacgtctatgtttaaaacatgacgcgccacctgcaaacacggtgccacagcctcagggagacgccgctcatccactctgcgcctgcgcggttcacacgctccttagctccaaatgcctcatttgcttccattagctccaaagaagcaagtcaaagtgttttccaccaatgccagattcccttccaggaatgacgcccccagggctgcctccggggtccacactctgcccaccagtccagcaccctggctgagtccacctgccaggcaccatttgctcacacacctgaaggctggatgggtggctgtggccctgcttaaaggatcacctctgcatctccaaactgtcttcccagcacaccctgtgtcttgggcctcccaggccactgtccacccacacagaccagcagccccttccttccttccctgcctgaacactgcctgcctcgtgtccctaaggtcaccaacaagtctctctgttctccagccctccatgattccccccattccaatccaagatcacagagaagaaacagctctccaaactgacaggcaggctgcagtggtgagcacctgtgtcccagctactcaggaagttgaagcaggaagatcccttgagtcctggagttggagagttggagaccagcctgggcaacacagtgaggcccagtctcaaagaaaaaaaaattaatggacaatactaagtggtgaggagaagaactcggatcccaggagcccgtggagctggggtgcttgggcccagataaatccgtgggtctccctttctccacctcagtgccgtggagtttccagagtttagataaaatgagataatacatggaaacgacgcccttagcatctgcatccagcctccacacccacacacgcacaagaaacccactcccctttccaggcaaggcccgggccccaggctgaacctgcccctgccggagcccctgctgtttcccaggtgcagccaggccctgcaccttcgtcctcaggggttaaaaatagcacaggcagcttagctgagctcggttaataaaatatccaagttaattttagcattaggggaatctaggatctctgatgccaaggcccatgtgtggccacacagcccctccttacactgtcagacagacacggggaaagccacggcgtggccagtatccctccctcaccttcacaaaacacttctcttacctgagtgagccctagccctctgaagacactgttgctactttctcttattaaacagaccatcacctaatttgatgcctgtaacagccctgtgaccagcggcctccacctcccgtgagggagtccatcaggctgagagtgtcagctgccacttctagcagagctgggcccggagcccttaccttctagcccaggagctggggccagggaggcacagtccaggggaccctccaggcaccccacttgtcattctccctattctcacccggtgccacctcctcctgcttcaggtgggattctgtttgtgatcaggagagggatagctggggctggaggccggcagcccctggccctcactgccccacaggcctgcaggcaccagcggttcaatgttgggccagaccggccgtgggtcttcttcacggacaagctccagcctcacaggaagggagcaagagcccagcggagccacaggcactgagcccagaggagaaagaagggagcgaccagagagccacaggaagccccagcggggagcccacggcaggcccggcctcccacggacggcattcccggacgctgaccgcctccagctcgacggcagggtcaccgcggtgcgagagcctttcccgccctggaccgcggggctggctttttttttttctgtaacagattgagagaaacaccttgtgtgttgctctttattgaacacatgtatcaagataaggcgccacatttaaaaacaagcagtaagtattgtggaaacggaagacatcactgcgaggggaggaggcactgcacgccttgggggcgggggccccaaaacaacgccgtggccgtggcggaagtgccctccctgtgggtccctgactcatggaaagtccgaagcacaggcttcctcaaagcagcgatcgcataggaagtgtggctcagtcatgcatgatacacagactctactgtgaaaggttaatgactgtttcaaaagacacagtgtttaagatgtttaagtgcacagaaggacatatccaaaatgattccacaaaactgaaatgcagaaagccagattcttcaagacaaagactccaaattgttaccaccaaagcacctcacttctacgtggcgctctcctcttattacctcacctgcaagagctggaaggacaaagaaagaggaagggggaaaggaggaagagattctttccatttttcccaatgtcaacgtctgaatgaggccacacaccaccacacatttcaaagctatttaagaatttaaatggccaatgcccctataccttaaaaaaagctcccaatccccccagaaatgtgctggctttttttcttagtaagagtagtagcagaattgcttatggtataactttagggacaattcttgttctgggagtgagggggcagggtgttaacttaaccctgaacaacactgccttgtacgttcccaccggatgtagtagacaataattgcctggcttttgcaaacggaaaaatgaggttatgaaggggaagacacgggccctgggtcatgcagcaagtcactggcagactcatgggcaaatccagcgctcctggagacaaggctcagaggtgaatgacagcgaggggccctcaaatcaaccacaggggcaccatcttgtctgagccttcaagaccagggactcaggcagggcaagtcagagccaaggttggccatgaatgtggattaaagaaagagcctgaggggctcagtggccccctggcaccagcgccgctcagggtcatcctccacttcgcttctacagatgggctttctgctggagccccggggtatcaggccagcagcacagttacatgagactaaccccaaaccagcgcacccacaggtcaccctcagggtctccagcccagactgcatctctgctcaaatgcaggaggtgccctgtctccccagctacttggggcacagatacccctcaggcagccagccctgcaggtgacctctggaggggagaggaaacggggacttcttgctggagccacatccagagagtcgggcagctggcatttgggcctctctacccgtcctcactgctgctgcccctgggagggtcaaaggttcagatgatatccaggccccacgtgggattagcagcctaagcctcagctgagccagggtttcactggcttgtttaaagtggagcacagagcctgaccaagttgtggcatctccaaacctccttctctccgagggatcctccagggtgcctgacccccacgcctgtcggaagtggggccgagtgcccgcaggccggtgaagctgccttctgggagactcagggtctgagtatctggtctgagactctggtcttccctcgccctcctgttctacttcccatgccttctgtaaagtcctgccgtggcctgaagtgtagcccttcctggagtacacagcgagcatgctgtgccggctgtgggccccccacccccgagccgcaaagccccaggccgcctctgcctgctgcctggagacctggcactgccccacaggggcacccacctccagccctcctgcccccgtgactgaggaagcccagtgcttctcacactcctcagactcgctggctgagccaagcagccttggctgaaggaaagagcagcaaactgacccccacgggccgcgacctttccccacccaggcaaggcgacctcaggcacttcagggagcgccagctctggctttcttgtatgaaagtgacagcggatttaaaccacattaacaaaagaaatccctcctctctggactactcaaagcggaagtgctgccacatcctagctgcagcgcttctgggccaaatatcaagacagtgtctcagcgatgatccgcaaaccaaaataaagccgacaggaaacagcccgctggtttaggggagctggaatgcctccggcagcatcaaatgtcatcaacaactgacactcagcccgttcccggaggcctcttcacacgggaagaggccggctgcgaagtgcggctcagtgggggagaaggaccgtggggaccgcgacactgcaggccctggaagcctctccagcctgaaccgcgctgtggtccagcacactcatggcatgaatatggaacagtcactccaggaaacggtcttgctctgggggagggggaggacttccacatcactctcccaagataaaacaaccagggaaaagcagatccctccagataaaccagaagtccagacacagcctcctctccggaaacgcctccgggagcccacttcagaagctgctgaagcccagagaaaaaccgcagcctcgcaggccctggtcgccaccagctcgcccgccacttctcagtggaaagggacgtggtgccgatgggtccggggtctccccgccccgcgggagccctcagccagaacgccccaccagcacacacgcacacatgcacacacacaaacgcgcgcacacacacgcgcccacacacaaatacacacgcgcgcacacatgcatccacacacaaatacgcacccacacatgcacccacaaacgcacgcgcacacacaccgcccacacatggacacacaaacacaagcacacacaaacacgcgcgcacgcaggcacagacgcgcgcgcacagcagcagcagcgcgccggggcctcacgcccctggggagaagcgtgaaggagcctccacattccccggaaaggaagtttctgggcgcagcggagaaagggagatgccgagaccccgacgtcagtggatttgacacctgaagtgcaggcgcccagacagcctcaggcgcgcgcactcctgcaaacacgcggggcacacgctcgggcgcacacgcggacagacgtccctcggcgcagggaccccacctcctccgccgctaccagggaccggggccgctccgggcgcagaggaggcgcagggagccgcgttaccccggagccgactcgacccagcccgaggcccggggaggcggggaggtggggaggggccgcggagccggaccagccgttctccggggagcgcgccgcgcctggagggcgtctccgccggggtccccagcaaggatctgcggaggggaggcgggcgcgggagaggacagggtcgggccggggggtcggacgcgtggctgccggcggacactcaccgatcttgatcttcacgctctggaagacccggagcccctcgtcctccaccgccatgctgcgcgtccgcgcccgccgagcctcgccccaagcgcgcgccgagcccgggcagctcaggccgagcaggaggagcggcggcgccggagccccgagcgcggccgagggtccgcccgcctgcaagaccgccagttggccgagggcgagggcggggaccgggaggctccgcccgcggcccggcccctgctcccaactggcccgggccctgcaggggcggggttggcagggacggcgctggcgggtggcggagacccggggggcgcagggatcggcttcccccgaggcctcggcccccgcccccgccccgcggattggccgctgagcggaagggaccccagcgggctgcctggcggaagagacgaaggaaggtcgccggcgcggcccgggcccgctgagcgaggctgagcgattgactcgcggacgaactttgccaagagaagttcacgtacaacgatctggcaggggaggaatcccgcgcccagccccagctcctgagatgcgatccgaaggcacctgctgcagacgcacgaggggggcggggacacatacacgcacacacagccccccaccccagacctccggcatgggcaggtcccccccccaagtccccctgcagaccccagcatgggcaggtctccccccccccagtccccctgcagaccccggcatgggcaggtctcccccccccagtccccctgcagaccccggcatgggcaggtctccccccccagtccccctgcagaccccggcatgggcaggtcccccccagtccccctgcagaccccggcatgggcaggtccccccccagtccccctgcagaccccggcacgggcaggtccccccccagtccccctgcagaccccggcaccggcaggtctcccccacccagtccccctgcagaccccagcatgagcaggtccccccccagtccccctgcagaccccagcatgagcaggtcccccccccaagtccccctgcagaccccagcatgggcaggtccccccccagtcccctgcagaccccggcatgggcaggtccccccccagtccccctgcagaccccggcatgggcaggtcccccccccaagtccccctgcagaccccggcatgggcaggtccccccccagttcccctgcagaccccggcatgggcaggtccccccccagtccccctgcagaccccggcatgagcaggtccccccccagtccccctgcagaccccggcatgagcaggtcccccccccaagtccccctgcagaccccggcatgggcaggtccccccccaagtccccttgcagaccccagcatgggcaggtccccccccaagtccccctgcagaccccggcatgggcaggtccccccccagtccccctgcagaccccagcatgggcaggtaccacccttacctccctttcttctgtctcgaggtctcctcctccctgacctcctctctgaggagtatgtttgtgtgtgtgtatgaactgtaggtgtgtatatgaactgagactacactccctcctctatgttgcaaaacttcattgcacccagtgccacacacacaccctacacatatatacacacatacatataccacacatacactacatatacatatacatacacatagacaccacacacagacaccacacacatactacacacgtgtacacacatacatatacacacatatacacacaccctacatacacacaccacatatacacatgaacacatatgttcatatacacacaacacagacagcacacacatatactacccatacacatgcacagacatacacactaaacatacatacacacacctacgtgaacatacacaaacacacacacactgcatggagaggaacaggagcttcatgaagatagaggcctatttttttccactgcttaccttcacttcctaaaaagcagttccatgcgttgaaagaatgaatggcctttcttcccctgactgctgggagcctgcagccacaggggcctctctcatcctcagcccttgcaagcctggtgctcactggggcagaacaggaggttaaggcggcacccctggttccaacccagagcctctgcgtctagcgctggccctgggtggcgtctgcagtgggtgctgtggacgccatccacacccctgctttacgacggagactatgcttccgtttggagccactggaagcaagccggctcctgtgtttctccgaggaccagtggagtcctctgtggcagcccagccacaaagctgcttctctgccatccctccaccctcacaggcctgctgataaactcaacgcggatctcgctttggtgtttgtttccaggcgacagctggggtcaggagtgaatctccagactgcagcagtggcagccaggacgggagccccttggaaggaaatgcactggcagcggcaggatctcgggtgctggagagttcgggaaagtcacagatacatggactatggaatcaggtggctcgtgttgagggcaagataatgaaaagatcaccacctgaaacaaaagggtggcacgctaacgggcctcctcagtgccacataagacactcatctcctgtgaccagaggaaaaccaaaacactggatcagggccaggacttaaccgtgtagaaggcagagctccagagaaggccaggtgcttggcctcagaaggtgttgttccaggttcgggtgctcggcctcggaaggtgctgttccaagctctggaccctgactgggaagaagagaggccctgactgggaagaagagaggcttgcgatggggccatctgaatgaatgcactcaaaaatcttgaatcccagattcctctaaatctgctgggcctgaagaggtgtcacatttctgtctgttaaggacaaatgctgtttctgtgcttgaagacactgcagagacctctgcaaggcgacacgcctgccacccacctccagctcagctcctccaggtcagcatcatcaagctggagaagtgctgaggctaaaaactgaggaagagacagtcggccaaggagcttcaggaccaaaatgcatgcaccagcatgagccaggggtaaatgcagaactagatccaaagaacgttggattcaggggaggcagaatgtagagttagatgttagaattcattgacatgggcgcattcagtcatgatacagggtttagcccctgggaggtgctccgtgctgctagggtggcgttttcaactcgtaaagtaaagcaatgtcccacattaagcagctgtctgtcaggattggaaaaggcactcctggggtccaggctcactgcaccggctggtggcccaggcccagacgtcagcagggctggagcagggcttctctggtgctcctgctggcggctgaggtgcacagtcaccctcacctcccggcaaatgagcactcctctcccagtcatgatggagaaaacacgcatctccctgactcactccttaacccagccgcaaacttcactgggttagcctcggtccatttcactcctacatctcgaaactgtggtcgtctttacgataccacaagaacctggggggcggacagtcccagagaaaaagtttgtgctgcacaaatggatgctgggcatgaccagagtgccccacagacggtcgactcagaccccacgtgcatctctccccagtcggtccctaaaacccaccctcagtgcttatccaggcacatcggagcaaggtatctgtatgtggggcccccagccctctgagaggcacaggggctgagcatacatccagggctcccgcaacaaaacacagccccgcagagctgcccaagcaccggccttctcacatttgtgttctaaatgaaggatttggtcattcgttttctaaattagaaagttgtctcttagagctgtgataatatgagctgggaaataaaatactgagagaagaaaggatcagatgatgacccaatagaaaatctctataatttcttctttcaatgaccttggtgttacactttgctctctttggatatactcttctgttcacatatcaacccattgacaagtggacattcattcatttccaaaacagcattattagatcatgtctgaacaatctactttcaaaggatttgaagccacataaatgaccagtacacaacggaataatttttggagggttcaaagtaagaactgaaggaagaacggtggaatcaggtatctgaacctgaaagagcccatcctgccaggtgcatcccaaggggctcactgggcctgaattcaaaatggaggcacgcgaccttttgctcactagaggtcacacgccagctctgcgttcccggaagtgctggaaatttcacagctgtctgttcatgctgctggaatcaaccaaggccagaaaatcccaatttgccctctggaccaaaccaatagactgctaccaggctctaccaaacagaatgaagcaagtctgcctcccttatctgcataaaggccagaatgagatcctgggcaggaattcccttgtggaagacaatcgcatgtttcttctctggaatgcacctttgttttgttccaaaggcagcatctcccagtttgcaaactgcttgctggaataatgtctctttcccctttttttttttttttttgagatggagtttcgctcttgttgcccaggctggagtgcaatggcgcaatctcggcgctcaccacaacctccgcatcccaggttcaagcaattctcctgcctcagcctcccgagtagctgggattacaggcatgcaccactatgcctggctaattttgtatttttagtagagacagggtttctccatgttgaggatggtctcgaactcctgacttcaggtgatccgcccgcctcagcctcccaaagtactggggttacaggcgtgagccaccgcgcccggcctgtctctttccttttaaaagaaatttttttagtggatttgttgacacatgtaaggtgagaacagctgaacgtaaagctacacactgagcttccggatagccaaggtgaaaagggaaatatggaaatatgaatcttacacaagtcacattatctgataaaaggaagcatgtcagactttcaggaaagacagtactttagcccacaaggcaatacaagaaattttttagggaattcttttcaaaaggaatattggacaagttaggggaggatgtttttaatctcaaatgacactcactacagggcctagaacatggtaaatgctcaatgaatgtttgttgaatgaatgtagtaaaaatataacattaaatcataattctcgcataaaatttatgtaggcacttagaagtcaaagaaagtagctttctagtgacctgatgagctgcgaaagaacacatttggagaatctagagagatgaataaatagccaccgaagagtctttctcaaacattagttgagccacacaactgagagaagcagacaggtccactccaagattcctgtggatgccgaggcctggtggtctgtgttgttgatggacaggagacgcaatgctgtgctgggtttatcaactacagtcggaggctcaggtgggccttaccacggagcatcatggtctcgctctcatcttcttgaaatgcagagagagaggaaagaagcagcctagacccccgagtcatgaagcagacagcagtgggtgtagacacggtggcggtgggtgtagacacggtggaggtgggtgtagacacggtggaagtgggtgtagacacggtggtgggtgtagacatggtggaggtgggtgtagacacggtggaggtgggtgtagacacggtggtgggtgtagacacggcggtgggtgtagacacggtggaggtgggtgtagacacggtggtgggtgtagacacggtggtggtgggtgtagacacggtggaggtgggtttagacacggtggtgggtgtagacacggtggtgggtgtagacacggtggaggtgggtgtagacacggtggtgggtgtagacacggtggcggtgggtgtagacacggtggaggtgggtttagacacggtggtgggtgtagacacggtggtgggtgtagacacggtggaggtgggtgtagacacggtggtgggtgtagacacggtggcggtgggtgtagacgcggtggaggtgggtgtagacacggtggtgggtttagacacggtggtgggtgtagacacagtggtggtgggtgtagacacggtggaggtgggtgtagacacggcggtgggtgtagacacggtggcggtgggtgtagacgcggtggaggtgggtgtagacacggtggtgggtttagacacggtggtgggtgtagacacggcggtggtgggtgtagacacggtggtggtgggtgtagacacggcggaggtgggtgtagacacggcggaggtgggtgtagacacggtggtgggtgtagacacagcggtggtgggtgtagacacggcggaggtgggtgtagacacggtggtgggtgtagacacagtggtggtgggtgtagacacggtggaggtgggtttagacacggcggtgggtgtagacacggtggaggtgggtgtagacatggaggtgggtttagacacggtggaggtgggtgtagacacggtggtgggtgtagacacggtggcggtgggtgtagacacggtggcggtgggtgtagacacggtggtgggtgtagacacggtggtggtgggtgtagacacggtggaggtggatgtagacagggtggtgggtgtagacaaggtggagttgggtgtagacacggtggtggtgggtgtagacacggtggtggtgggtgtagacacggtggtgggtgtagacacggtggtggtgggtgtagacacggtggaggtggatgtagacagggtggtgggtgtagacaaggtggagttgggtgtagacacggtggtggtgggtgtagacatggcggaggtgggtgtagacacggtggaggtgggtgtagacacggcggtgggtgtagacacggtggaggtgggtgtagacatggtggtgggtgtagacacggtggtggtgggtgtagacacggtggcggtgggtgtagacacagtggaggtggttttagacatggtggtgggtgtagacacggcggaggtgagtgtagacacggcagaggtgggtgtagacacggtggtgggtgtagacacggcggtgggtgtagacatggtggaggtgggtgtagacagggtggtgggtgtagacacggtggaggtgggtgtagacacggtggaggtgggtgtagacacggtggtgggtgtagacacggtggcggtgggtgtagacacggtggtgggtgtagacacgatggtgggtgtagacacggtggaggtgggtgtagacacggtggtgggtgtagacacagtggcggtgggtgtagacacggcggtgggtgtagacatggtggaggtgggtgtagacagggtggtgggtgtagacacggtggaggtgggtgtagacacggtggtgggtgtagacacggtggcggtgggtgtagacacggtggcggtgagtgtagacacggtggaggtgggtgtagacacggtggtgggtgtagacacggtggaggtgggtgtagacacggtggcagcaccgcacggaacactcaaagcccactttctggctgtgatggccgaggagagctgcctcccctccgagtggcccatcctaggtacccttgagcctcacaagctcagttgccaacctccctgcttcagggaggggtggggcagcgggtgggacaggaaattcaccaggttgtgcagggcagggcaggagagcagagggagacgctcacgcccccgcccccaggcccgcagaagccgtgggtgctgatgaatgcccctcagcccacaaatccctggcaccttgactgtgacaacgatcgcggctgctttcattatacttaggagttgtgaaccaccgcgtcaattacttttatttcttcaaatagtttcctgtgaagctaactcatctccccagattgtctcccaatttcttcgtctgtaaaatggggctggcagcagtgcccgcccgcaggcctgtgccgggaccaagctgcgtgtgctgtgtgtcctgtgtctggcagataagaaacagtcggctagaggtagcttttctcgtggttatttttcccgagagcactggcaggcatttttcctctctgccatcctcccagcactgcacactgtgtcgggcccctggtggatttgcagatctaactcttgtacgtacataaaccacaccaggaccacagaagagaagccgaagtgtgggtgctgtccccagggagcccccgcagtctgcccaggctcagcctcctcccacccacaaggaaggctgtggattaggagagtgaggaaaatgcccttcaaaatacatgatgcataaaaaacacaaacgttcaccgcagatttatttgtaatggcagaaaactggaggcaaccttcaagctgtccttcagcaggtaaagagtgaactgcgtgaaaagcagcaagcgagcgggtgcacagtgttgcaggtgagcctcaggggaactgggctgagtgaagggagacagtctcaagctgacaaagtcacagcaacggaaagcagagcagcgggtgtcagcggtcaggggtcagggaggggcaggaggtggctgtggctggaaaaggagcaggagagatgctcgtgggatggaaatgtccggcatctgcacagagatctgcatacagggcacaactgcccagctctagacacactcacacacacactcacacacacacacacacgggacacaactgcccagctcgtccctcacacacacatgcacacacactccctcacacacacacatgggacacaactgcccaaaactagacacactcacatgtgcacactccctcacacacacacgcacacactacctcacatgtaagcacacatgcacacatgctcacacacactccctcattcacacacacactccctcacatgcacacaccctccctcactcacacacgctagcgcacacatgcacacacacactcactcatacgcgcgcacacacactccctcaatgacacgtgcacacacatgcgcacatacatactccctccctcacacacaaccttacacacaaattccctcacatgcactcacacacgcacacacactccctcacacatacacatacaaactcacatgcacacaccctccctccctcacagacacacatgcacacatgctcacacatgtcctcacatgcccacaccctccttcattcgcacacacacaccctccctcactcacacatgcaagcacacacgtgcacatgctcacacacatcctcacacacttcctcacacaccctcacccacatgcactcacacacatgcacacacactccctcactcatgcacacatacacaagcatactcacgctcatacatgctcacacaccctcccctccctcacacccacatgcacacactcgcacatgcacatatggtcacacagtccctcacacacacactcccagtccctcacacacacaagcacacacacagacatgcacacacattcatgcacttcctccttcacacacattcatgctcctcacacaaatacacccacatgcacacatgcacacagacacactggtacacacacacggacacccacatgcacacacacacaagcatacccacatgcacacatacagacactgacacacacatgcgcacccacatgcacacatacacatagacacactgatactctcacacacccacatgcacacagacacacacacatgcacacccacatatacacagacgcactgacagactcacacagactcacccatacacatacactgacacacacacccccatgctcacacacacactgacacacacgctcacacccagtgtatgtgcagctggtgccatccgccctcagggcacttgatcccatcggtgaccactccttgctttgcaagatgctgctgttgggggaactgggcaaaggggctgctgttgggggaactgggcaaagggaacaggcactctccgtgttattccttacgactgtgtgtgaatctgcaattatctcaaaagagaaccgtttaaagcaagaggactatgtgggagtggacaccagctccctggccctgtcctgctcttgcggcagcccccacctgcccgaggcctccgctgtgggaactggaacctccctcacaggaagggcgtgacctcgtgtttaccagccctgccctgagcgcagagcccttcgtggaaattggtgccttgttgtcatgagaggaaggttgaggccaggagaaacctcaagttcttgtgggcatggtgctgcctcgcggtttgactgcaggaggccttacggcggctccgagatgggtggcttggcctggagcaggacgagccagggcgagggcagctgctgggcgccgtgaccctggctcctgctgcaggctttcctctgggccccctgttccagaaccttctccctctcaggccacctgtgtctgtgcccctcaggaagcaagcaggctttctgcagaccaggctctctccaccctccaggaggcgtggctgtcagggcagctggctggcgccccactgctctccaagccaaccagcaccaggtgtgaaaggagtcaaatgtgtcccaacgtataaacaatgtttatcccgactagacaggccacatcctgatgttttacattctgttctagcttcctagactaaccttgtgtactcagcttctaaatgagtgtcgggcccctcaagtagatgccgtgagcagctgctgtgtgcacgtatgtgtgtgcttgtatgtgtgaacgacagtgtgtgagtgtaagtgagggagtgtgtgtgtgtgaggacgtgtgagagcatgtgcgcatgtgccgaaggtgccagctcaggacaaccaagcattacgtgttcaggaattttgcaagctggttgttaaacagagccattactaaaaattcaattcgatgggcttatagagtttataaaattgcacgaacccatgctctggggtcgctgacatctgttctatggaggaaatacagtcacgcaccacatgacaatgttttgatatggaggaaatacagccacgcaccatataacaatgttttgatatggaggaaatacagccacgcaccatataacaatgttttgatatggaggaaatacagccacgcaccatataacaatgttttggtcaagcagggtggtcccacaggattgtagcaccagattcttactgtcctctcccgggttagttgtgtttggacgcacatacaccactgtgtggcagtcgcctgtggcattcggtacaggagcctgcacacaggtctgtggcggaggagcgctggctgtaccttgcagcccaggcctacagggggcccggccatccaggcgtgtgtaagtcactgtgaggcccgcacagagaaatcgcccagccatgtatttctcagagtgcatccctgtcacaaagccacggtgagtgtgaacgcagggagcgctgcctgtacctcctcccacctgggagtgtctcatgccctcccccaaccccgttttttcctgagtcatttgttaaaccttggcctcgcttgtgactggcagtttgaaatgccctattcaagtcaactcccctccctggcccacgccaccttcgtgtttcctgtgaagaggctgaagggaggccatgggggcccaacgtgtgaccagtgggtactcagctgggagtggtgcacattccaactcagggtccagagctgtcaccccacaaggtcctgcctctcgactcatgcccaccccagaggtaaggaccgtctgcccacagcctgggcttccaggcgctgcagctgggaactgtcaccccacctggaatggtcccctgagatgtggctctgtcaagggctggggacaggttctggctccgggcacgtggactctcgcccacccaggtccaggacccaaggcacagaggctgggctgattcctgggggcctcgctgtgcccttcctgcacagcccctgggggatttgcagggtgtggggtctttgtggggccttgtccttcagagcttcctatttgcccctttcaaattggttgaagaaaccttggggagtcaggagagagccgagaatcaggactgagtgagaacagcgagctgccctccaaggccgcctctgactggggaggcttccgcgtggctgtgcagtcactgggctgatgaggctttccgcccttacaacacaggttcaactacaacacctcaaactcaaccccaacagctatgaaagcagcatcggggaattggaacgaaatcactcccgatcccacctctgctacatccgagccatgtctgttcctgcattcatttcctgcaattttactccccagcattcgtgttttcatgtggttctaactaaggccctagaggctacagccccacgccgtccttgcagaagctgtagctcatctccttcgctattttaattgaatgggcaccaagcgtttgccctggaccacctgtgaaaggcaccgagggagaagccatgggctcaagaccccccagccagggctcgccttaggaccctttacatatttgaagggaggccaggaaggtgcagccacagtttcattctcttatcactctgcctgcatttttcaggtttcaataagagcagatataattagaggggctctgttcctcctggagaaagaacactgcaaattacagggtatctctaatgagccatggaccggaagacagcatcactgacccctcatcatctcaggctctcctcttgccactcccaccatgactggctggatgaccaagcaggggcctgagtgttcagctacaaagacaagcagctccatgcagccttcagagaggaagagaggcaggtggctagagagccccctgtgacagatgggctggtccgggcaggaggaaggagggcaggggctggagagtccctggggaccaatggggcttcttggcctaaatgccacgggtgggagctggggcagcaggggtttgtgaggcactcacctggattatctgtcattgttgtagctcatacagtccaaggacctcagactataaatgtgtggtggtgaattaactacctgttgtgatgttatcctggtcctgtgaagatttacaaggagccatgtcacttctctgccaaaaccctggactgtcctcctgtcccccttggcacaaatcacaaagcgccatcgtgcacacaggagcccgggggctcaggcgtcacccagcagctccaggcctcctggctccaaccctctgccttcttgctttcccttcagcagaacgggtctctcccttcccggggcctttgcacattccccctgtaggaatgctctgtcttgctctctgcaggaattccctctgcagcaatgctctgtccccagggatctgtgtgttgcttctctctgaggacacctgcgagcgagatttcctcgactacacaacgtcaaataactggcccttacctgcatctgccctgctttattttcctgagtaacacgcacgtaacacgcgtcaccacctggcctgctcactgatgtgactgctcattgaccctcccagactcagtggggtgaagatatctcattcctaattgcatctcacttagcagtaataaacagaacacgaatctgcattcaacggtcgatgcttccacagtgtttcctccaatactcgagaatctgctccacaggtaaacggacttctccaactggtgatagaaatggtggtgcccgtggtggtgggaacccacacccaccctcagactccaactcgcgcatctccgcaggcccaacagcccccgctccagtggcgcagagacccccgaaggccggcacctggacgttccccttgagctattcacttaagaagaaaaaacagtccagtctccatagggcactcttctcatccattctgagaattgaaaatcaggctttttgtttgttttgtttttaacctcaaacagcactgtttctaaaccacggggagtgaatccaaatctgaagacagaatatggactgaacttcggggctccctgggctgctggctgtcagctcacctgtgcccacctaccccgtgcccacctgctttacttaccatcctggaaagacttctcagtctcagccatggcccatggcagcccaggcagcccttgccttccgctctctgcgagggagcccctggagggcggcagtggaagagacgctctgaagcctcaacagctccagagaccagtgggcagcctttccattcctgtgtgccggcctgacatccccccgcgtgaactcccttgcacacacacgaacacacacacacagagattacccacacgcccattcaaacagcaacttaataacaaggaactgaaaaaaagaaaggctattagacccaaatgagaatcacaaggtggatcccaatgagaactgtctgcagcatcacactcaccgctgtgtctgagaacaggattttccatttcggcagtggatctaaacctgatgcccaggacctgttttaagcagtgaatcaaagatcacagaagttaaagtttggcaagttttcgacgtcaaggagatggaaagcctaaaatcagtttctgaaccactaaattagagggaacagccttgctcgcgaattttccagaattccacaaacaattaagaagacccagggtaggaagcacatacaatttgttttctttgatggttaagttggtttaaggcacagagttgagaagacaggcaagaagaagcaactgttcaagccccaaggagaatcctgaaccgacccagcccccaaggagaatccagaaccgacccagcccccgaggagaacccagaaccgacccagcccccgaggagaacccagaaccgacccagcccccgaggagatcccagaaccgacccagcccccgaggagaacccagaaccgacccagcccccgaggagatcccagaaccgacccagcccccaatgagatcccacaaccgacccagcccccgaggagatcccagaaccgacccagcccccgaggagaccccagaaccgacccagcccccgaggagaccccagaaccgacccagcccccgaggagatcccagaaccgacccagcccccgaggagatcccacaaccgacccagcccccgaggagaccccagaaccgacccagcccccgaggagatcccagaaccgacccagcccccgaggagatcccacaaccgacccagcccccgaggagatcccacaaccgacccagcccccgaggagaccccagaaccgacccagcccccgaggagatcccacaaccgacccagcccccgaggagaccccagaaccgacccagcccccgaggagatcccacaaccgacccagcccccacggagaacccagaaccgacccagcacctgggcaacattctgcccccggcctcctccacttgctgggcatgcatcaccgtcatctgcagccactttccccaatgccagaatcagaaattttcaaaatggttgaatagtatttggttattttttgataggatataatgcttttgttccttctttgacttcacgttttctttgttctctaagctaaatgccagcatttaaactgtataccgagacacacaattgtgtgaatattagcttgaggctctcttaagacagactcagatatccaaaggctttgaactcacagaattttgtaaaactcgaagcacattcgcactgccctttggaacctgccttgtctacagagctaataggcaagacccagctcacccagggggctcggggatccccagccctgcgtgactttgcaacaccagctgagatgcctggttcccagttaagttactaggatgagttacagcactatttattcaaaactctgagaggcccgtgttactgctaattccaattttaacttttcttccagaatggcaggaagcgatgagggcagctgaggtttccagagctcgtgtgtagcaggcgccacggctagtgcatcatgtgaaattatgttgcttttctcaactgtgaggtggggactcaacatggtttccatcgcagcccatacaggctgctgtggttgaccaagcttcctttgctggcagggctgggtgtgttctgctggctgcagctcaccaccatgctcagaatggctcataatcatttgttgtgtactgttttttccaaagacacgtctctgagactacgtcagctgcacctggacatggtcacacgtcaacatcatacagagtggtttctcaggtagcagaaagtgacaaatgagacacggttattcttgtaaggcaactgtgaaataacagggtatcacacaaatttaggtggccattgtcttcgtctcaaattttctccttaagaaattaaaaacaggagagaaaaacaagttttcgattaaaaaacaaggagatcctgggatctccgtgggggctgggtggatcctggattctcctcggaggctgggtcggttctgggatctccgtgggggctgagtcggttctgggatctcctcgggggctgggtcggttctgggatctcctcgggggctgggtcggttctgggatctccacgggggctgggtcggttgtgggttctcctcgggggctgggtcggttctgggatctcctcgggggctgggtcggttctgggttctcctcgggggctgggtcggttctgggttctccttggggcttgaacagttgcttcttcttacctgtcttctcaactctgtgccttaaaccaacttaaccatcaaagaaaacaaattgtatgtgcttcctaccctgggtcttcttaattgtttgtggaattctggaaaattcacgagcaaggctgttccctctaatttagtggttcagaaactgattttaggctttccatctccttgacgtcgaaaacttgccaaactttaacttctgtgatctttgattcactgcttaaaacaggtcctgggcatcaggtttagatccactgccgaaatggaaaatcctgttctcagacacagcggtgagtgtgatgctgcagacagttctcattgggatcacattttcttctctgttcaggtggaggcatttcatacattttttaccaggaccagacaaccttggcaaatcatctagaaagcacagtaaatgtgaaaatgtgattaaataaacaggtgttggatttcagaatactgttttattttttttcctcaaaagacatctgcttaccaatctcagtgttactggggctgaaggccatgctctttccaatgatgggactacactcaagtgctaatttattacaattacaagtttcccttcaccactgctgatggcataatttgaccacaagtgttttgcaaatatatcacacctggtattccaggacccacttcaaccactggcttgactcagaattttccaacagggacaattagcatgtgccacctgctggaaacactagccacacctgaagtgaaaggagaatcctggaaagtcttcccctggagctaccagactccccactctcgagtctggtggacacggcactgtcaggacccctcccctcggcagagagtggtggtcggctgcaggtctgcccaccgtctgacgggattccagctctgccccagtgcttggcacctgggtgcttctgttaaacccagtccctcccagacccttcccagattaaacctggacccaggaccccgcccttagctgcattatcactgcccagcagacctgaccctaaccctaaccgccagagatcctgttaagcaggtctatggtggggcccagaattcacacttcatccacttcccaagtgatgctttactgttggtcccagaatagggtgatagcccctcagtctgccaggggcaaaggagggttcctgtgacctgggactttcagcgttgaagctggagcagccctagggcaaagtgggacggtcacctcacctggggacctcacctggggacctcacctggggatcacacctggggacctcacctggggaccacactttgagaaccacttacctggatcctttattaatcctacggtggagaaaaactgctgacattaattgtgctgaactttgtatttttattgcagacttcttccttcgagatgtatgtgcacaagagaagataacaaatgagtccccaacacctaatctggaatttttatattaagttttctctctcttagagaagaattttcaaagagtagtcattcaaaaagcaaaacacacaaacaaaaccctaaaactttgagagaccattttatgcctggagccaaagatgaattttataggctttgcttctttaggtcttggctccaaattctacacagtgctgtgttcctttccaccatcaacatacagaaccaattccccttctggattgtatgcactgaagaactttagctttatttattaactttttaaagatctctcaattggttacataacaaaccaccaccagcctagtggtgtaaaggaagcagcatcatttcccgaaattctgagggttggctggaaggttctcggggctgagactcctgggctgggctggggtggaagagggcctcactcacacgtgcaaggccttggcagagacatggcctccgaggcacctgaggtctctgtcattcactccctcattctcaggaggccaactcggcctgcccacttggcagcagaaggttcccaccgcaacagcggggacgtccaatgcctttcaagcacttcccaagtttctgctggtgtcagggctgcttttgtccccttggtcaagctgcaccgtgtgtccaggcccagcggtcacaggggaagggccatgcaggctcggtgtatggaggcaagtctgggcaccatcacaaactcaccatttcaacaaaacactcattgtttctgaactatctttaaaaacaacttttaagaaataagaaaagctatttccagagcactcaccagtgccacgtgcacacggatcatctaattctaggggggcaactgcacggtttgcccccgaccgtccagtgttagtgtccaaggaagcccctcagttccgaggtgaaccaacagaacagatcaccctgtgaggtatgaagtgttgtcctctgcattcgacagatgaggaggttacagctgcgagactgtaggcggttgcccgggcgctcttccaagtaggtagcagggccgagtgaatgagcctaggcaccgcccggtattgctgcaacagccaggcggcgctttgacttctgggtcagtgtcactgcctacctgaatcactcacttcctgtaaaatacttgattccaaattactttggtctgtattgaaaaataaaattcaagtttacctttaaagacaaagatttgccatatttaaggatattttagagaacgtgctactgactctgaagaagaggcataaaaccgccttgaggaacggcatcgtctgtgctgaagcaggcagcgcccagctgacgactgtcaatgcagccctagcaaacacggccacgctgccctccatccagggtcctgtccagtgctgtgctaagcacttcacgtggtgacagctagctgcacaccaggcacggtcaggtgcttagcgtttattaagtcgttcaattcttctgtaaccccatgaaatggatgctattgctagagctgttttctacagagaatttaaggattttgcctaaggagatgtcaccagcaagtagcagaccatggtttgaacctgtcccccagtcccaagtctacacataactgttgtcccacgggtgataggtgtgacagtcctaggctccagctctttccccggcgccacagtgcctgctgtgcttggagacaccaccctcacctgactgggagagctccactcaaggacccgcacaaaaataatcccagcttccgtggtttcctcacaccattccccgctcacagtttacctccctaggaacccaacactgttttcctgtagctcatcacttcacaaatgtattgccttttgttaaaatcgtgaataagcctctggtctgactgcctctgcggggtttttgtctcatttcgtgaagccgccacatgcatatgaagtaacgctttttctcctgttaatctacttttgccagttcaatttgcaggactccagtcactaaaaaacataagtgagtgaaggaaaagtttttttcctcaccacctgtttgttggaaagcaagtaatggcccacctggtattcttttggtcaagacacaacggggaaatggggctccggtcaggcccctcaggttgggcctaattggagcagaatcggaggggcctgggcttcttgctgccagtggcaaatgtccagtcaggaagtcacacgggcagcagcaatgccggcaagggacgcttgtagcaggaacggggcagcctcccttactcaaacaagacgcggactgcctgaggccggcagctcagagaacaaaaggcaagtgtgagggggacggggtcagtactcagaaagctccatgtgccttcctgctgaaagcaacattgaaagcacaacatgtgcatttggttaaaaacgctgagggcttgtgctgggaggcggcagtggtggcctcaaccatctccccgtccgcccgcatggcaaccacgacgactatttcctctggtcaggcatttccaacctcctcctgttattacaacactctctactcactaattttagatagagtctgtgccagacttccgactacgatagtgagaattcagccaacttgctctgaagaaatcatacagggcctaaactttctgagtccgtatgagtctaaaaatatctttattattcccacacacttaatttagggtccaggataaaagcagattttgccgagagcctagaggcatcactccaccatctccaccactacatccctccatcatctccatcactacatcactccaccatctccatcactgcatcactccaccatctccatcatctccatctctccatcactccatcactccatcatctccctcatctccatcactccatactccatcatcaccatctccatcattccatcatctccatcatctccatcattccatcacaccatcatctccatcatctccatagtctccatcactccatcactccatactccatcatctccatcactccatcatctccatcatctccatagtctccatcactccatcactccatgctccatcatctccatcactgcatcatctcctcattccatcatctccatcatctccatcactccatcatctccatgcctgttgacattttctcaggacctgcctgcacgcctcgacctctgccttggaaggtctgggctgctgtgttttctgcttgtttcttgcacacaacgtaaagttgggtttcactttgcgaatgatcccacgagtctttttgttgaagaggtgagtcgaatttatttacttatgtagactgagaggaaggatgcagtggcccttggttttgtcatatttcatgttatagtttctaaccaatcctcttttaaaaatttcactaagcattctgtgttccactgtgggtgtgtcttgatttggaaggttgatgtttttgttccaggagatacgtttgctcagttttccttccccttgtggccacacttctctgctgctctcatcgtttcatttgtgcctttcccgttttttgtctgttggtttgtctgtgccatggtgtgatcctagctcactgtcacctccaactcccaagctcaagcacctcccgcctaggccttcaaagtgctaggattgcaagcgccgccccacgctcagcccctttcccttgttaaaaagtgccttactctcaagaggctgaggcaggagaatcgcttgaacccgggaggtgaaagttgcagtgagccgagccgagatcgcgccattgcattccagcctgggtgacagagcaagactctgtctcaaaaaaaaaaagccttactctgtctgtgtctagaccctgtggggcttctctggttaagggggcctgtcctccttagatgagctgtcccaggaggctgctacttcctgcagctgctgaggctcaccctcctctttccaccactgaggcccaaggctccagttgctctgaggagtgtggaggcccgtgaggtgtgggggtgcggagtggccgtggaaggtgtgtaggggattgcagttggggttgggtgctggatgtgcaggtagagtataagggtagggggttaaggtgtggggcatgggggagattggggaggttgggaacatggggcaaagtggtgggggatgggggatgcaggggtggggatgggggatgcaggggtggggtgtggagttatggtgagtggggggctgtagtggggcgttgggggtggagggggctgtgagggtgtggggtgtgggtcatgagacatgggacagtgggggctaacggggtgggtggggtgtggggtgtgggatgcagagtgtgggagctcagggagttagaaggtcgagttagagggtgtaggtgtgggggcatgatggtggggcctgggggagggggagggtgcgcaggtgcaaggtgtgagggtggaaggctgggagaccggtagtgtgtgcgactgtggggtgtggaagtgggggactcaggggaggagtggggtgtggaggtgtggggcacggggtggggggttagggaagggtggaatgtagggggagtttgatgtaagggtgggggctatgaggaggggtggggtgtgagggtgagggtgggggctttgggcagggtagaggtgtggggcatggggtggaaggctgtgggagcagtggggtatggggtgcagggcatgagggtgaggggctaaggggaaagtggaggtgtggggcatggggatggaagattagggccagtggtggggtgtaggggtgtagggtgttacctggagggggaaggtgtgggatgcacggtgtgagggtggaggggtggggagggtgggtgctgggcatacgggtggacagtggggaggggtgggggccaggcatgaggatgaaggggtggggaggggtgggtgctgagtgtgggggtggagggtggggaggggtgggggccgggcatgagggtggagaagtggggaggagtgggtgctgggcgtggaggtggaggggtggggaggggtggggtgcagagggttgggagggaggggtgagggaaggggaggtgctgggcgtgggggagggggggtgggtgccaagcctgggggtggagggtgggtgtggtgggtgcggggcctggtggtggagggagggtgggttgggtgctgggcatggggtggaggatgggtggggtgggtgctgggtgtgggggtggaggggtggggaagggtgggtgccaggcgtgggggtggaggggtggggaagggtgggtgctgggcgtgggggtggagggatgggtggggtgggtgctgggcctgggtttggaggggtgggtggggtggatgccagatgtgagggtgggtgccgggcctgggggtggaggggtgggtggggtgggtgaggtggatgccggatgtgagggtagaggggtgggtgctgggtgtgggggtggaggggtggggaagggtgggtgctgggcgtggggggggaggggtggggaagggtgggtgctgggcgtggatggggtgggtgctgggcgtgggggtggaggggtggggaagggtgggtgctgggcgtggggggggaggggtggggaagggtgggtgctggggcgtggggaggggtggggaagggtgggtgctgggcgtggatggggtgggtgctgggcgtggggtgtgcacctcctctgggctccccgaccttcaccctcgcccttcccagtcctggtgtcaaggtaactggaatgtgtttctgtttctctttctccttttgattgtttttctccccagaagaggagaggaagtgtcctttcggtcccctgtcctgggtctccttgcttgcccccacctccccaccagcctctgccctgtccttctgctccggaaagtttcctctgtggaggaagcgtcctgcctcccttctcttctctgaagcctattcgcctggcatttcctcagcgcatggtccaggactttaatctctccttgagaattctccatctgtctttttgaggcatattctggaaacctcactggaccctgaagtccatctctttcgtgggattttcagttcagaaatcatattttaaacatctttcctgctctctgcctgttcttaactagtattctgttcttatgttacctatatgcgtattttcttgaatattctgaggacagtaattagatctttaacttcattttttgttttcccacttagctgttttctctgaggtcagctgtcacctttttttttttttttttgagacggagtttcactcttgttgcccaggctggagtgcccaggctggagtgcaatggtgcggtctcagctcaccgcaacctccgcctcccgggttcaagcgattctcctgcctcagcctcccgagtagctgggattacaggcatgcaccaccatgcccggctaattttgtatttttagtagagacggggtttctccatgttggccaggctggtcgtgaactcccgaactctcaatccacccacctcggcctcccaaagtgctgggattacaggcatgagccaccacgcccagccagctgtcacctttgtggatcctccccctctgtcgctggtttctatggaaagtctggagaagcctgctcacctgtgtctaagaaccagtggctcatttagatgggatactgtgggttttccgtggggtcctccaggtggaaaggtgagctaggggtggaaaggtagctgggggtggaaaggtgagctgggagggaatccacagacggggcgtggctgtgctttatttaggacagatgggtgaggagcaggcagcaggctagcatctctcccttcccccgaaacactgcaatccacactagaataaggcacatatacaccatggaatactgtgcagccatgaaaaaatgatgagtgcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacacggggcctgttgtggggttggggggagggatagcattaggagatatacctaatgtaaatgacgagttaatgggtgcagcacaccaacatggcacatgtatacatatgtaacaaacctgcacgttgtgcacatgtaccctaaaacttaaagtataattaaaaaaaaaaaagattttaccctggggccctagacccaggctgcaagctgtggccacacccaggatgctgactccagggccgtgaataagaatcttctgacgctgcctgggaacctgctggcttcttggcgggatacagacgcaggcacgggttgcagaggtgactactgccaggcacttgttcacaggcaactggaattaccagcccccaccccgttttcagccccacatctatctccctttgacctcccagctcagtgccactctgggatccctcagcaagatgaccctggcctccaccattgatctctgagcatctctggctgggcgccttcaccctgccccaccgcccacacccttgcatccccttccacctttggaaatcattggccattctcatctgccagcacctctattcctgttctctttggggctacacgtttctccttggactttgtttcaatccaactgggcctgaagaggagggaggccctgcattcagggtgcccagcagcaactgccctccacttagcgggagttcaggacaggacagagtgcttagacatctgggggcattccagcacttccaaagaccccgtgcgtggtgttctcaacgtctgtaaaatgtggaggtgaacattagactattgctctcctaagaacttcagtcacgctgagcacagggggtaaattcatccctggtcgcattcttgtgaaaggcattatgtagcagatcatctttttttttctttaatttcattttattttattttaagttctgggatacatgtgcaggacgtgcagccttgttgcataggtaaacgtgtgccatggtgatttgctgcacagatcaacccttcacctagatattaagtccagcatacattatcttatttttcctgatgctctcccgccccccaaccccacgacaggccccggtgtgtgttgttcccctccctgtgtccatgtgttctcattgttcagctctcacttataagtgagaacacgcagtgtttggttttctgttcctgtgttagtttgcagaggataacggcttccagctccatccatgtccctgcaaagacatgatcgcattcctttttatggctgcgtagtattccatggggtatatgtgccacgttttctttgtccagtctatcattgatgggcatttgggttgattccatgtctttgctattgtgaataatgctacaatgaacatacgcatacgtgtatctttataatagaatgatttataatcctttgggtatacacccagtaatgagattgctgagccaaatggtatttctggttccagatctttgaggaatcaccacactgtcttccacaatggttgaactaatttacactcccaccaacagtgtaaaagcatttctatttctctacagcctcaccagcatccgttgtttcttgagtttttaataatctccattctggctggcgtgagatggtttctcattgtggttttgatttgcatttctctaatgatcagcgatgttgagctgtttctcctatgcttgttggccacatgtatgtcttcttttgagaagtgtctgttcatgtcctttgccaactttttaacaacaaggttgttgggtttttttcttataaatttgtttaagttccttgtagattctggatattagacctctgtcagatggagagtttgcaaaaattttctcccattctgtaggttgcctgttcactctgatgacagtttcttttgctgtgcagaagctctttagtttaattaggtcccatttgtcaatttttgcttttgttacaattgcttttggtgatttcatcatgaaatatttgcccgtgactgtgtcctgaatggtattgctgagattttcttctagggtttttatagtttggagttttacatttaagtctttaatccatcttgaattgattttaatataaggtgtaagaaaggggtccagtttcaattttctggatgtggctagccagttttcctggcaccatttattagacaggaaatcctttccccattgcatgttttagtcaagtttgtcaaagatcagatggctgaagatgtgtggtcttagttctgagttctttattctgttccattggtctatgtgtctgtttttgtgccagtgccatgctgttttggttactgcagccttgtctgaggtcaggtaactgaagcatccagcttcgttctttttccttaggattgtcttggctatatcggctcttttttggtcccatatgaattttaaagtagttttttctaattctgtgaagaacgtcaatggtagtttaaagggaattgcattgaatctataaattactgtaggcaatatggccattttcacaacattgattcttcctgttcatgaccatgcagtgtgtttccatttgtttgtgtcctctctgatttccttgaacagtggtttgtagttctccttgaagaggtcattcacttcccttgttagctgtattcctaggtattttattgtcttcgcagcaattgtgaatggaaattcattcatgatttggctctctgcttgtctattattggtgtataggaatgcttgcagtttctgcacattgattttgtatcctgagactttgatgaagttgcttatcagcttaaggagatttggggctgagatgatggggttttctagatataggatcatatcatctgcagagacagtctgacttgctctcttcctatttgaataacctttatttctttctcttgcctgattgccctgggcagaacttccaatactgtgttgaataggagtggtgcgagagggcatccttgtcttgtgccagttttcaagggaacgattccagcttttgcccattcagtatgttattggctgtgggtttgtcataaatggcttttattcttttgaggtatgttccatcaatacctagcttattgagagtttttaacatgaaaggatgttgaattttaccaaaggccttttggtagcaggtcatctttacaaatgttgtatctactcctgactcattttcaaagcaggactcaccgtgaccccccctcatcccgcaattgttccactgcctcgtcattcgtccccagcttgtgagaacgctcacgttggccctccgtgcccctcctgattgtcacccactgggtgaatcagtttcctgagcaaaggttcgcctccaatgaggtcaacgcacatgtggcagggacccagtatggtttgttcggaaacccgtttcatgcggagccagcagaagccacgttaaacgcacgcgttcttccatccctctgctcaccggaagcgagcttcccaaggcgggcacggcgccgcccccccagtcacgcggcttccgcttccggtcgtgccctctcgcctctaactagagaacgcctcgcggtgtgagtgaaactctggcggcctcgctaacacgccaaacctctgtcctcagaatacgaagggcaaagtgtgtcccactcacgcgcaggcttccccgcggcggccacagcggcggggggcgggggtcgtgctcaccgtcgtccagttcaccggcatgttttcaatcagccatcacgagcgaagtgctgcttcgtgtccaccagggaaagcttcagggagcacgttattggcactcaagatgccagccatgggctgcctggaacgacggtttttatcatttatgtgagtcctgggacattttcttccaacagacctaagtatgtatgacaccagcatattacacgaagccgagagggggctgctctgggtgagcgtggaggaacacacgacccctcccacgctcacgtgcccacaacctccaggacagcccagcctgggtgaactgcaacttctttagctcaagggacatctgcttttccccagaggggcccctggtgcagaagcaagttggggagtgtgcagagccgggaagaagcaaagcgagggtatgggtgggagggagtgggaatccttggatttggcagagaacaagtaaattttcggaaatcatagtcagcgtggtctccacaaagatgagagggcaggaactcgattggaagggggccagtgaagctgctgtcaggaagctctcacagggcagtaaacagctcctggcacccggaataggaggaggaagtcgagaacccacagccgccctgcccagcctggctcctcctcacccgcccaggctgctgtgctcctcacgggaggaaaacccgcctgcgtccagctacctccaggaaagcaacaactgcccgtcctcgactaaaggccaaaccttttaacatttttgtccttgaccacggcatcagctgtgctgtctacagaaggaactatattattcccacttaaatagctcggtgtttcgtcaagagagtgcaaacacgagggcttcggtagagggaggagacactggctcaggaaccagagctcacggttcctgctgtctctgccccttgacctcggtgtgaggcggctgcgactgggtctctgctgtgtaaatattgtgcctgagggccattttgacaatgaccgtttctactttaaaaacaaagcagaccaagggagtctctggtccagggataaggtgcctgcagtgcttttccgacacctaaatctctgctttgtcctgagagaaacaagcgtcacgaacttagctcactgttggtgaagtgacggccgccagggaagagtgcagggatctcaggagagacgctcgggtcctttttcaaaaccagtgtgatgcacgatatgtgactactcgccagagtctcgggagagtgtgacgagcgatgggtggctactcaccagagcgactggatttctgtctgaggctactgcatatgctgggtcttagcaagcaacggccatgcggccatcaaggcacaacagagagctcttcttctaggaagttcgaggcattaaaaatttcctccactgggagcatgagcataaatatcttccatattgttcccagtttttctgaaggcgaaagaaaataaagaaggccagtcaattagaaatctgaatttttctattaaagaaggcaggggttagccgggcacagtggctcacgcctgtaatcccagcactttggaaggccaaggtgggtggatcacttgaggtcaggagtttgagactatcctggctaacatggtgaaaccctgtctctactaaaaatacaaaaattagctgggcgtgatggcaggcgcctgtaatcccagctactcgggaggctgaggcaggagaactgcttgaacccgggaggcagaggttgcagtgagtggagatcgcgccactgcactccagcctgggtgacagagtgagaccccatctcaaaataaataaataaataaaaataaagaaggcgggggttcctgtctctatttttccaggagaacaaatattaccaatgtacaaaactagggggagacaggagtgactttacctcactgccaacgcctccaacacagtctccattcacaggtcaagacagaaaaggagtttcctggaagactgcagagtctgccacagacccagggcagctggacttcctgcagatctaaagccagggctggaaaagccacccagagcccatcaggcctcctggacctgcttcttggtccctcttctcaaagtcctctcccctgaaggctatttcccctgcctctccctcatctcatctcccacagtctcctagtgtctctgccagccacatgccgagagaaccagctgcgccccaacacttccagtctctagagagatcatttccgtgatccattcagctgggcccaggccgagggcaggggcaggagtggtcatgtgttaagaacagggcagactgggtgggttgtgggtcgtggggagctgggcagacaccctgcagggcgtccacaacacccgttcctaatgggaatgtaactgaaagatagcggagatgagcttttcccagagtttgggaaaagcataaggagtgaggaaggctgcaccctcaccagccttccccagtgacgacggagctgtacaccctcaagcagatgctgtcaactcctgggagacacagtttctttactgaaaacacgagcctagactaggactggacggttcttgctttgtttttttgtttctttctacaccattcacattccattggtagaagtgctccttccatacccggcagggggaccgagggggccatgtggcactgagcgggctgccgggaccaagggggctcatcagccccttaggtggggtgggggcatgcaccgtttgagcaccaccgccggactctgcacccagcgagggaccctctcctccctgcctctgaccaccactgtgaattacaactccaagcagtgcttccctggccacgcaggaggagttacaggggttgaggaagcgtggcctaaggagaggcagatgggggaaggatgtgtgctctgccgtcttcaatactgaggggcctcgtgtgcagaaggacgtcgtttcttcagtgtgacttcaatgggcagaattagaataaaaaggtaaagtttattatggaagaaggtaaatctcagctcatctcaaccactttctctaagttagagttgagttgacccccgattcaaaggtgctgcttcgggaaggcacagtgcatgtccctgtgctgtctatggcaagaacttgattcaaggaggatggaagccagaggcacccagctcctccaccattcagcccgaggcccaggagcaccgtcctttcccagtgcttctacctctggtcttattcgcctcttgtgacacagctatgatgtgacgtcctgcattttactgatgtggacgctgaggtccaaagacaagcagcctcccagggacacacggagctggagtcccccgagtctctgggctcctggctggggttcctgccgcctgccctgctgccagcacaagcgtcctcgtcgctgtctggggtgcacgctggggcatgtgcttagttcgtacttcccattcatggaagagatgatgagccccagtaagaaaataatttgaaaataatttactggtgggtgcacgctaagttcccacaaggaaacagacatgcagttcggtgctgagagctcagtgaccatcctggggacaagtggtgtgggagcgatcacactgcacaccaggccacctgccccccagcttcccagctcaccctcacgcctgtcttcctcaccccagcccacccacacggccccttcaccatgcacagaccctggcaaagcgcagagtgccttcactcgaactttctcaggactacagcctgcccggccagtcggcccttcctagcctgcttggaaggtgaagaaagtggtctccatgtcacccgcataaaaggcgacgactatctgctcggatgtcataggctgaccttcccaaaacaatctccctcagaaccaacctaggtgctcagtgtgaactctcacccattagattgacagagtggttctcgactggggttgatttttgctgccatctctccccaggggacagcaacgcctgtaaactctttgagctgtcacactggatgtgaggcacacctacagccatagaatcctagaagccaggggtgccacccagatcccacagcgcaaaggacatctccccacagcacagaattgtttgacccaaaatatcgcttttcatcagtggccttctaaactctgcctcttaggtgataggctgctcccacctaggactgcgtgttaaaatgtgaaaacgggcggaagcttggcagcatgcacagctttaatcagggattccgtctggaatacctgctgggagtcactctctccaggttagtggccatcgtgataagcgattctgggggaaggaggaggaggagaagtgggaggaggtcttggtgcagcaggaggcatttaagatgggatggactgaggagccgcagtcgctggattggacccaagccaccaagctggaccacaaatgaagccctggatccacacctcctcctggtcacagtgacagttcccacctaggacatctgaccttctaaaggccaaggcagttctttactaagcagacgaatactactttcttctcaatttcattttccttctcagttggaggagagggtgcagtttgtatttcattgaattttctccttttcttgaagggaaggatatgttgccaaaaatactcatgaactgcttccttgtttttgtgatggagaaaatgattatttattttacaattgcatctgcattaagatggcaacaaggggccgtgggctgaggggttagggtcctgtcccctctctgtgcgctggagagcttactgggcatcttgcaggtctcctggacagaggccccagggctcagaagcacacacacacatcctgtctagtttgtgggaccctgcagagcccaggctccaagggctgctgagatggctcagcacacgcgggtctgagcatcaaaggcttctgtgccttgcgccgcccccgaccccgcctgcagcctcagctgccctctgccttcctggcaggcactgcccatgggttctccgccagggcctggctgctttccagcctgtgccccagccccggagggaccgtcccctgcagatgacatgagctttgcctaaggccagacttgaggaccagtaactagggacaaaaaaatagctgctcagaatagcacaaaagctgttgttgttcagttctgaaagtcttactgcatcctatggccagatgaaaaaggaaccgaggcggagaccccgggcaggacgtggtgcttttgcagacagtaagggaaccaggcagcctccagctctggtgtgctctctgcccgcatgggtctgcagcccctgctccctctcctcaccacgggctgcgagctcttggcatggctgccccagcatcggggttgcccaggtttcctggcaaaaaccaactgaacgttcagatcacctccctattcagctggcttggagcagagagcaggaatggtgcctggcctccttcccaggcagccttcctgggaagcctccagggccctggaagttgagtgtccggtgccttcttgtctgtggtctcctctctgtgattccctgggacatccaaggcctgaaacaatgtggggctgaggaagcaaggacgccttcgccagccaggcggtcagacaccatgaggtcccagggaggggctgttcagacaccgacggccgagggactcttgtttgctttataagagaatccatcttgtgagcagggtgggcttgcaggcagtggttttgtgtttttttgaatttctaagctcagtaggtatgagatggtgtcagtggagaaggggccggctgtaaagatgtgatcaaggcctagtttgcacatcaaatagattttctttaattaaccacacaaaatgataaaaactttaaaatggctttcttcccacctgtgaaaagaaaaacttcagctgaattaaatctaaaggagtttaattgagcaatgaaggattcacgaattgggcagcccccagaatcacagcagattcaaagagattccagtgcagtcatgtggcagaagatttatagacaaaaaaaagagaaatgatgtacagaaatcggaagtgaggcacagaacagctggcgactcagcgtttgccttatttgaacacagtttgaacactcagcagggtaagtggctaaagtacggccactgggattggccaaggctcagtgattgttacaggctcagactcctaagttttctatcttgtctacctattaagtcaggttgtagctcatccacaaggactcaaatagagaagtacagagaccttctcaggacatatttactttgctttaacaattcccctcttttggtcattttctcaatttttgagagattaaccaaaactttagtcagcgatgtcactatcaccatagtaaatgtacttatttggtcttgaaacccactggaaaatagtagaacagtgagttttgcaaaggtaagaagaaggactgaacagaaggcacctcctcatactgaacgtcctgtttacaggaggaaaacaaaacctggtctgttctgtcctaggatctgtacgtttccttcaagtctttgattatgtcacatttagcacaagaaactctatttttgtctgattgggtctgttggggcctattgtatgagctcagttcaaaacaatggcctcccatcattttgtttaaaataaattccccctttttggtcaggttctcacttaggtgagagtgtgaccaaaacttagggcattagcgccgctctcagttaccatgattttgggtttctggtctcagcacatccctcataggttatggtgtcctcatggtcacacatttctttcagctctagtcattccaattgaagagagaccatttgacattctaaagatagctgcatgcaaacatttgaaatctttgagagaatacagtgcaccagggagactattattatgactattgggaggataataccaagagtctgcaatatactccttacccagggtccccataaaccaaacctcctaaaatcaaatagatcaaagaatgagcttgataaggagtctactcacttgactaagtcgttttttcattaatccccttcaactgaatctctgtaatacccgatgttttcttcataggccgtaagtgccagcaactgcacagatacttctctgtttagccacttttcagcataacttttataagagaatttaaagtttgttgtgtaaccatagcttttcagtagaatctgctatagagcctatcatgagggatacatttctaatcattgcctcttttactccaaacaatggaaataaggacctaacaagtgatgcccttccagaagagtgaaggcttcctggcaatgttctctttaactcatgatgtgggttaagaagaattaatcaatgttctgtttctgactgattatgaggcaatgtatgtaccattaaagtttctcacctacatcaggccttcatcttttatctatcaaagtataagattgtccatgtataagactggctgcaaaatccttcacaaataaaagtataccccataagtgcacacaacagaccccctttccatttctattgttcacagaggcataagcaaggagaaaatattcaaaactaagagtctcgtgatagaattcttgatccgtgatcttgggaaaagttggtcacatcaaggatgccaactacttctggggagaaacttccctggttagctttaccttaagggttccaattggtgtccagttccaagagtgtggagggacccttctcagtcgtgagatgatgaactcaaggttcaagtttccaaagttttgttgcagtgaggatggcaatggcagtctttctctgacgttctcagaagatcccatctttgtgttctagattgtgaaggggttgactctcctcagtgaaccataaagaagcttccgttacctgatgaaaatacactgtggcacaataacttagtgttataatatcagccctattgcatgggaaggcttttatacaaccagaaaacatgcattgaaaatgacaattgaatgaaattccttaataaatgtttaaatggcccatcaggtaaccaaatttatctgaagctttgattgtcttcccaggaatatggaaccaaacattggttataaaccatttttgcaatttataaatcaccacatcaatatatttaatttggattattttatcttttcatgatgagtcatggaatgcagaactcttaatattaaaagctttaaggactcgggaaggacaaggaagccatcctagttctccatgagtccatgcttaacattggacttatgtcctcttgaataacagttgtttctccaaatgaggtgcatagcactgttaactaatgtgttatcataggtaacttgacttagaccatagatttcattcaaattgtatatctaaacaatttccgtattggctgatttagcatgaaaatctggcaaagtatttcattggtattcagttaatttttgtcccactttgagttagcagtttgataaactggtcagtcctttcattcaagttccaggaactgttatgcggttcaaatgacatgactctgcagttgttagaaacctgtgttcaagagcgcttgtcagcgtcctccccatcctttcatgaacatcctaaaggacaccatgcttttgaagttttcagaaactgcatcagctttaagcaattaactgtggaaatgactttaaatagttatagttaaaaacacaattccagcactttgggagtccgggtcaggtggatcacctgaggtcaggagtttgagaacagcctggccaacatggcaaaactccatctctactaaaaaatccaaaaattagccaggtgtggtggtgggtgcctgtaatcccagctacttgggaggctgagacaggagaatcacttgaacctgggaggcggaggttgcagtgagccgagatcaccccactgcactccagcttgggcaacagagtcagactccacctcaaaaaaaaaaatgaaataaaataaaataaatagttatagttaaaaccactataactaggaaactttaacacttaagctaggaaatttgtttatttctgtggtctacaataacttgacataataaccataattatgattgatagcatatactcaaacatattagaattttagaaattccatacaattttggaacatatattaatataattcaccaaagtataacctgaagattaaacactatttttattttaacaatgcttcccatgcaacttaacatgtcagataatcccgttgacctctcttttggatgtttcaagggccctctgtagcatcccaaagtcggaggtcagaaaagaccattttgaagctgacatacaattttgagaagcctatcaaatatgttaaaggtttaaaacacttgatgttatgaaatggaattccacatgtccccaggccttaaaagtcaaggcagtttatcaccttaaagcatttagcgaacctagtatttgacctgcataattgagaccaaatgtctttatttttgccaataatctttaaaactttttatttcccaaagattattaaaatcatgtgagctaaagggcattagtttttatttttctttaaaaatatttgatcgaagtgcttatttttctttaagccaattaattagagctctttcatataaacattacacacacaacacatttgtaactacacggacagacagacagaagattattacagtagttgtaagttttcttttaccagtttgttagtttcttaattggattactggtatagggtccagtccttggaagaatggggccaggaaggggtctctggtgcccctgtttttcttaaagagtcccaggctcttggagcttgaatatccacttttaatgaagctgactattatctatagcactgtttaataaaagttcttttaagtttcttattacccgactttagccaggcccaacagccaatatttttgtgcttacagaaaggaaaattcaagactgttcatggaggggaagaggatttaaaaatggcaaatgtcacccaaatatcaatcagaaagtactcattccctaagccgggaattgaaccatgaacctggcagccattgtgatagagagactgaggaaaacatttccacgtggttacaagctcaagcccccagggacgtttaagacaagatggagacctcatctacttttattttctttttcttctttcagggacctgaagcaaagtttataactgaccaatttgcatctcgaacagtgggcttatggtgttttaggcatgcattttatcccaaggtaccccttttaatgacagaacaatacagaaagacacacaaagcacaccagattcactacagtttaagaccagcctcagaattctttttcatattaactaaaactttacagaggagataaacagtgatttttactattcatttaaccagtttgcacagagaaaaagaggccaggatttctctgactcacgaggcatccttagcattttgtcggcatgctaggcttctgggttccctttccccgagggccccactgacccggcttgctgcaccaaagccaatgcagccaagccacagcacaaaggaaaattatctttttctgctctggccagagcaaaatacatgtgacaaaacatagatgttagccactctgctttgcccccaatatcaaactggcaaggctcaaacttgcccccagattggccccatcatctctaaatctttctaaaagcttctgcatattaatatgcatccctagatgagactaatttgtgaaccctcatttttaaatgcacttttgtgcattgttcatttggaacattccactgtaagttacctttagtaagattttgccatttctttaagacttcatggcctcccaggcctaatgtataagccagaaggaactcagttttctagaaactaaggatcccatttttgatagcattagtattaagagaaatacgtaatgtagatgacaggttgatgggtgcagcaaaccaccatggcatgtgtatacctatgtaataaacatgcatgttctgcacatgtaccctacaacttaaagtataattttaaaaaaaaaaggatcctatttttacctaaaatattggctttactctcagattcccttgattaacttagccaattgatatggtttactgtgtccccacccaaatctcaacttgaattatatctcccagaattcccacatgttgtgggagggacccattgggaggtaactgaatcatgggggctggtctttcccatgctattttcatgatagtgaataagtcttgcaggatctgatgggcttatcagcaatttctgattttgcttcctcctcatttttctcctgctgctgccatgtaagaagtgcctttcacctcctgccatgattctgaggcctcccagccatgtggaactgtaagtccaattaaacctctttttgttcccagtttcaggtatgtctttatcagcagcataaaaacagattaatacaccaatgatttttttctacctaagcgcacagggaaaatgaaacaaaggggtggaacacaaaaatccctgtgaatttccaaaagccaaattttataacccctacaatatcagatcccacttctgacaccatctattaaaagaaaaacttgagccaaattaaatctaaaggagtttaattaagcaatgaaggattcacaaattggacagcccccagaatcacagcagatccgaaaagactctagcacggccatgtagtggaagaatatttatagacaaagaaagggaactgacgtacagaaattggaagtgaggtacagacagctggattggttacagctcagggtttgccttatttgaacacagtttggacactcagcagggtgagtggttgaagtacagctgctggaattggccaagactcagctgttgttacaggctcagactcctaaattaggttttcaatcttgtctacctattaagttaggctgcagtttatccacaaggactcataaatctggaagtacagagtccttcttgggccatatttagttgctttaacacacctataacaaattaactttaccaaggtgtcttccagtctcagcttctcacatgctagtaagaggaagtttttccaaggtatcttctgggctcagctccccacttactggtaaaaggagcagttttgtgcatatcttgctgggtttgtctttccagtcatcacaagagtggctgcaccacaccccatcactttctgtgtggagtgggcccagctccagctctgtgcaacagtaaaccagtgacactggaattcatgtgtttatacactcagctttcacatgcttctgcatcaattttttaagactatttccagagtgggattgagacctaagtgaatcgtcccaggaatagggttcttgagaaatgattgcatgagtaaggctgcagttaacaccaccatgactaattaccagcaaattgaactccttctgttctgtgaaagttgctagtaccaaaataggttcactcatatcaaactctaacaaaatggggtggggaggccatgacggggcgccctcatacacaaacacctggacaagcctcatctcaaggcacccctgcacgggcctcaggttcgcccatattaggatgcattgcacgaaaattcctcaagacaggtcggtattacaggtgagcggcctgcacaaggagctaacgccagctctgggacaagctctgctaaccagtgatttttgttacaaagcagcttctgtggagttctctctgtctttaaagatctcccctttgccctggcccctccagtgtgcctgtgatctatcatagcatgcaatcccgtgctattctcacttaaatttatttgttctggagagcctgttcctttgaatttccttttaggtggacagttcaagacccctaacacattaatccacttaatccaaagagctcctcttgtatcagggaaggccacagggacatccctgtcttgttcctgaccttggaattgcattgcttagtttccaaacatgggatttcccagttatcttttgttatgaattcctggctctctgccactgtgaacattatctgtatgatttcagccctttgaaacatgtggacactttttcatggcccagcatacggtcaaattttgcaaatgttgtaaacattctttctgtattgaaaacttttatggtttcctgtactctgcagctatttccgattttgtcttttgtgccttgaagcagagtgagtcttatcatctgtgtctgagccatctgctccaaggttcctgtggtgctagtcgtgtcttctctgcaggattgattcactttgcaagatgtttggtgcactgagacactggaaagttggcagcatcttgagatgtcatcagtccagggccacgttaagataatttcgcgacttgagggttttttaggcactgtgacattaagctaatttcacaactgtgtgaacctgggccgcagggctcttccttgtcttgtcccctgctctgctgtaacctggcagttgttgaaggatgggttatttctgatccacgttttcctgagggtgaagacttcagctcctatgaagactgcccacctgccccatcccccacaaagaccccaccgctggcatcctgagtgccttcaggagaagccctctgagtgctggctcgggggtctgacagatttttttgaccacagcctcaaaattcctgactcctgggtgggctcttcagtatatgcaagatggcctccaggattctggctttgttcagtggaagggtcgacttaagcaggtcacgcagcagttcctggtggtggtgactcccagcttctttagctcagctcttgagtgatttgcactacacagaaggtactggagacacagttaccttttctggaaatcaatgtttgcaagcacatttgccctccaaaggttgaaggttgagtgaatttgaagtggttggagatttgtttgtaaaccactcttctgcagaatgagaacgaagttgctgcttggttttgaagatacggccttttgtgggagggcagaacagaaaaatcaaagcttggatttagagttaaggacacaggaaaagaattatgaatattaaagactgagttaatatgtgtcatatagcaaatactttacatattgcatgcaacatagtaagctgttctatgtaacggcctccacatttcaggatatcacttggtgacatttcaaggcatttctaagaaacaaaacgttaaacttaatattgggccaaaatattgattaaggcagcagctgaacacccaaatataatctggataatcaaagtcaaaaataggcgttggtatttactttctgtagaatataagtagaaactatataataccaaacatccaaacctagcccagtataaaaaataattctccacttaatatagaaatcacaaaatgcagtgtggtgccatggcttggatcccggaacagaggtgcacggtggaagtccgcactgcttctcaacactggaccccagactgcagctcacttccatgcagtgttgcttcatgtgtgcaagcccttgtcagtgtttcattagtcctcaggacagatgccaaggagctgctgcttaactgccttgtctggtctgatcttaagaagcaaaacttgattggagccctgtggtgccctgaaatccagagcatgttgttgggggtgattgattttcctgggtctttagcaacatgtctgatgtttgcagattctgtaccatgggccctgccgtcagtcaagtccaagagcagacgtgagtcgagtggtcagtgggttgcaggtaaccataggccagccgagggtggcagccgtaggtggacagctgggactccttccctgtgggtgacagctgtgggtgacagccgtgggtggacagcatgggtggcagccgtgggtggcagctaggactccttccctgtgggtgacagctgtgggtggacagcatgggtgacagccgtgggtggacagctgtgggtgacagccgtgggtggacagctgtgggtgggcagcatgggtggcagccgtgggtggcaactaggactccttccctgtgggtgacagctgtgagtgacagccgtgggtggcagccgtgggtggcagccgtgggtggcagctaggactccttccctgtgggtgacagctgtgggtggacagcatgggtggcagccgtgggtggacagctgggactccttccatgtggatgacagctgtgggtgacagccatgggtggacagcatgggtgacagctgtgggtggacagctgtgggtgacagccgtgggtggacagcatgggtgacagctgtgggtggacagctgtgggtgacagccgtgggtggacatcatgggtggcagctgtgagtggacagctaggactccttccctgagggtggcagctgtgagtgacagccgtgggtggcagctgggactccttccctgtgggtgacagctgtgggtgacagccgtgggtggacagcatgggtggcagccgtgggtggcagctaggactccttccctgtgggtgacagctgtgggtggacagcatgggtggcagccgtgggtggacagctgggactccttccatgtggatgacagctgtgggtgacagccatgggtggacagcatgggtgacagctgtgggtggacagctaggactccttccctgagggtggcagctgtgagtgacagccttgggtggcagctgggactccttccctgagggtggcagctgtgggtggacagctgtgggtgacagccgtgggtggacagtgtgggtggcagccgtgggtggcagctgggactccttccctgtgggaggcagctgtgagtgacagccgtgggtggacagccgtgggtggcagccgtgggtggcagccgtgggtggcagctgggactccttccctgacctgagctcacttcatttgaccaggagcatcaaaaacagtgtgtgcatccaaaccactgtgaatccccacactgtaaaaacaaaaacttcaaacgtcacatattttgtccactttgccctcaatgcacgctttatccatgtgagtgtgagcagacatagagcacagccctcactcctccatccaccaaccgatggcagcagcaagcacagtcaggcttctcagcacacaggatgaaggaacaagggaagacagccccacggtctgactccgagtcccagctgaggaaccagccaatagcatggacagcactacttcccatcagcatgactgtcaggtatttgtcgagcacctactgaatattaggtatttgttgagcacctactgaatattaggctttttctagtcatttttgaccaatgacaatatcagagtaaaggaaattgattattctaatagaattcctctgaatgtaacatttagattgtataggctaagaaatcataactaagcctcatgtcttaaagtgctggttgtatttctaggtaggaattcttacatctaaattctacagtatatgcaagttatctaaaaattaatacttgtgaacaattatgtattaaaataaatttttcttttcaaaaacccaggcaactttaaaattttcattaaatcaacaattttaacagcctataaaggcttctgccaaatgttgaagatcatcagagctagctgagtacagagcacctcagccacctcaagagtggcaggggaggaaataaagtcatattttggcttcactcacatcttattacttccagatctgattctttctttcagactggcagccactacatcctgctaatattcagagcaaatttctcatgaaatgccctgtatctgctcctcacatatgcaaagctgaacaatgagttcccatccatggattctgcactggagtctcatgtgatgagagctgtagtgtaatgaagaccacagctctgacatgaaaatgatgatgctattttctcattaaccaaatcctctgatgtgtcgtcgccaacattgcgcacgtggcttcaacgaagatgaaacgaccgacagctgtcctagcgccatgttcactccattcgtctcaggaaaaacccatcccaacctgattagagcaatggagagagggtggcttaaaacagctaagcctttgcataactcgtcttcaagtcaatcagaaaaattagggaggatctgctgcctaaccttcaaacaaatattttggaattgtctgaattatataaattattcaagatagaagagaaaggagataaggaaagcagaaagaaaggtactaattaagaaaggaaagaactggagagcgggagaggttgggaggaagggcagaagaaagaggtaggggagaggaagacagcaaggagcaaaggaagggtgggcaggaggaaggttagttggagaatttctcggatcttatgtgtgattatctccttcctctgtagctgaggagtggcatcaaaatggcaacactaaactatccaagatctcctgaaaaaaaaaaacaccccagtggagaagaagatcccactcttcaccattattcttcgcgtgttgtttgagaatcccagactgtcttctggctcccgttcttccccctccttggacgccatgacaactgtcacatgaccctgcaaacacagcgtctccaggtctgcaccaggccccagctgctcctctgtctggaatgagcaagacgattttgttgctgagatgcacggagccccccggctgacctttccctgtgccagtgagtacctgtggcatgcaagggagaaagcctatcaggaccacaggagaaaggtaggaaagtccccaatccagccctgacagctcagcgggcgggcaccaagcagcgcccacgaaatgcctctgctttccctggagtcctggaggtgattttctttttggagacagcatggttgaaatgacatttcctaacaagattcatcatctatgttgccatacaataaaaatctcattaaatagttgacggctttctttctttcttttttttttttgagatgacagctttcatgtgccatgttttagggccatcctatttctaatcacagcatatatttaagaagtacttaatttttcctaagtgacttgaaagcatcttaagacaaaaacaccagaagcatccttttctttttctttctttttgttttttgtttttgtttttgtttttgtttgtttttgagagggatgttgccataggggtgttgccatgttggtcaggctagtcttgaactcctgatttcaggtgatccacctgcctcagcctcccaaagtgctgggattacaggcatgagccaccgtgcccggcccggcatccttttctctatcaaaacagtggactccaagggggactaaaagccaacccttgtccccattagaagatatgttattatttccatttattggatgcaaatgtggacaattgtttgagggcatcgccatgcagatctgaggtggcctcccacagtcttctgcccacacctcagtggaggcgtcagagaacgatgttccatgtatcatgtctccacatgtgtgttgatcaggctggaaatactcttaagaaggagaagtttgggtttctgtttctgggaatggagacactgccctgtaatgatcttaagtgactaccccaaggagtgaactgcaggtcaagcatttctcttcctcctagggttgcaagtgacattgtgtggcctgggctgcaggtcacactcattgcaaggcgccatagcacccagcccccaccccacgtcaggcctctgcacctgctgtctcctttgaggtccccactgggaactcttcccggctccttccccagctcaacctcacttcctggcactccggttccaatatcatctccctggagtcttctctctcccctctgccgctctctggttcctgggcctgctacctcctgttgccacgtgattgatgggcatgttcattacttgtgttgttttccccactcagtgctgaccacgtcctgcccaccacgatgttctctgcacgtagagtgtggagtgagcacttggtcaaccgttgtcagtagggaaagatggaaagcagtgggtaaggcaatagcacatatgaatcagttagcattacagtaatactacaggatagaaaccccatgggtgttttcttgtttgcttttgtatcccggggactagaatacctcctgcatgaggtagctggtcagtaatcctgcagcctaagtgagtaaccaggctctgtacctgagaaactgtaaggtaaagaaggttgaaattgtcgtcatgggaggtgcagagatgattgaatagtgaactttggtaggttgactggagccatgaggccccagggggcataagctagtttagcagctctgtgacgtcggaaacctacaggtactgggtccaaggatggagtcattggaacaccccagtgtggcccccgagtagcagcaaggggcatgggccgggaacctatgattctggcacgaaagtgttgaaaagagggactgggtgtctgacctggaggggatgaagtgaagacagagaaccagtccagaaagagagaaactggaagtcacatatcgtaaggaactgctgttgggcacagctgaccaagtgatgaaaaggaggttgtggtgaagaacagggcaactgaaagcacagcttcccagcaggggcagacacaggtggtgatgatgcctgggtgtcctggcaggggtatgctgaggggcgtgagggtaggacatgaaacctggcaaaggaggttaaggcagctggcagagccgtcccacgggggtagggctcatttaggacaaagaaatgggagaagagcaagatgggccctgacgctacaggccccactgaatgaggagaagggcaagctacagcagaagggtgaggagcagccggggctggaagcagctacatgagcaggacccctctaacactccacagttctccaactggcactaaaacttgaatgcaaacaatgtttctcccaaattaagagtggagagaatcagctctttgaataacttagttttttattgcttggctgagaatctctgaaactgtaaaggaccttggtagaataagaggagataaaataagaggagaaaaaagacctgtgggagaacagtgcatcccagtcccctgatgactgccctcctagaataggggcctcatcctcagcccagccttccccctcagagcctgagtggcccctgcccccagcgctccccaacgcacctgacccctcagccaggctggccatgcctgaaggggtggcctgcccctccacacctgtgggtatttctagtcgggtgggacgagagactgagaaaagaaataagacacagagacaaagtatagagaaataacagtgggcccaggggaccggcgctcagcataccaaggacctgcaccagcaccggtctctgagttccctcagtttttattgattattattttcattatttcagcaaaaaggaaagtagtaggagagcagggtgataataaggagaaggtcagcaaaaaacgtgagcaaaagagtctatgtcgtaattaagttcaagggaaggtactatgcctggatgtgcacgtaggccagatttatgtttctctccgcccaaacatctcagtggagtaaagaataacaaggcagcattactgcaaacatgtctcgcctcccgccatagggctgtttttctcctatctcagaattgaacaaatgtacaatcgggttttataccgagacattcagttcccaggggcaggcaggagacagtggccttcctctatctcaactgcaagaggccttcctcttttactaatccacctcagcacagaccctttaccggtgtcgggctggggtacagtcaggtctttctcatcccacgaggccgtatttcagactatcacatggggagaaaccttggacaataccccgctttcaagggcagaggtccctgcggctttctgcagtgcattgtgcccctggtttattgagactagaggatggcgatgacttttaccaagtatactgcttgtaaacgttttgttaacaaggcacgtcctgcacagccctagatcccttaaaccttgatttcatacaacacgtgtttttatgagctccagattggatcaaagtggttaggtcaaagtggctggggcaaagctacaaattgacaacatctcagcaaagcaattattcaaagtacaggtctttttcagaatggagtctcttatgtcttccctttctacatagacacagtgacagtctgatctctctttcttttccctacaatgcccacggtgtcaactccagccttgcactcactgctacctccagacactgccatctccagaaactcctttttcctcttccctgtgctacctggacttctcttggatgggcttgttagtagactggcactcctgaggaaagaatccctgagctttaggacgtatcagttaaaacccctgtctcagtccatttctgccactacaacaagatatcacagattgtcattatttatttatttatttattttgagacagtctcactctgtcacccaggcgggagtgcagtggtgtgatcttggctcactgcaacctctgcctcccgggttccagcgattctcctgcctcagcctcccaagtagctgtgattacagtcgcgtgccaccatgcctggctaattttttgtatttttagtggagatagggtttcaccatgttggccaggctggtcttgaacttctgacctcaggtgattagcctgcctcgacctcccaaagtgctaggattacaggtgtgagccaccacacccggccaaagattgtcatttataaacaacagaattcacttctcacagttcaacaggctgagaaatccaaggttaaggcaccagcagatttggtgtctgatgaggtcacgctctgcttccaagattgctccttgttgctgcatcctcatatggtgaaaggaacaaaagggatgaatggctgtgtctttacatggcataagagatggaaggcccaggcagctctctaaagcctcttttattaatatgagggcattagtcctattcacaagagcagagccctcatgacttagtcacttccctaaaggccccacctcttattaccaccacagtggggattaagtttccacacgaacaatggagggacacaaacattcgaggcatagcaaccttcaaaactgaaaagcatgctggacacagtggctcatgcctgtaatcccagcactttgggaggccaaggcaggaggattgcttgagcccaggagtttgagactagccctgacaacatagcgagacaccttgtctctacagtaaaatttaaacgttagctgggcatggtagtatatacacgtaatcccagctacttgggaggctgagacaggaggatcacttgagcccaggagtttgaggctgcagggagccatgatcactccactgcattccagtctgggcaacaaaatgagaccctgtctcagaaaaaccagccgaacagccaaacaaggaacaaactaaaaagcaaagagaacgaagtctgaataaagcagaaaaggctatccaaggactgtgggacaataacaaaggtgtaacttacttgtaatgagaataccaggagaagaaagggagaaaggaacagaagaaatatttgaagcaataatgaatgagaatttccaccacgttaatgtcagacaccaagccacagatccaagaggttcaaagaatgccaaaaaggataaatgcccagaaaactacacctaggcatatcgtgttcaaactacagaaaatcagagatagagaaaacatcctgaaagaagccagaggaacaagactccaacagaggaacgaagatgagaatgacacgctcacctcctccagccggtaaccaggaaaaagtgtagggagacatgtgaagtgtccagaggaagggaagcaagaccctagaattctgtaccctgagaaattatctgtcacaagtgaagaagaaataaacattttctcaaacaaaaattgaggaaatctgtcagttgacctgccttggaagaaatagcagaagaaattctttagagagaacaaaaatggtgtaggtcagtaacagatccacataaagaaaggaaaccatcagagcaggaataagcaacagtaaaataaaaactcttatttttattattcttagttgatctaacagataaaagtttgttcaaaaccataattactgcatggtgttagactgtgtatacttatgtgcatatctctatctgtgatacacatacacctgcttttatattaatataagtgaaacgaataagcagccactgtcatcatgtcagttgcagtgggtggggggtggtgcatgggtggtggtggtggaagcagctgcaggagtggcagtaacagcggtgggacctctgtgtcccacatccccaaggcagccaactgtgctgccccaacccttgtgtggccaggcaggacctgctcccaggcccagggcctccaccactgcagactctggccccgtgtcaccgctcttgcctgctgatgcagggagggcacaggaaagaggtgaacagtacccggagcccacccctgggagccccctggaacctgtcaccctaagagccgctgtgatggagccaggccgagctgcctgctgacgggagagcagtgcagttgggcacacaggagcaggcagagaggggcccagtggggacctggaacccccaccccggctgtgaggaggcatggccagggctgcacactccacggagcctgtgggagccaggaatgagtgggagccccaccccttctgagttggcatgtcaggagctccctgggtacagctgcagccacctggccatggctgcggacccaggcatgtgtgtggttctgcactctcaggagcccaggaaggccccctgtctccccgcaggctcagaagtgcctgctcccactgcctggcttctccccactgttggcaccagctccgatcttggagaaaagttggggccaagcccaggcactgtcacagcccggctgggtgtgcccacacttagggcagaagtgacatgccagccccttgccacctcagccccctccagatttgggcactgacaagcacaggagggaggctgagggggatgcagaggacagcacagtgctggctgcgtgcctcttggcatgaacagcctgcgtgccatgaacagcaacaggaggcagacggactcctgggcagaaggggtcaggttcctggtgaagccccaccttcaagctggggagggcctgaagcctggggttccagctgcctgtcctgcaagccagagagggaacttgtggtgcttttccctgggtctgcccatggccacccatggaccaatcagcatgcacttcctccacactgaggcccataaaaaccctggactcagccagactctagcagaggatggagatatgatggggagacgatgggctgactagctgcagggaggagctaccctctctgctgagagctgaagaaaggacaggatgaccagctacagaggggagctgcacaccccaaggtctcctctctgctgagagctgagacgtcaggacaaccagcttcagggaggagctaccctctctactgagagctgaacacttgtcaggataccgtggctatggagaggagctgcccactgtgggtctcctctgagctgttctattgttcagtaaagctcctctttgtcttgctcaccctccacttgtctgcgtacctcattcttcctggatgcaggacaagaacttgggacccatcaagtggtggggctaaaagagctgcaacacaagcagggctgaaacatgccccttgttcaccatgctgtgggtgaagaggagaaaagagagaaggagaaaagagctgaggctcttggggggtcccagacctgggagctccctgagccagggctgtgactcccactttggggccctgcagttcctggagcctccaagcttctgggcaccactgcattccccagtgccaactatggaagcttcttgcagtatgcctggtccaggcacagcctcgcagtgagccagcacccatgctggcacctggagctgcccatctcactgcagcagctggcatgactggctgtgcagtgactggaccccacactcactcactcacacacccctcgccactccactccagtctcttcagagggatgggatccaggccagtagcatgagctgagcacagcctgccagtccaagtgggcccagtgggcccgagcaaaattcggcaaaggtgccaccagccacagaggtttccagccagaaaggcaacaccctcaagattcccataacaacaccaatgataaggaacaggagagaggtattcagattattttgtaatataagttactcacactacctgttaagcaatatagtgttatttgaaagtggacttgagttatttgtaagtacatattgcaaatcctagggcagccattaaaaatgtaatgaaagaagtatgactgataaactaagaagggagagaaaatggaatcatataaaatgctcaattaaaaccacaaaaggcagaaaagacaaaaataacaaatatcaagagtaacaaacaaaatagtaacaaatatgatagctatttatccaactatattaatcactttgtaagagtagattaaaaaaaaaaggcccaactatatgttgtccacaagaaaccattttaagtataaagacatatagcttaaaagtaaatgattgaaaaaaatataccatgtcaacacaagtcaaaagaaagctggagtaactatattaattttagagcagacttcaaaacaaggaaagttaaagggaacgataaaatggggtcgattctccaaaaaggcataataatccttaatgtgcaagcacctaacaatagaatatcaaactacttgagatactacaagaaaaaatagatgaatccccttatcacaattggagacttcaacaccccctgtcagaaatgtgcagatccaacaagcagaaaatcagtaaggacatagttgaactcaacgtcatcatcaatcaactagatataattgatatctatcatccaattcatccagcaacaggataatactcattcttctcaagctcacatggaatattcaccaagatagatcatggatcatcttctgggccacaaaacacatattagcaaatttagaagaacagaaataatacaatatctactcttagaccacaatggaattaaactagaagtcaataacaaagataactggaagatcccaaaacatgtgaatattaaacaacaacaatgggggctgggtgcagtagctcacgcctgtaatcccaacaatttgggaggccaaggcaggaggatcacttgagcccaggagcttgagaccagcctgggcaacatagcaagacaccatctccacaaaaaaaaaaaaagtttaattaaccaggcatggtagtgcatgcctgaggtcccacctattagggaggctgaggcagtagatcacgtgagctgagaagtttcagctatgatcatgccactgcactccagcctgggtgacagagtgagaccctgtctcaaaaaaaaaaaaaaaaaatcacataggtcaaagaagaaatttcaagagacatttaaaaatattctgaactaaatgaaaatggaaacacaacttaccataatttgtgggatgcagtgaaagctgtgcttcaagggaaatttagggcattgaatgcatatattagaaaagaagaaagatctaaaatcaataatctaagtttttgctttaagaaactcaaaaaaagaggccaggtgcagtggctcatgcctgtaatcccagccctttacgaggccgaggcgggcggatcatgaggtcaggagatcgagaccatcctggctaacacggtgaaaccccgtctccactaaacatacaaaaaattagacgggtgtggtggtgggcgcctgtagtcccagctgcttgggaggctgaggcaggagaatggcatgaaccccggaggaggagcttgcagtgagccgagattgcgccactgcactccagcctgggcaacagagcgagactcaatctcaaaaaaaaaaaaaaagaaactcaaaaaaagaaaaacaaacccaaagttagaagtaaagaaataataaaaattacagcagaaatcaatgaaattgaaaataggaactcgatagagaaaaatcaataaaacttggttctttaaaagataattctttgggaaaaaaaatcagtaaaatcaataagcctgtagccaggctaactaagaaaaaagaaggaggaggcaaattactaatattttgctattattagtaatattattacttatattactagtatatatgtaataatataactataataactatgttataatataactatattagtaataatattactaatattaaaaagctatgatcatcaagaaaggaaaaaaggagcatcactacaatccctaggatattaaaaggataataaagggatactatgaacaaatttatgcccacaaatttgataacctaaatgaaaagggccaatttcttcaaaggttcaatctgccaaaattcacacaaaatgaaataggcaatctgaatagacccatatctattcaagaaattgaatcaataattaaacttccaaaacagaacactgggcccagatgggttcattggcaaattctattaaacatttaaggaagaaattttacctattctctacaatcgctttcagaggactgaagcagtgggaatacctcctgtatgtattctgtgaagcagcactaccttataaccaaaaccaaagacattacaagaaaacagtaaatcaatatctctcatgaacattgatgcaaaaatccacagcaaaacttagcaaattcgattaaaagtgtataaaaagtattatatgccatgaccaagtgggattcattccaggtatgcaaggctggctcatcattcaaaaatcaatgtaattaatcacatcaatgggctaaaaaaagaaaaatcacatgatcatatcagtagatgcagagaaagcatttaacaaaatccaacattcattcatgatttttaaaatcccaataaaccaagaataaaggaaactagaagttgaggaaaactttctcaacttgataaagaatatctccaggctgggcatggtggctcgccctgtaatcagaacactttgggtggctgaagagggaggatcacttgagcccaggagtttgagaacagcttgagcaacatagcaagaccccatctttacaaaagaatttttaaaattagctaggcggtggctcatgtttgccatcctagctacttgggaagtggagatgggaggatcacttgagctcaggagtttgagattacagtgagctatgattgcatcactgcactccaacctggaagacagagggaggccccgtcttaaaaaaaaaaggaatatctgaaaaacaacctctacctaacatcatacttaatactgagaaacttgaagctttctcactaagatcaggaacaaggcactcaccactcctctcaccactcctcttaaacatcgtaacattgtactgaaaatgttagatactgcaataaggcaagaaaaggaaataaaagatatagtgattaggaaggaggaaataaagctgtctttgatggcagatgacatgatcatctatgtagaaaataccaaataatcaataaaaagacatgtggaaggaataaacaattatagcaaggatgaaggatataaggttaatctacaaaagtcaatcactttcctatacaccagcaagtgacgactgagattaaaaacatgataacaattatattagcacccaaaaagtgaaatacttaggtataaattgaacaaaatatgtgcaagatctgtataaagaaaactacaaaactctgataaatgtaaataaatggagagatattttatgttaatggataggaagatacaatattgtcaaaatgttagttctttccaatttgatctatagattcaatgcaatcccaataaaaatcccagcaagttgttttgttgatatcagcaaactcattctgatgtttatacggagaggcaaaaggcccagaaaagccaatttaatattgaaggaaaagaacaaagttgaaggactgaaactcatggactttgagacttattaaaagctatgatcatcaacacagtgtggtattaatgaaagaataggcaaatcatcaactgatctttgacacagcaacaaaggcaatacagtagagcaaagacagccttttcacaaatggtgctgggacaacagaacatccacatggaagaagaggaatccagacacagaccttacagccttcacaaaatttaactcaaaatggatcatagacataaatttaaaatgcaaaaaaagtataaaactcctagaaaataatataagagaacacctagaggaccatgagtatgggaatgacttttttttttaaatcagcaagcagagctggcaagaaataggtttttagacacaatgccaatggcatgatctatgaaagaaattattgacaagctgaacttcattaaaattaaaagcttctgctctgtgaaagacaatgtctggagaatcaggagacatctatagactgggagaaaatattcgcaaaagatacgtctgataaaagactgtttccaaaatacataaagaactcttaaaactcaacaataagaaactaaacaatccaatttaaaaattaggccaaagaccttagcagacacctcaccaaagaaaatatataggtggcaaataaacatatgaaaaatgctccacatcttatgcatgagggaaatgcaaattaaaacaataatggccaaaatccagaacactgacaacaccaaatactgtcaaggatgtggagtaacaggaactcattcatttctgatgggaattcaaaatcatacagctgctttggaagacaaaatggcagttgcttacaaaactaaacatactattaccatacaatccagcaattttgctccttggagttgaaaacttttgcccacacaaaaacctgcacatggatgtttatagtagctttattcataattgcctaaacttggaagtaaaaaagatgtcattcagtaggtaaatggataaataaaccacggtacacccagacaatggaatatcattcaattctaaaaagaaatgagctatcaaatatgaaaaaacatggaagaaccttaactgcatattattaattgaaaggagccaatgctaaaagactgcatactatattattctaacactatgacattctggaaaaggcaaagtttactatggagacagtaaaaagatacgggtgggtgggtgggtggggggaggaaggaagagctggagcacagaggatttttagggccatgaaaatatgctgtatgataatgcagtgacggatacctgttattgtacatgtgtccagactcatagaatatgtgacaccaagagtgaaccctaacgtaaactatgggttttaggtaattatgatgtgtcaatgtaggttcatcgattgtaacaaacataccactctggaggggcatgttgataatgggggaggttatgcatgtgtggatgcagagggtatatgggaaatatctgtacctttctctcaattttgttgtgaacctaaaagttctctttaaaaaatcatttaaaattttttttaaatcgcaaacaaaaacacaacataaaaggactgtgttaccaaaattggcttctgaagagaaagtccaaacagaccagttatcagacagttatctatagtttcataagaaaattataccaaacatttgatgatcagaaaatccaatcctgcttaaattgttccagtgcagggagaaagaaaattttctaatttatgaagcaaataggagacattgatcccaaaacatgacaaatacttcaccaaaaaagtaaaaaaacacaaatcaatctcacgtatgaatatcaatatgaagacaaaaacattcataaaataatatcaaacaaaatctgaagcacactttaaataatcttaaccaaggaaattccatagatgcaagggtgattccatatgaggaaagccactaatataatttaccacaataataggctgaggaaaaaattatacaattggttccatagaggcagaaaatattttgacacaattcaacacccatttatgccaaaaaacaagcaataaaatagaaattacaatgatatgtccctaacatgataaaatactaattaatatctcacctcaaagccagtatcttaattaatagaaaaacactaaaagtgttccttctatggtaatagataaaacaaggatgcctactatctcttacaatttctaaattgtattggaggtgttagtcaatgcaattagacaagataaatccattagaggcataaaaatattttacaatagatattttatttgtaaatgaaattcctaagtatctggaaaaaaacaaaacaatcaatggaaaaactactaaaaacaaaaaataaattagtaaagataattagggcagaatagaatattcagatagatttaattgcatatgaaaatttagaaaacaataaaagcagtgtctgtattagtccatttgtgatgctataacagaatgcccagactgggtaatttataaagaacagaattttatttctcacagttccagagactgggaagtccaaaatcaaggcactggcagctggtgtctggtgaggatcttcttgctgtgtcctcatatggcagatggtggaagggcaaaaagtgatggactctgtgtccccatgtagcagaagagcatgagagaccccactcccaaaagccctttttatagtgacattaatccatttaggaaggcaggcctcaccttctaacactgttgcagtggatattaagtttccaacacataaattttggagaatatatttatatatagcagtatcttagactgtttgggctgctataacaaaacactataagctggtgatgtacaaacaataaaaacttatttctcgcagtgctggaggctgggaagtccaaggtcaaggagttggcaaatgtgtttgtagagacaaagtttcaccatgttggccaggctgctcttgaactcctgacctcagatgatccatctgcctcggcctcccagagtgctgggattacaggtgtgaaccactgcaccttgccaaagttaatacaatagactgaaacatgtcaaatatgttttaacattttacttcctaatgtcttttaaaaaaacaaaacaaaacacctcactagtcacctttggaaggtactaagaaccaactcactattttgaaattggcaaatagagaaaacctagtaagtttcttgccagtgcaaagcttttctttacagaagtattccagcaaacaaatacagattgaatgatggaattagaatatctccacttttcaaaccataatgaagtaatggatctaggatcattcactgctgctaacatcacaaggtagagacaagcaaaaatttgtacctgccaataaaatgtcaagataccacctgtggtttatcaaggaaaaagaaaaatgaacctgaatttctaactgccaatatacagaaaatgtcaggcatgtgatcagcaaaatccagactcagaaactctacaggacaaattctctggatttctcatagcaaattgcagggagaaaaacagggaaattgtacattagacgtaaaagatgtacgaccagtggcaatataggcctttttacgtgagtcctgagtcaaacatggaagggaggagggtggaagggagatcgggtctccattttttatactaataagcactctgttgggggcactcatttcccccccaagagcattctttgatgattttgccaaaaccaatctttacaatgatggttacaaaatggtgatttttcgaccacaccactgcttctacgtttaccaactggcattttgctgtaaggaaacactcccttccccccgtacctaatgtttaaattaaacaagaagcaacatcagataacattaaggggttcaaaaggccttggtcaacaagttctgccaccaggcaagctagtgtgacatttttaataacagttatgttctcaaatctttatctggagcttgaagaaacttgcttctagaaagctctgtgtaggcatctcagattaaacatagttaactcagaatttcctgtccatgccccaaacccactcaccaccttctctgtcttagtgtcacctggtatgaaaactgaaagcagagggcattcttcatgccttcctttcccttcacccccgccccacacatgtacaccgcacctgggcctggatcttgccacctccccgcccagtggccccacagccctgggcatgctgcaggcccaggtctcctccctggatgaccacaggagccttggcattggcctccctgccttccttcaggcttctcttcgttcacacgtagtgacagaggagcctgtaaaaagtgaccatgtgaccatgtcactcctctgcctctattttcaatggttccctttcctttggggaccaagttgcagctcctaagtgtgctctgtgaacacgtctccatctgcccctttctccacctcctgacatctcgctgcatcttctccaccctctgtgctgtcaccacattgcacgtgggttcagtccccagcctggctatccttctccatgtgctgggggtttcttcctccactggggagtttcccaatgctgtcgccttcaggttatccgtgagcaggtcccgtagttaactatctataaaggaatgtctagaatatgcggggattcctttttattgcaagcagtgatacatacaggtctcatgcatttaacctgtcacattttaaatataaatgtttcccttatttgtaccttttctaagtggaaactttagagattgttgtacagctaatgcctaaggtgctcatcctgaaatactggtggagagcttggaaattaaagtgaggtggatgcagggacataactcactgtataaaaggcctcctggcagctgggtgcagtggctcacgcctgtaatcccagcactttgggaggccgaggcaggtggatcacaaggtcagaaaatcgagaccatcctggctaatgcgttgaaaccctgtctctactaaaaattacaaaaaaaaaaaaaaaaactagctgggcatggtggcgggcgcctgtagtcccagctactcgggaggctgaggcaggagaatggcatgaacccggcagacggagcttgcagtgagccaagattgcgccactatgctccagcctgggcaacagagcgagactcaaaaaaaaaaaaaaaaaaaagcctcttggcaatagagtgcagactagaaatgtcaccaggtgttggcatttaacaaattctcaccctgcacccacttaattctgtcttttaaaagggcaatagaggctcatttctgagggtgcctggcttcctccaggggatactcggattccaaatctaagcacgagcctctttcagaacttcaggccgtgtgctgacatggaatccctggtgccacgaaagaccccagagcagcacaatctgagctcactctgtttccaatactgcgcccaggtaacgctgcctcctcatgccacaggtccagagcgcccagccgctggtagacacccgcgccccgctgacgttccgccatctccacctgaaactcaagaggctgaaggtacactttcatttctaccttacttaatgtaatagctaactagaaaatgccagcttaaaagcccaggaaaatagaaaaggcagggttagtaaggaataaactcaccgaagacaaaatgcagtctaggtgattaattagccccgtctgtccgtgagggagctggttgataattggagcagaaatctttccccagtcgttgtgctgactataaaccaaaaattatctgagacaggtctcaatcaatttagaagtttattttgccaagtttaaggatctgcccgtgacacagccccaggaagtccttgaaaacatgttcccaaggtggtcaagatacagcttggttttatacattttagggagacttgagacgtcaatcaatacgtgtaaggtgtacattggtttcgtccagaaaggcaggacaacttggagtgggagcaggggtacttccaggtcacaggtggattcaaagatttcctgactgccaattggttgaaagaatttatctaaagacctggaatcaatagaagggagtgtctaggttaagacaaggggttgtggagaccgaaattcttatcatgcagatgaagcctccaggtagcaggcttcaggggaaatagactgtaaatattgctcatcagagttaaaaaggtgccagactaagtaaattctctcctggatcaggaaaaagacctggaaagggaaggagattctctacagaatgtagattttccccacaagagacagctttgcagggccattttgaaatatgtcaaataaatatattttggggtaaaatagttatatattttttaaacacctgctatctatcatgttggtatcttattgctacaaagagtctttttgtcagttttaaggtctctgttttaaccttaatgctggtcagttgtgcctaaattccattgggagcagggcataatgaggcatgtccaaccccacttcccatcatggcctgaactagtttgtcaggttaacttaggaatgcccttggccaagaggaggggtctgttcagttggctgggagttgtggagggggcttagaattttatttgtggtttacatgacccatcatgtcttggggggaagggaagtggattcacagtgacaatttattcagtgcagttccagaataactagcatcattcccttacagtaaaccatttcttaaccacctcagaatgttgggttttgggtttgtttgtttttgagatagagtctcactgtgtcgcccaggctggagtccagtgatacaacttcagctcactgcagcctctgcctcccaggtgcaagtgattctcctgcctcagcctgccgagtagctgggattacaggcgcacccaccatcaagccctgctaattttcgtgtttttagtagtgatggggtttcaccatgttggccaggctggtctcaaactcctgacttcaggtgatctgcccgcctcggcctcctgaaatgctgggattacaggtgttgtttatttcttttttcttttctttttttattttgttttttagacggagtctcgctctgttgcctggctggtgtgcagtggcacgatctcggctcactgcaacctccgcctcccgggttcaagcgattcccctgcctcagcctctccagtacctgggactacaggcccgcaccaccacgcccggctaattttttgtattttagtagacacagggtttcaccatgttggccaggatggtctgatctcctgacctcgtgaagtttacctcatttggtgattgagaattgcatggttatctcgaagtaatgcctccaggacaaaaggctgtgggctttatatgagcctgttaagcagtggtgttaaaatgggctgaactgaagccgagtaaccagtctccagcatatctgcagaccgaccacttggaagcctaaaacaagaggcagattcttttcctctgggctcaaatattctcttcttataactgaataaaatatctctatctttcttaaaatataaaaaagatttcctcattagcaccaccgccacatgttacttttggagggtcacctaattttacaagatagtgcctcgcctcagtgttactctcacttactccacccaatgcgttccaatccatgggcaaagcagctggtggtccccgctgaggggtgacggcgcgtccccgtgtttacggtccccgctgaggcgtgacagtgggtccccgtgcgtacggtccccgctgaggggtgacggcgcgtccccgtgtgtacagtccccgctgaggggtgacggcgcgtccccgtgcttacggtccctgctgaggcgtgacagtgggtccccgtgtgtacggtccccgctgaggcgtgacagcgcgtccccgtgtgtacggtccccgctgaggggtgacggcgcgtccccgtgtgtacggtccccaccgaggggtgacggcgcgtccccgtgtgtacggtccccgctgaggtgtgatggcgcgtccccgtgggtacggtccccactgaggcgtgacagcgcgtccccgtgtgtacggtccccgccgaggggtgacggcgcgtccccgtgggtacggtccccgctgaggcgtgacggcgcgtccccgtgtgtacggtccccgctgaggcgtgacggcgcgtccccgtgggtacggtccccactgaggcgtgacggcgcgtccccgtgtgtacggtccccgccgaggcgtgacggcgcgtccccgtgtgtacggtccccgccgaggcgtgacggcgcgtccccgtgggtacggtccccactgaggcgtgacggcgcttccccgtgggtacggtccccgccgaggcgtgacggcgcgtccccgtgggtacggtccccactgaggcgtgacggcgcgtccccgtgggtacggtccccgccgaggcgtgacggcgcgtccccgtgggtacggtccccgccgaggcgtgacggcgcgtccccgtgggtacggtccccactgaggcgtgacggcgcttccccgtgggtacggtccccgccgaggcgtgacggcgcgtccccgtgggtacggtccccactgaggcgtgacggcgcgtccccgtgtgtacggtccccgccgaggcgtgacggcgcgtccccgtgcttacggtccccgctgaggcgtgacggcgcgtccccgtgcgtacggtccccgccgaggcgtgacggcgcgtccccgtgcttacggtccccgctgaggcgtgacggcgcgtccccgtgcgtacggtccccgctgaggggtgacggcgcgtccccgtgcgtacggtccccgctgaggggtgacggcgcgtccccgtgcgtacggtccccgctgaggcgtgacggcgcgtccccgtgcgtacggtccccgatgaggggtgacggcgcgtccccgtgcttacggtccccgatgaggcgtgacggcgcgtccccgtgcttacggtccccgatgaggcgtgacggcgcgtccccgtgcttacggtccccgatgaggcgtgacggcgcgtccccgtgcttacggtccccgatgaggcgtgacggcgcgtccctgtgcttacggtccccgatgaggggtgacagtgggtccctgtgtgttcggtccccgcttaggggtgacggcgtgtccccgtgcttacggtccccgctgaggcgtaacagggcgtcccctcgcgtacggtccctgctgaggcgtgacagtgggtccctgtgtgttcggtccccgctgaggcgtgatggcgcactcgccgatatgagacgaggcagcgtaaaactcccagggcactcaagtcacagaaacgtggcgtgaggaagagcctcgcaatctgccggcgctcctccagcctccttctctgtccccagctggaggaggaacggctctccgtcatcgagagggacaaccgcctgctcctggagaaggtggcctctgtcatgaggaccaggggacagactgacagcaaaaacaactccaagcacaggaggtaagggagcggctcctgccatcccacccggctcagcaccaaacccgagtgctgggaaggggttggggatgagcagaagagctgcccgtgggtgggagtcgaggcgtttctgtcctctcccgaaaacagccacagctctgaggagtgcccttttccttggcggattgtgattccaagttttacttgagactcctaggctgtttccgcaacccacaactaaatcacagttagcggctgtgagctgcccgtgtgccagacactcctctgaacctgctaagcgcttgactcagaaccctcacaggaccccgtgtggtacgggctcttgtgcacctcacaggacagtaggaaacggaggcactgggaggtggcagaacttggccaaggttgcagttcggcggcggaggaacacaggctgtaccccagccctgctcatgcagttctcaaaggtgtcaagttaccaaaagcagcaaaaggttttgtttctctgtcagcagaccactaggtccagcatctttctggaaaaaacaccgaaaatcatgtacccctgcatcctgtgtgggtcccagcctgggatactggtactgctctttcataacctcacttttcacccagaagtggagttctgccctctgtgaaaatgaatatcagcaggctttcatactccttaaaatcaccttataaatgcttgactgtgaatcctaaaagcctctcttgtctaaggtcaataacctctgccccctgcatcttacacatcctagagtaacctcatagttacaccatggccctttccctgtaagtgcaagattttgatggtgattgtgatagttaattctaatgaaggggtttttgttccggaagtgcttgaaccttttaagacttttggcctgtacctatccccaagaagcttatagtagtttcagatttcataataaattaaaatataattgatcctcaggtacctcgaggtgtgtgatacaggaagattgcaggcccagcagggtgcaccactgggaaggtgctgctccaagctcaggcgggccctgcatggtcctgtgtgctggctttgttcaaaggcccaactggagcaaacctgcctcagagatgatttactgtgggcttccagggcttcaagggaagccatgggaaagtcaaccatttttctcaagaatgcatcagtttggggcttgataactggctatttcatgtctcagttgactccattctttaacaaaggacacttgccgagttaatgcacaatgctggagagaaacagttcgttttcaggggagtctcagctgcttctggagcactgcagaccagttggttgatggaataaacatatctagctagctggtcagccagtagcacaaatcaacatgagagaaactatagagccaacaattggactttcactcctgatttcatttttcatgtctttattcagatgtgattggcatacagtaaacacatattcaaagtgtatgtgataggtttgtcatatgatacacccatgacaccagcaccccagtcaagacagtaaacatattcatcactccccaggtttccctgagcctttcggtccccctacccaccaccctctgcccatcgaaggttccctatgggtgcctttgcactttctggattttatgtgtataggttcatcaagtatctgcgttttgtctgcctttcagttagcataacgttgagtagtgttccatcgtacggatctatcacaatgtgtttatccattcacctgttgatgagcatttgggtggtttccagttttgggctattacaaataaggctgcaatcagagtttatgtaaaaagaaattcagagatgaatacctctgcccaagactgaaaactcaatgacaaatggatttcaagtgggatccacatgagagacccccagaatgaccgcatgaggagctctctcaacccactccccagcaaaacttttgaaaatggttaaaacacagtcatttagagtctctgctgtatggtcctaagaagaaacatatattcaagaaaagctactgtaatttgacaagaacagcaaatgtccctggtatatgagctaaaacctgctgtctccccactgcttccagctcagcaatgcagatgcacaccagaagctgcagccaagtgcatgggctctgctccccacagctcctagtcgaagggccttcttcctggaaggggcagggccttacttttctcatcttgtctgcagttgcctgttgctgagactaaatcccaggtgagtgtggccccacgctggagatgctcttgttctgcccatttcctgtttgtggagtggatgcttagcctgcagccttgggaatggtgatcctaagactacaggagccaagatccccttggtctggttcataggcattggttccatgctgggagagtcacgccgagaagacctgtgtgtccctccaacacacacacacagtggagcacagagcctggggtgtcactcagagagaagatcgccattgttcccactccgagctccagggctctgagattttgcccagaggaagaagcagaccctcgtaacagctcccattctcttcccaaagggatggtttaatttgcaacagaatttagaaaagtgcaagcctcactggacatgaaaataaaagacatcgaaattgggaaggaagaagcaaactatttctattcacagatgatatgatcttgcatatagaaaatcttaaggaatgcactaaaaagctgtagaactaatccacaagttcaacaaggttgcagaatacaagatcaatacacaaaaatcaattgtgtttttatatacttgcaatgagcaatctgaagaggaaactaagaaaacaattccatactcaaaagtatcaaaagaataggtacttaggaataaacaaaggaagtacaaaatttatactccaaaaactacaaaccgtcatccacaaaaattgaagatctaaataaatggaaaaatatcccacgtgtatggattcagaagtcttgctatattaagatggcaatatacaaactattgcagaattttgctccttagttcagctgaaactgggtacttgtcacatgaccaggaaaatctaggcacacgaacacattgaagggtgagtagagcaggattttcttgggtgacaagggaaaaaaagaaaagaaaaagaaaactcagcaaagtgagatggagtcctgctaacaggctcccacctcacaaatggaatcccaggccaccacacaggaactgaagaggccaggctcctcccctgcccgtggcttcacccgtttccccagtgcgcatgtgggcatgtgcagacaaggccctgggcaggttccctcatctgcacaaaagcatctggtgtaaacacttgtcagatggggcagagattctgggcatttggctgtctcaaacccaatctacaaattcaatacaatcccaattagaactccagccaacttctctgtagaaattgacccactggttctaaaatttgatggattgttttagtcaaaacaatcctgaaaaagaagatcaaagtagtaggactcatgtgtccttattgttgctggggagcaatggctatctcagccagtggcatgggggtaatgaatttaccaagacagttgtaggtaaagaaaggcagatttatgagagaaagtaggaaaatacatttcgaggaggcagcgggcagcccacaggagagaggctgactatgaggagaccaaggcttgctggggattttatagggtggcatttatgctgaagagggctttgtgcagtaccaataacaccaaagctacagtgagctaacttgcaggtgtctggtaatagctcggcacaggaaaattgtgagctgtttgcgcaggagggctgcgtgttctggaccatgaagaaaggcagacttgtcgcttacctgctttatctctttgctttcccttggtcccaccagcttgactcctctttcctaattaggactccacacctatttcaaacttactaagaaagctatagtaatcaagatagtattacactggcattaagatagacatataaatcaatgggagtccatgtgtctataatcaatgtattttcaacaaaggggccaagaccattcagtgaggaaagaatagtctttccacaaatgctgagacaactctatcgccacatgcaaaagaatgaagttggactctcacctcacaccatatagaagaattaatcaaaaacggatcaaaggcctaaatgtaagaactaaaaccataaaactcttagaagaaaacagtgggaaatcatcgtgacttcagatttggcaatggagtctaagatatggcaccaaaagcaggaatgacaaacaagaagatacataaactggacttaatgaaaattaacaacttttgtgcatcaaaggacactatcaagaaagtaaaaaaaacccacagaatgggagaaaatatttgcaaatcagatacgattagggacttgcatctagaatacatgaagacctctcacagttcagtgataaagacaatgacctcattaaaagatgggcagaagatctgaatagacatttctccaaggaagacatacagatgattaataagcacatgaaaagatacttagcatcattcatcatcaaggaaatgcaaatcgaaaccacaacgtgatagcacttcacgcctatcagattgactggaatcaaaatgacagataagaaggagtgttggtgaccatgtggggaaattggaaccctccagggctgggaggaatggtgcagccacttgggaaaacagtccagaagttcctcaagtgattaaacatattttaataaatatatggggattaaatatatttaccatataaccaatttcactcccaagtatataaccaagagaaatgaaaacatgtctacacgaaaacatatacaattgatttttgtgtattgatcttatattctgcaaccttgttgaacttgtggattagttctacagctttttagtgcattccttaagattttctatatgcaagatcatatcatctgtgaatagaaatagtttgcttcttctttcccaatttggatgtcttttattttcatgttcagtgagggttgaacttctctaaattctgttgcaagtgaaacagcatttagaacagctcgtccctttgggaagagctgggagtggagacaatggcaatcttctctctgagtgacaccccaggctctttgcttcattgtgtgtatgttgtggggacacacaggtcttctgggcttgcctctcccatcttggaaccaatgcctgtgaaccagcccaaggggatccgggctcctgtattcttagaagcacaatttccaaggctctaggctgatcctccattccataaacaggggctgggcagaacaatgccacactcacctgggacttagtctcagcaacaggcagttgaggacaagaggagaaaagctgaggccctgcctcttccaggaaggaggcccttcgactagaagctatggggagtagagcctgtgtgcctggctgcagcctctggagtgcagtctgcattgccgagctgggaacagcagggaaagagcaggtttcagctcaaatgccagagacatttgccaaattacagtagctttttttcttttcctttttttttttttttttgagacaaagtcttgctttgttgcccaggctggagtgcagtggcacaatctcggctcactgcaacctccacctcccagttcaagtgattctcctgcctcagcctcccgagtagctgggattacaggcgcgtgccaccacacctggctaatttttgtatctttagtagagacagggtttcgccatgttggccaggctggtcttgaactcttgacctcagatgatctgcccacctcagcctcccaaagtgctgggattacaggcgtgagccaccgctcctggccagtagctttttttaaataaatgtttcttcttaggaccatacagcggagactttgaaccctaaccctaaccatataatggaatattgcccagctatgaaatggaataaagtattgacacgggctacaacatggatgaactttgaaaacatgctaagtgaaagaaggcagtcacaaaagaccacatattagacgattccacgtatatgaaacaaatctatagaaacagaaagtagatcagtggttgcttaaggcaagggtatggaggggtagcaagatgataaagggtccagggctccctaaggaagtgatgaaaatcttctcaactgactgttgaggactgtgggcgtctccccattgaactgcacacgataaatgagtgacttgtatggtatgtgaactgtatctcaaggaagaatctcactgcttttgggggcttctaagacccacagcccattcaccaaacctactgcaaatggcaagggaccagggtcactggattctggccttctctggtcagctggatgtgtatggatgctcctgtatgggatcagggaggagttcttgccttaaagggacaggcattgaaatgccaacaaaaagggacccctcccagacccagtgcaattcctgaggggataaaagaaagaagctgtggccctggcacaggctgccaagcatcaccaccgcatggcagcagtgtccccgcatccacctggtgtgggcaaggcacaagctcagcctgagccccatctgctcccctgccgctgcaagggcagcaccatgcagggcacacagaaagtcctcagggctcgcaaaccagaaagtatctagacaggtctcaaacaatctaggggtttatttgccaccattgaggacgctactgggatacggcatggacagcgaggggaggggtcccgttcttgtgaagcttgatattacattgtaatatagaatgaagtaattatacaactcaacatcatgtagaatcagtgggagccctgagtttgttttcctgcaactagatggtcccatctagggatcgtgtggagacagtgacagatcatcaggcattagattttcataaggaacacgcagcttagatctctcgaacgtgcagttcacaatagggttcacactcctatgacaatctaatggcactgctgatctgacaggaggtggagctcaggcagtaatgccagcaatggggagtggctgtgaatacagatgaagcttcgctccctcgcctgctgctcacctcctgctgtttggcctggttcctaacaggccacagactggtatgggtccatggcccgggggttggggacctctgccttatagggaaaactgattagatcattgttctttgcttgtaaatgttctcatgtagccaactagactttgtcaccaccaccatttttttccctagagaggctatgtggtggcttttaatcccattttggctctacaactcaggtccaaaatatgtcccatgctcttcctctaagagaagacattggccagaaagcaaggagaagctgtatccagaaagtaaagaatctgtaatcaatgcatctccttgggtcactcggcagtttcaacattccatggagctggtaagatctgtgagccaggctcttggtgggacctcagctcactctgccgtctctcccagctttagacctgggcttcacgacttctagctgtgtgaccttggacaaattgtcaggttctctgctccttggtttccccatgtataaaataggaactcctgtgcctttcttgtaggcttgtcatgagaatgaaatgagttaatacatgcaaatgcttagtgctcagcactcaataaaagtcagccaatatcgttgttgctattagcttcttcatatttcaaatacggatttctttaactttttcgtgccacgacctgctttggaagaatggtgacgtcatagactcctgaaagcagtgtgcttaaatgaatagaataaaatccacacaatttgacaggcagccaattatattgaagcacgttatcaaaataattctttaaccatgacaaaataattcatgtgcttatttattaccatattaaataacagaaccctgcagcaggccctatagccaccaaaattcacctaagtgataagtatgaataatgttccaaaaataagcaccaactgtaatatctgaagtttctcttggtgataaagtcataggttaccgtgtttgttgcctccaattataatggaagaaaatgctgaattacagctaaaaactggtgaaaatatgacgcaattgctttcctatccaggttcatggatgcctgaattctatccatggttttctggactatgtgccaaatctcccagcccatgtctctaggatttggctctggctgggacgactttgggaaccttgctatgtgtccagttttctatacagaagcctggacaagaaccccttcctttgggctgccagaaaccacaagatgcgagttctccctgccgcctccaatatgaataagcaggtccacaaccaaagacagcctcatccctcagagaattaaataggacccctttggtttttggatatagaaggtgatttttaaagcctggaggagaatttggctaaatgaaaatttagggaggaaggaagacaaatgaagccagctaccgattactcatgaaaagaaaagagaagaaagcaagcaaggataatccacaaagaatggataatagagaaacattccctttctgctgccgtgaggaccacagtgaaacaggagctcgcttgccactgccatctgggcaccatcccgctgtccgcatccaacacagctaatttgctccagtgaaacttcaagtagccaaagtcatcatttaagcacagtaaaagaaagagaagacttaattggatgacatcaatttgcacaataacacgagtaggtggtctcatagaagaccagataataaagtgaacaggtctgcctggaataataacaaaggtgtcagttaaaacgatgtctcaagtacaacacctttctcctccgtgtctcaggggcccttcctggtatgtgaaaagaaatctagagtgttcgtgtaggcctagctcttactcagctttcagccttcacctaaatgtcacatggagaggaaggtcctgatggtctagaggaaggaaggtctagaggaaggtcctgatgcccaccagtgtggcgctcattctgtgctcgttctggctccaccgttgtgtcttcctttaccacgggcaccacagttgtcatccaagcagccaaagtcatcatttaagcacggtaaaagaaagcacagtcacttacttgtgtgttgacctgtctactgtctgtcttcccactgaatctcaagccttatgattccagggactttgtctcttttgtttatcattgtagactcaatgcccaggccaatgctcggcacatagtaggtactcagtaaatatttgttgaatgactgaacaatcaaatgaggtcaccagtgacttcccagttgctcaatttattgaattgtttccttttaaagtttaaaaaataatgtttttattgttcctgattataacataatacatatttatggataccaagaagaaatttaactatcatttcatcacccagagagaatactttttgtatattttctgcattttgtatatttttgtatattttctgcatttccaaatatataatagagttatatttttgtgcacatatatgtattaagtataattaaaattgtaccttatatgtgatcttatatcctggcttaagactttttacatctcattgaaacttttgaacaccacttcaatgggttcatcactttcttaatcagttccatattattaaaaattaattcagaattttcactattatcagtgatgctgaaagggacacttttatgcattaatttcatgtggactcttccatcctactctttttatgttgagtgactttgctgattttgacccactgtatttgaccctcataaaatgtcagtttagtttgatccgatctaacccttgacctttctgcagcttttaacattagcatccttgcccctcctggttgtaattcactcctgactttctgcacttcctacctccctcactgttttcttctgccctattttcttctgctcccgtggctcagcctttggctgcctccctgcctgtctgtcctccatgggcaacgttgcccagcaccacttcgatgctgcagatttgattgcagatccaggtcttcagccctgttgtcactcctgagcaccagcctaccagatggttccacccaaatgttccaccccagctcaagcccagctccagccccaccttggatggcttcagcctccaccaggctgccaacagtgcctccctctcaggtcactcccagggttaaatgagagaagcacatttcattgatacacacacacacacacacacacacacacacacacactttaatggctctgagatggagatgcatcttgcagcacatggtgtgctatggttttccaaaacaacagatgcaatctgtcaccaatgaaatgaaatatgcacaggacagtgcctggcacagaggaagtgcccaacaagtctccagagggtgatggtgaacttccaggaggaggccaccaaccatccaccattattccctgcttccacaaatctccctagttcaccaaactctcagccctaaccctggtgggttctttacttcgtgctcctctgtgctccacagccagggtcaaacccctactctaggcgcttccgcagccccccatggctccctctccatccaatgcagcctcctgaacaggtttcaccggtcccatctcaccactgcagtgggctggcatcgatgcccctccctcccacttcatgctccccagtccagccccagcctgtccacaggggtctttctcaagtgcctgcggagtctggtttgaagccattcagtggctccacactgtcttccacatgtgccagactctgtgcactgctagaccctccaaaatccaacccctgccaacctccctcacctctctcccatgggcgcctgggtgcttgccctccccgcctgggaccctgctctccgccatgggtgcccgggtgctcgccctccctgcctgggaccccactctctcccactcatcttgtccagcatctgctctgctgaccacgctcaggaagcaccgggagacttccccgctgtgccccattgtgctcaccctgaaaacgcccctcccgccgtgcaaagcgagcgcgccggggctgagtgtgcccttcgctcctctctgagccagcagctcccactccagcacctggagaaccggtttcttaaatgttggttcagtgggaagcaggagcaaccctccaccccgggaccccttcctgctctggagcctgttggccctgtggagggaatggcagccttaataaaatccaaatttcaaaatgtgtgtgctctttcgtggagtctgcacagggggaagagagaacaggaacttcgcagagtgcggaagaaaacacggccattctggaaggaatcacacactcagaaccatggtatggagctcaaaggtggtgtgaagactggggcagggctgagaagtcccgggtgctggtgtggaatctccctggagacagcagatacgcctagcaaaaaggtacccgcaccttctttttcatctaaaatccatagctatttgaaatttcccgttttacttcatcagattcatcagaattatgtactcactcattctttgccgtattagagcattttgttcaattgtcagcaaggatatgtcaaatggtcacatcctgtaacaggagatgcaaaacagtcactcagctgatgacctcacccaccacgcatttgttcacgaagttgaggaaattaaaataagctcagctgattgattgtagattgtgagagaaagatttggtgaaaataacttagccagatagtatgcatacaacatcattaacatcaggttggccaggcgcagtggctcacgtctataacccccagcactttgggaggctgaggtaggagcatcgcttgagctgaggagttcgagaccagcctgggaaacatagtgagccactgtctctattaaaaaaagaaaaagaggcagggcatggtggctcatgcctataatcccagcactttgggaggccaaggcgggtggataacgatgtcaggagatggagaccatcctggctaacacagtgaaaccctgtctctactaaaaaaaatacaaaaaattagccaagtatggtggcacaaaattgcaatcccagctactcgggaggctgaggcaggagaatcacttgaacccaggagacggaggttgcagtgagccgagatcttgccactgcactccagcctgggcaacagatcgagactccgtctcaaaataaataaaataaaaattaaaaagaaaaggaaaaaagaaaaaaagaaatcatgtgatgatcctgaattagctgtcccacagaatccaaaatggaaagagttaaaaatttgagtttgtcccacaatttaagttctaaactctcttcattttattcaaattgacaaaattgtaattgtaaaggaagaaccatgagatttaaattttgtcattaatatactgcttataaatatccccaataaatcaaattaattaaagagttttaaagatcttccatcactcgctttacctgtatatataaccgttatattgtggaccattataatgtggaagattgctttccttaaaatccagcccatcataaggaaaaatatgtagacaccaaagattaaataaatgctccaggaccatggaccccacccctgcacaaactccagaaccacagaccccacccctggacaagctcaaggaccacagaccccacccctgtggaagctccaagaccatgaaccccacccctgcacaagctctaggatcacgaatcccacccctatggaaactccaggaccacagaacccatccctgtggaagctccaggaccacagaccccacccctgtggaagctccaggaccacagaccccacccctggacaagctccaggccaatgaaccccacccctgtggaagctccagcaccatgaaccccacccctatggaaactccaggaccacagaacccatccctgtggaagctccaggaccacggatcctacccctggacaagctctaggaccacagacccccacccctgtggaagctccaggaccatgaaccccacccctgcacaagctccaggaccatgaaccctacccctatggaagctccaggaccacagaccccatccctgtggaagctccaggaccacagaccccacccctggacaagctccaggaccacagaccccacccctgtggaagctccaggaccacgaaccccacccctggacaagctccaggaccacaaaccccacccctatggaagctccaggaccacaaaccccacccctggacaagctccaggaccacagacccccacccctatggaagctccaggaccacagaccccatccctgtggaagctccaggaccacagaccccacccgtgtacaagctcctaaccctaaccctaaccctaaccctgaacgagcttcagaaccacagaccccaaccccggacaagttctaggatcacaggctctacccctgcgcacctacttgaagtagcacctcattgccttgccccctgcagtttccacaggtatttgtgctgatgtcagctttgcagtgcttccttccatgcttggtacaacatcgtaagcccagctctgctgcttgctggacatctcttatagaatcccgaagagtgaagagaacaagtacctgtgcaaagacgcatgactgttaagcagctactaactctgaaggcattcagaaaatctagtctgctttgcaatttacattgaaattttaaacatttcaagtccaatcaattttctcaaatcttttaactacaaagctaatatttgctttctgtaaaccataaaatgtcaaacagtatagagggtgtaaggaacatgggagtcttctcttggatggcagcccctggaagtaatcactgttagcaacttgcatgtgaactttgatttttatttgtcaagtacatatatttgaggttttgtttgtttgtttgtttgttgagatggagtctcactctgtcacccaggctggagtgcagtggcgcgatcttggctcactgcaacttctgccacccaagttcaagtgattctcctgcctcagcctcctcagtagctggggttataggcatgagccactgcacccggccatatttgtttgtttaaacaaaaatggagtcctactctacgtagttttctgtaaattgctcatttcactcaataatgtatcatacaaatagtttcattccatacatgaaagtcttcttcattccttttttagcaattacaaaatattttatacagatttgccttaatttatttaatcagtcccctaattattgaaatttaggttgttttcagtttttcgatattccaagtgaaactatgatgatcatcttaacccatatgtatctttacacaaaattatgctgtaacttatattcctagaaggaaaatggttaaatcaaaggtaagcacatttagattttcaatggataccacctaattgccccccacaaacagtctagcaattttcacctctgcttaaagtggtcccaaagtgtctgtctcctcataattttgccaaccctgggtagtaaatatatttttaaactttggaccatctgatttcttcttgtatgaattgtctgttcatagcctttgaccaaattcttatcatatgttacttttcgttattaatctatagtaagtatatgttatcaatatttaccttttttctattatcaatgtcataagtatctcttccacattattacttatcaattcacctaagtttattttaaggtagtcaaatccatcaataatttcccttatggcatctggtctgtgtgccatacacagaaagggctctctcaagctaagattatgcaagtattctcctgtattctcttctaatactataagttttcttgattacctttcagtttttagtaaatatggaacttaataactatggaatttttgtgtattgtgcaagttagagatcaatgtttattttttcagtttattacaagttattaaaaatcagtttacaatgtcaaaaactctattcttcacacttcatagaaattgttctccagagatttgtagcagtgctttcccatgtcctcaccaacatgaagggttacccgtgggggcactctttgctcatttcactgccaaaagcagtgtctgctttgatgctgtccctctttgactacaggtgagacgctttctccctcactattctctctcacaatgacagatcactgtggtgatgtgtcacaattccatctgtgggctgggctcaggtaggagagtcaaattgctcaggtgcttggcagaggcttatgtcaaagtcaaacctgcaggaagttttggggatgagatttaacaatcccgcacatgtcttgtttctaggtatgagagtcagcacctcctatatgttgggtctaagtacacaagtcacaatctcactagtggactgaattcgtgcatgagagcctcccagagcctcccacctcttctgctggctttgcccttgtgaaatcacagccccacaggtgtgcttctcccagcctgtctgtgtctgcgacactccttctccagggatctcagtgcttttatccacattgtcacctccactgccctcctcccggcttgttttcagacatcattttattttttacttatttattttctgttatactttaagttctagggtacatgtgtacaatgtgcaggtttgttacatatctatatatgtgccatgttggtgtgcctcacccactaacttgtcatctacgttaggtatatctcctaatgctatccctccccactccccccaccccacgacaggccccggtgtgtgacgctaaccttcctgtgtccatgtgttctcattgttcaattcccacctatgaataagaacatgcggtgtttggttttttgaccttgcaatagtttgctgagaatgatggtttccagcttcatccatgtccctacaaaggacatgaactcatccttttttatggctgcatagtattccatggtgcatatgtgccacattttcttaatccagtctgtcattgatggacatttgggttggttccaagtctttgctattgggaatagtgctgcaataaacatacgtgtgcatgtgtctttatagcagcatgatttataatcctttgggtatatgcccagtaatgggatgactgggtcaaatggtatttctagttctagatccttgaggaattgccacactgtcttccacaatggttgaactagtttacagtcccaccaacagtgtaaaagtgttcctatttctccacatcttctccagcacctgttgtttcctgactttttaatgatggccattctaactggtgtgagatggtatctcattgtggttttgatttgcatttctctgatggccagtgatggtgagcattttttcatgtgtctgttggctgcataaatgtcttcttttgagaagtgtctgttcatatgctttgcccactttttgatggggttgaataaagaataaaagagagaagaatcaaatagatgcaataaaaaatgataaaggggatatcaccactgatcccacagaaatacaaactaccatcagagaatactataaacacctctacgcaaataaactagaaaatctagaagaaatggataaattcctggacacatacaccctcccaagactaaaccaggaagaagttgaatccctgaatacaccaataacaggttctgaaattgaggcaataatagcctaccatccaaaaaaagtccaggaccagatggattcacagccgaattctaccagaggtgcaaggaggagctgataccattctttctgaaactattccaatcaatagaaaaagtgggaatcctccctaactcattttatgaggccagcatcatcctgataccaaagcctggcagagacacaacaaagaaagagaattttagaccaatatccctggtgaacatcaatgcaaaaatcctcaataaaatactggcaaaccgaatccagcagcacatcaaaaagcttatccaccatgatcaagtaggcttcatccctgggatgcaagcctggttcaacatatgcaaatcaataaatgtaatccagcatataaacagaactaatgacaaaaaccacatgattatctcaatagatacagaaaaggcctttgacaaaattcaacagcccttcatgctaaaaactctcaataaattcggtattgataggacgtatctcaaaataataagagctatttatgacaaactcacagccaatatcacactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtttgcagatgacgtgattgtatatttagaaaaccccatcatctcaccccaaaatctccttaagctgataagcaacttcagcaaagtctcaggatacaaaatcaatgtgcaaaaatcacaagcattcttatgcaccaatagcagacaaacagagagccaaatcatgagtgaactcccattcacaattgcttcaaagagaataaaatacctaggaatccaacttacaagggatgtgaaggacctcttcaaagagaactataaaccactgctcaacaaaataaaagaagacacaaacaaatggaagaacattccacgctcatggataggaagaatcaatatagtgaaaatggccatactgcccaaggtaatttatagattcaatgccatccccatcaagctaccaatgactttcttcacagaattggaaaaaactactttgaagttcatatggaaccaaaaaagagcccacattgcaaagacaatcctaagccaaaagaacaaagctggaggcatcatgttacctgacttcaaactatactacaaggctacagtaaccaaaacagcatgatactggtaccaaaacagagatatagaccaatggaacagaacagagccctcagaaacaataatacacatctacaaccatttgatctttgacaaacctgacaaaaacaagaaatggggaaaggattccctatttaataaatggtgctgggaaaactggctagccacatgtagaaagctgaaattggatcccttccttacaccttatacaaaaattaattcaagatggattgaagacttaaatgtaagacctaaaaccataaaaagcctagaagaaaacctaggcaataccattcaggacataggcatgggcaaggacttcatgactaaaacaccaaaagcaatggcaacaaaagccaaaattgacaaatgggatctaattaaactaaagaacttctgcacagcaaaagaaactaccatcagagtgaacaggcaacctacggaatgggagaaaatttttgcaatctactcatctgacaaagggctaatatccagaatctacaaagaactcaaacaaatttacatcattttatttttaatatctttgggtcattttattttatattgtctcataaacagaatagcataattttgcattttaacctagtcccagaggctttccccgctcagttttatccatttatatgtattgacataagtatattgtatttgttctcatttctggctcttttgttttcatttccttacttttcctcctcttatattaatactattgagtttttcctcagcaaatgtcaagacagtgcttgcaaccaatgtttcaaatttatacttcatttactttctttggctctcttattcttcctgctttatgtaacaggaaacagataaagcccaccacaaaagcaatgttaagataaagtcaaacaaaaaaagggaaaacagaagcactagaaagagtttcctgcagccacagaccagtcactgcactttattgaagtccccagctttggcaatatggttcaagtgtaggctccaagacagagctggggaggggcaggctcttgcaggacactggctccgaggcatgcctcccccactgccctgtacctggacaaaaacgggaaacatgggaaacgactcattgtctctgaacctcaagctggaattatggtctgtgtgtcccaagaagatggctttctcagcagcatctttaagctcctagggcctttggctcctgtgtgtgagggaggaaggaggcgatgggcccagggccatagggtacctcagtcttcagtccccttctctgccatggggtctgcagttttgaactactggaacgtgaatgcgtctctcggtggtgcttccccaccttggaaacagaccagccacgtaccaagctggcgacgagggagcacggcacacacgtcttctcattttagaaagaaaaacaaagttaatttatttgaaaactgtaggtttaggaaagaaaaatgctaagtgttatgagaccagaaacctgaaacacagccttcagaagaccctcctgggcccagcggccaccttgacctgctgttggaccacctccctatggttcggccagctgccagacctttgggatccgggatctttgctctgggatcttcgctggcctcgcatggatgggacacatcactttacctttatagtcccagaaattcatgacactggcagagaaccccttccctgctctccagagcccaggcccctctcctctgccccaaagcttcacctgacggaggctgtactgctagtctcctggatatctcaatctggtttaaatattaactcgcaaaatttctcaaacattttaaaggaaggatttcaattttccatcctccttaccccttcaagtcatttatccctaactccaaaatgagaagataataattttgtacctgtttctactgaaggatttatataagattatccaacaaaacccactggccatcctggcacttcctggagcccccagctaactggaagtatgcattgctctaatttagtgccccaaccccaataactcctgcacatgagaaagaagcaaaaattaaacaaacacaaatgatctccaggagcaaaattagctgtttaaataatcggctgactcagtgcaggttgacacaggacacacaatggatgtgagttggctttgagctccttggcctccaaccatcatctcggacaaaagctcagcctcggggagccccattctcgcttctaaagatgggacaggaaccacctcctggacctcacgtcagggttaagtgaataacatttgcaaaaatgactgtgaaagtgactcacacttggctgggcatggtggctcatgcctgtaatcccagcacttcgggaggccgagacaggcggatcacgatttcaggagatcgagaccatcctggccaacatggtgaaaccccgtctctactaaaaatacaaaaattagctgagtgtagtggcgtgcgcctgtagtcccagctactcaggaggctgaggcaggaggatcgcttgaaccagggaggcggaggttgcagtgagccgacatcgcgccactgcactccagcttaggcgacagagcgagactacgtctcaaaaaaacaaaaaaacaaaaaaagtgactcacacttacttggcaaaagataaatttgagtttctttcctttttcctcctgaaggccctttaccatccagcaacaagccaacatggctcagtttactgattccgggaaaagtactttgctgcatttcagaaagatgtttaacaacaaaactgacaaaaggttatctgattatttgaatagagatttctcccaacaggatatacaaatggccaataagtgcatgagaagatgttcaatgttattagtaaatgcaaatgaagaccacagtgagatgtcacttgcagccactaacttgtctgcaatcaaaaggtagattacaataaggatgtggagaaactggaaccctcataggctgctggtaggggtaaacagtggtatgtatacatatgtaacaaacctgcacattgtgcacatgtaccctagaacttaaagtgtaataaaaaaaaaaggaaatgaaataaaaggtacacaaacttaaaatgaaaagaaaaaaaaagagtggtgcagccactttggaaaacagtttggtagttcatcaaaaagttaaacagttaccaaatcacccagcaactccactcctaggtctatattcgagagacttgaaaacatacattcatgcaaaaacccatacactgatgttcatagcagcacagttcacaatgaccaagaggtgtaaacaacccaaatgtctatcaactgatgaacagataaaacgtggtatagccatagaatggaatattattctaccataaaaaggaatgatactagttacagaatggataaaccttaaagacattattatgttccgtgaaaaagctggatactaaatgccgcatgttgtctgatcccttttatatgaaatgtccagaataggcacattcaaagagacaaaaagtaatcagtggttgtcggggctgggggaagggaaattggggagtgatcccaaaggagtttgatttttggagggggaggtgatgaagatgttctgaaattatattgtgacaatagttgcacaactctgaatataccaaaacacactaaaatatacactataaaggggtatagaattgtatctaaataaagctgttattttaaaaattgtatgtttaattctaagtaaagacttgtcaatgagttgaaatattccatttcccaagtaagttgatagtttcttgttcttgcctaagaaagcgttagtttcaaatatgtattttaaatccagcaggaagtgaaactggattagcaagcgcacagccaagcctggaccctaaaagagaagtgaggaagggtaaggattcagaacacaaatccagaaagaagacaagtgtgatgagggagtcacaaggaagacccacaaggccagccatgagctcccccaggctaacacagccagcggtctcagggcagtgtggggaatcagccttgcccagggccggggccagggcagccccgctgtcttcctctcttcactgttatcacagccggagcagctgtgaagtgcccaggaggcagctcctcaaacggtgtttcaacaatgtgcccgagcagatgacgcagcaaaactattttctgtgcttcttggactctgataactggaaacaaactatgcagagtcatgttaggaggtgagggtttgaattagattgttttctctagctatgaagacttattctgttactgtattttgagctgtggtggatttgtctataattcctaggtggatttttaacttaccttaaaagctctgtgattgttcctttaacaaatatctaaataaatcagattaaaatttttgaacgtgatgaaactacagcttgactccagaatacataacctaagatataaaaaagacccagagggccaggcacgatggctcacgcctgtaatcccagcactttgaggggccgaggtgggcggatcacaaggtgaggagttcgagaccagcctgaccaacatggtgaaaccccatctctactaaaaatacaaagaagttagccaggcatggtggcgggcacctgtaatcccagctactcagaaggctgaggcaggagaatcgcttgaacctgggagatggaggttgcagtgagccgagaacgcgccactgcactccaaccggggcgacagagcaagactccatctcaaaaaaaaaaaaaaaaagaaagaaaaaagaaaagaaaagaaaagaaaaaaggacccagagagtctcggttggagacatcaagggtatgtctgagagcccttgggatctgcttagttctctatcagccccaggtaagatcccgcctaagctgttccacaacaatgaacatcagcccatgggcaatgccttttaaaaatgagttaaaagactcacacacaccttcattcattcaacagaactctgcatatgtagtctcagcctcatggagctgatagctagcccctcagaaatgtcacggtccctaactactctttgctatttatttatttattatttttattttatttatttattttttgagatggatgggattacaggcacatgcaccaccactcccagctaatttttgtatttttagtagagacggggtttcaccatgttgaccaggctggtcttgaatgcctgacctcaggtgatctgtctgccttggcctcccaaagtactctttgctatttttaacctatattatagatttaaatttttgttttgttttgtttgaatgaaaataagaagataatttcaggctgggcatggtatcgcacacctacattcccagcagtttgggaggccaaggtgggagggtcgcatgagcccaggaattcaagaccagcctgggccacatgatgagaccccgtctctaccaaaaaaaaaaaaaaaaaaaaaaagaagcagcagctaatttcattccttatttcattcctttatgcacaagcccctttaaaatacacttgacatgaatagcagagcttgcctccggctcctccatgcagaattcggcaatcccaggttcctcaccgctcctcagggtggaccttccattgacagtgtttaaaatcacagactgtggggtcagacaggcctggatgtggattctgggtctcctgctgatcccccgagtggacctcccgaagcctctcctgtgcagcaggtggtgctggagcctgagatgccggcatcgggccgggaggagctgggcctctgcccactgcagccatgacctctccaggcagccccgcccccctgtgtcgtgaagcgcaactgggcacaggacctccattaacagtccacgtctgtgctaaacttgatggaaaaaatggcctctccatagcgatttgtgtccttggtttgcaagcctcgaatttgcacctccttttcgaggtggcagtttagggttgactctggcagcattttccgaatgtgcctgcctgtgtgtccccaccttgttccaccccacaagggttgtgctgtaggagtcctggcctctgccagccctccctgatgggccctaatgcaatgaacgtcaaaggatctatcacaaaactagaaaggctgctgtctggtcctgagaacattgttctcttttcaatctctctttccagagagcaaacagtttataaagactgacaaattgctacacatagtcaagaagtagacaaaatcttgccattacacagaagagccataatgtcagctcttttcccttctggactttgctcagagagtcagtggacaaatgagcatcctgccagcagccttagtgtaaaaaccagccacccacaagctctgatgacctgaaaagtcaagtaccaggtgcattttcagatccagagatgtgtctgtcccatgttactctgggtatcaaattaattgaaacctatagaactttgaaatgctttaaaaccatcataaatataatggatggagcagtgaggacagaagcctgtctatcctgtgtgaggtgggcacacaggaaatacgtgttaaatatagaaaggaagaaaataaaggagggagagaagaagggagaagggaaaagaaggtagaaaagtagtcctatagtggaagaggaggggaagagacagaaggaggaggaggaggacagaggagggagggggagggggaagggctagggaggggaggagaagtgaggggggaaaggggaggggaggaaggggaggggggaggggggaggggaaggggagggagggggagggaaagggggaggggagggagggggagggaaagggggaggggagggagggggagggaaagggggaggggaaggagggggagggaaagggggaggggagggaggggggatggaaagggggaggggaggagaagcgaagccgggggagtggaaggggaggggagggagaagagaaggagggaggcaaaaaggggagtgggaggggactggggaggacggacaaggagaaagaaggaggaataagaattgcaggcgtggcccaggctggtactggggtgggggaagggagtgccccctgcagaacaggaggctgttgccctagggtatgcagggctcacctgaggagcctccttcattctgagccctgagcgcctcctctgcctcactccggtccccaccctgcagtggtgaagccaaagtcggtaaagcagtggctgctgtgtgttttctccaggtcagtgggacatggggctgctggacatctcagccctttggccgtggctctgccgagtttgatcgccacactcttccctgctgccaccagaagggtcacacaaggccactctcaggactcccagacctcatctgtctcagagaagaacgaggccactataaaagggtgatgtctttggccttagggggcgtgtaggcccctctggttgcgatgtggatagagttccagatgtgagggaatgttctggaaatgcaacctgggcagctgatggagtccaggcccttcgggtgctaacgctgtgaaacatctctgtttcagaaatgggtgccaagcctggagggcaggcttgcttagcaaagaaggcaaactctggtgagctacagctgggttcagcacatgggtctggtagggaaacacacattgaaacgttattaaaaccagcaagactgacacaggcggcagactgtgacgtctgtcccatgttacactgagcttgttttcaggtccggagatgtgccaaagccgtgccacactgggctggagccactcgtgaaatgtcattacgctcacacagctgcaaagttctcagtatttaccaactaggacttttcttgtattggtatttgtttaattgtcttctctcctcaacagtaactataatgtcctaaaactccgtagacaataaatagttctttaaagaccagatttagttttcatgtaacctacaggttggggaaggggaaccacaaattgcattgaccctcaaaacagtggctgaaatggaaagaactccttaaacggaacccttggggaatccatctgtaaagccccattgcctctcagattctgtgatctgggcctcgagacaaccttcagagtccctcgctgcatgagtgcatgtctggtcagagactttcaaaaactgaaatgccccaggccagcagccatccgctaacaaggaccgtggagaaaagcccatggatgcgtggagaaatggtgcccactagtggcgatctccagaatggacgtcctgtgaagtagatgccgctggccggcggtggctcacacctgccagcacctcaggaggctgatacggcgggggagtgtggggggcggggcgcattgcttgagtctggaaattcaagaccagcccgagcaacacagtgagaccctacctctacaaaacatacaaaaactagccggatgtggtggtgcctatggtcccagctactcaggaggctgaggtgggaagattgcttgagcctgggaggtttaggctgcagtgagcagagatcacaccaacgcactccagcctgggtgactgagggagatcttgtctcaaaaacaaacaaacaaaaaagatccggctgactgaagtacccaggcaaattaaccagacacttggagattttctcattttctacaaggctgaggagaaattttaaggagcccacaattccaacaccccatcactctttctcatgtttttcccaatattttcatcaaatcataaattgtggcaaaataatgtataattctcaatacatacaaagtaactcagaataaggaggactgatcaagaagaatgtaaccaatcaccaagtgccacattcactgaaatcagcaattcataagcatagttatatgtgtggtgttgggcaggggggctgtggtgtgtgtgtgtggtctgtgttgtgtacaccagtgtgtggtgtgtgacgtctgtggggtatgtgtgtggtatgttgtgtgtggactagtgtgcagtgtgtagtgtgtctgtgaggggtgtgcactagtgtgtggtgtgtgtgtctgtggggtgtgtgtgtggtatattgtgtggagtatgtctgttgggtttgcactagtatgtggggtgtggtatgttgtgtgtggtgtgtgtggactagtgtgcgatgtgtagtgtgtctgtgggggggtgtgcaccagtgtggggggtgtgtgtgtgtgtgtctatctccagattagatgatttcctgctttttttcagtgatatactgctgtcatttttaaaaattatcctcagcactatgtttcagacaataatgataacatgtcttggcataagcaagctgtgtgttaataaaatatttttgacactgagcaacacctgtaagcattgcaaactatccagaggcagttgtttttttcacacatcactgtaggaagcttttcctcattcatcttatgggccctcactcactgcgttccagccagactaggtttctttgcattccctgaatgccctgggccttctcccacctccactccctcccctatccactggttcaaccaaatccttcagttccatcttggcgtccgtttgaggaccgccactgtggcctccacaggcgtcaagcctgtgttcgcagggccctccacaatctgcactccgtcacccgctcctggcagaacactggcacaggagaccaaagtacacgtggatgagtcaatcagaagaacaacttgtactagaaagtgctttcccaaatttgacatcaaaattgagaccagtgaacactttcatggctcatgacaaagttcatatccacctaacacaaaacgagggcattattcagttaatttgatatactaaaaagataatcagataaccagctagagattatgacacttctgaattggctgttaccctcatgtcgacggggctggacccgtgtctgtggacagcagtctttgagaagctgcagcgggagcctgtgcaggatgactagtgttgcagtgtcctgggggtggtgggacaggatgctaggaagaaaaggcgtccggcacctcaggatgctctgtccgggtggctcagcttgcttcccgtagcctcccagtccttttactgaagtttcaggaggtgatgcttgggacgccaggcctggcagattcctctccaggcttcccttcaccccgcagagcttccccgcactggcagaactcgatcactgccacccagagggcattgtctctgaagaggcatggagagtggggaagctgcaaaccccaggctgatgttcttggtgtccccacagcctgcttttgccttaaaaccccaggtatactcacaaatgggtacaacacccaagaggccattgtcagctcagggacttggttttaggtgcggctttgggaacttgcttaggtaagttagccttgctgggtcttattttccacatcagtaagtgccacgaagcttaacatttataagccaacagaatgcctcaattttaattaacaaacattaattatcaatcattttttacctggatggaggttaattcaaaggaaaggtattaacccagagggtttttctttttaagagtgttattgtggtgcccatgtcccggcggggaagctctgagcttcctctgcccaactctgcaggcgacgcttatggccccgtctgtggcgtccaggtgcacctggacaggtctccaaggcagcgctggagcagatttgcagccacagggtgtggagaaatgcaagatgaattgagacttgatgtttggatagatgttaattccaaacttgagaactgtctttgtaaaatgacaacaaagacgtatctgccaatcattgacttcttaatcactgcctttgctctttcaaagcctcaacattttgcagtttcagccaacagaattctctaactttgtaaactgctctcctgtggcgacaataccacctcactctaatcagtgagaagggtgattgttctctcttcctttcagagtaatttaaattcttgagaaaccacttggcatgtttaatattctggtcatactgaaaatccaagtcttgttttcctgaccgtatttcaggaactagtttaaggacggaattatcttttaaaaccacaaaacaaagatttttacacactgaatttcacaaaactcagtattgcagaattgcaaacatgctctgtgactcagtctccagggcttaacttcccccttgtagtaactttagagggtcctgaaattttagcttctttaacaagggcaaatactgggagagaatgtaaggggaggaaaataaacagaatgtcttctgttagacaagccagcctctggcatgtacacatttggcagagttctaattttgtttgctaacctccgatcactacctgaaatgggtctctgcaggatatcaaggtgtcagcagcgctgtgctcctggagcatctaggtgagaatcccgtccctggcctttcccagcttcaggaggccacctgcactcccagctcactgttcttccttctttccttcctccatcttcaaagccagcggcgtagcgtcttccagtctctttgactctgaccccccggcctccctctttcacttgtaagaactcttgtgattacatcatacccacccacataacccatcttaacttaatcaccccttgcaaagtccattttgtcgtgtgaggtaatacacaatatttatgagccctatcagtttaaccaattagtaagtgtggtagaggaaatacaacgatggaaggtttaacctgaggaaagaaaaatagctcagagcagtctgaactatttgaaggatgcaaaatgtatcaggacatgagtgtgggactaacttcagtcactctgctccccatgccacaggggcaattgtttaaggcattttgttcctgactgctgtgtcacccattattttcatgtttctggagtctgtgagacaaagaaaaatgtatagtcaatcaatagcttacgttgttttaatgtaaatttttgataaacaactcaggaactgccctttctttcctccttaaaccccccgcccccaaccaggtacctgctgctggttgggtgcatactcagggaaattcaaatctgtgctcccaggtggtcatcctcagggcttgtgctcaaataaactccatgctaactcgtattttctgaatctttctatctaaggttgacaaacctaaggggcatcattctaaaatcagtaaacatgattttgctgtaggctattacaggtatagaagggaagaaaagcacaagaaatctaaccaaatatagagactccaggtcattctattagaatgtgatgtggtttggatctgtgtccccaccaaagctcatgtggaattataatccctgctgctggaggtggggctggtgggaggtggttggatcgtgggggtggagtgcccattgctgctggcggtggggctggtgggaggtggttggatcgtgtgggtggagtgcccattgctgctggaggtggggctggtgggaggtggttggatcgtgcgggtggagtgcccattgctgctggcggtggggctggtgggaggtggttggatcgtgggggtggagtgcccattgctgctggaggtggggctggtgggaggtggttggatcgtgggggtggagtgcccattgctgctggaggtggggctggtgggaggtggttggatcgtgggggtggagtgcccattgctgctggcggtggggctggtgggaggtggttggatcgtgcgggtggagtgcccattgctgctggaggtggggctggtgggaggtggttggatcgtgcgggtggagtgctcgtgaagggtttagcaccatcctctacttgggactgtatagtgagtgagttcttgtgaggcctggttgttgaaaagtgtgtggcacctgccccctctctccctttctcttgttctggccaggtaagttgtgtctgcttccccttcgcctttcgccatgattgtaagtttcctgagacctgcacagaagcagaagcagctatgcttcctgtacagcctgcagaacagtaaaccaattaaacctcttttcttataaattacccagtctcaggtgtttctttttatcttttttttttttgagacggagtttcactcttgttgcccaggctggagtgcagtggtgcaatcttggctcactgcaacctccgcctctggggttcaagtgactctcctgcctcagcctcccgagtagctgggactacgggcatctgccaccatacccggctaattttttgtagttttagtagagatggggtttcagtatgttgcccaggctggtcttgatctcctgacctcacatgatccagctgcctcggactcccaaagtgctgggattaaaggaatgagccaccgggcctggcctcaggtgtttctttacaggaatgtgagaacaggctaatacagaaaattggtactgaaaagtggggcattcgtatgaagatacctgaaaatgcggaaataactttggaactgggtaatgggcagaggttggaaaaatgtggggggctcagaagaagacaagaagatgggggaaaatttggaacttcctagagacttttaaattgttgtgacccaaatgctgatagtgatatggagagatgggcaggctgataaggtctcagatagagatgagaaacttactaggaactgaagcaaaggtcacttttgctgtgcattagcaaagaacctggcagcattgtgcccctgctctagggatctctggaactttgaacttgagagtgatgagttagggtatctggcagaggactcctgaaagtgatttctgttaaatctcgccctggcaatattaattacaaatttaccttccaggtacaaaacaaggacaagatgagattagtcactcttctgcctaccctgatatgggctacataactctttcctctactccctcttgtcagatgtttgcctcatcttatgtaaattgttggtttactgagcactaatcagagcatcactgtggacccctccctttttttcctcctgcttgccgtctcctcctaaacacccagtccccataaccctatttggatggcacagttgatgcttctgtggcttgcgtttttcccgggcccatcatcagacttctactgatggagacatttgcctcagtcactcatttttggttaactaggaatctcattaaatggatagaagtcgttgaaaatatggcttaaaacacacctcaccacatgcctgccccaagttaatgagcagagttgattactgcctgcttgcagaagtgggaaaggaggaggaaaaggaaatatacagggggacaaatttttaaacacaacttcaaaatattacccagtcatatatgtatacacacacatagaaaattacacggcagattacttacagtagcgtgagagaatttttgagtgggtgggattctttacagcaagtttttttttttttgcttctttgaattttttttactcttttaggtttttatatttataaaagttatatttactttttaaaagtgtcaaccttaatattgagattcagaaatatgattacatatagtgtgtatttgagcacagagcctgagaatggccacctggacaaatggggtcagcctttccaagtggagctcaggtctctcttaccaggcggagacagaagctccagcaggatcaccacagttctcatatgagaccaggggcacacgccgcagcggttccattggttagggatctctgtatttgaaggaagattgcgttataactccatgaggaggggtagtgatctgagggggtcttatctccggtgccatttggtctttattgtttacagggaaaaaggcagaagttacagctgggtgtggcatgacctaggccgcgtagccacattcccctcaaggctcaggtaattcaaagttccaacagcttcaagtttaaattattttaagtttgaatgatttaatttcacaaaaggtaatatatgcacattgactgaaattcaaaagcacaaaaagatatccaaggaagtacctctcccacttctaccatctctcatcttccagcactccttccagaggccttgcgctatgccggttttctcatttttccttcctgggacagtttagggatttttctacctatcattaaattcgtattttactcaaatgcaggcatacgataaacacgatcctatacttgctttttcccacatactatatcttgaagatcgttcaatgtccatgcaaagctgactgttcttttgaacagccagcgagtattccattacgtgagcgtatcatgacctatttactcagttccatacttcatgggtgtttaaattgtctgcaatcttttgctattacaaacgaaaccacaggtcattttgcacacatgcaaaaatgcaaatccatggtatatttcccaaaataaaaatcattaggtttaacagcacgaacacctttaaatttggaagatattccaattcgttcatcctagagagtataccaataccactcacaaaacttgagggtgcctgcttcccgacattcctgctagcagtgtcatcaacctttgtgatctttgttaacatatgaaaagtggtactctaattttaatttttattatgaattaagttggactttctttcgtatgttaaagtctatttgcatttctttccctgtgaactgttttttgcctgtctttctcctgagccattggtctcttcccactgacttattacatatatgtaaagggaatattggctctacattataaggaaattcgaattttgtgataggtttcaaatttttccctaggttgtctttgacttcatttgctgtttgtgcacacaattttttttttttgtaatgagagtgcgttgctcttatttttaaaatgttgactacattctggggaaagaaggctcagcagccacctgcttttttgcccgggtgggtggtccggccccgagccctcctgactctctcgccaatgcccagaggcgccgcagcgattccagggaggccgcgctctcgccccaaggcaaccagaagcccacgtgccaggagaggcatcggaaccaacaactcgggtccgttttcccgcgccagatgggattcgtttgctgtggacttccggggcggggcctgcctggagcggaagagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccaggtgggcggccccgactcggggtgcggggcccaggcctcgccgggtctttttccgcgcggcgtggggctggggtgactgttgtcggggctcttggtggggaaggactgggccggccctgggccttcatctggggccagcagcgctgtctccgcctcgcccagaagggagcggtccctgcagctgggaggggcacagcccggggagtggaggcccccgagcgcacggggcgcctcagtcgggtctgagcctcgttctgcacctggcgcggaggaggtgcccaggaaacactgactactcagtgcaagttgaaggacaatttttggaggaaagttgcagggctagctaataaaacatttttgagaggtttagttgtaatttttactgggctgaatttaagtgaataaagatgtgaagaagcctgttgtctcaaatcaatactttaaaaattctcgttaactatgtctgtgttctctgcactacctttgaatagcagagagcgtttaaggcaagaagtgtcttcgagaatcagcagcatcagttttatctatattgttgtttattttttgttgaaatgcttgctctttcaggaaattggaaagaaagggaaagaaaagccatggtaatgcagagttttcggaattgggtgctaactgacgtggccaaatgtttgcagtccatttggagggctgtgtttttatttaccatgagtcagttgaattcagtgttttctgatcactttttcttcggtacggagacgtagtgaggaatatgacaggcccggtttccagccagagacaccggtattgagcatatttataactatcccgttggcattcctcctgcctcgggctagcagcagtggtcctggcttgtctccaggggaactgaggcagagactgtagaagactgaggactgaggagcagaacagggtctaaagctagccgtaggtcactgtgggtggccctcattgtcggctccttcatttttgttagacttggaggaggtgagttcttccccatgttcagtgaagcttagttaatttatgtgtgtgtgtttttaaacttgagtgttattaaaactgccactgtgttatataaggtatttgagtatagtgttctgtcttctaaatttcactttgggattcattaacagctcgttgaaagtgttatataaatcacacatgaattgttaatgactagcttttgctgtttcacttgcatttcacttgtatgtttcacgatacatttttacagtgtatgagttttaaaaaattaccttcataagttgcatatacaaagatattacaggaatgtttgtattgcgacactgaactaaaatttaccctacgtgagatgtaagatagagatgtaacaaattgttgtcttgagatgaagatttattacatagaattatattaatatattacatagaattataataatattagataactgtttaagactattaaaataacagggcagttaccacctttttttttttttggtatgcagcaacagtatcaaagtgctctattttgggcagataaagtagcttcactctctcgtggtaagtgacaaaatgctaactggttttctgattaatcttaaaattcgttttctatttcaccttgtacctctgaccacttatgtgaatttttccctccagaagaaccccaggacatctattggttggctcagtgtctttacctgacagcacaatatcacagagccgcccatgcacttcggtcacgaaaactggacaaagtaagtgatggtatgaactttaaagctcttcagagctttaaaaaaaatgtcattagtggccgggcgcggtggcttacacctgtaatcccagcgctttggaaagccaaggcaggtggatcatgaggtcaggagctcaagaccaagatggtgaaaccccatctccgctaaaaatacaaaaattagccggacgtggtggcaggcgcctgtaatcccagctactcgggaggctgaggcagagaattacttgaacctgggaggtggaggttgcagtgagctgagttcgtgcattgcactccagcctggacaacagagcaagactctgtctcaaaaaaaaaaaaagtcattagggttttaggtgtatattccatttctgttgaaattatttaacttgatgcaatttttctttgtttttgtttttttgaggtctctctgtgtcacccaggagtgcagtgggatgatcgtggctcactataacctcagactcctgagttcaagtgatccttctgcctcagcctccctaatagctgggactacaggtgcatgccaccacacccagctaatttttaaatttttttggtagagacagagcctcactatgttgcccaggctagtcttgaactcctggtctcaagcagtcctcccgccttggtctcccaaagtgctgggattatagatgtgagtcatcacagtaggcccagtttttttttagtgaaagtgaagggaaaatgtcttatacctaatctgtcaccttctttttcccccatctcccatctagtctctaaattctgaagactgttttctaaacagctctggaatcatggatattcctcttcctccccactcgtacgtgtcaggcctttgatttttttgtctgttctgttacagcctctcttcttgtctcttttccccagtaacagtttctctcttcttatcttccctgtcacaagttcatcttgtgaactattacaggagtgagtagtctttaaaacacggatgtggttatattcccacaaagtcattcagtgacttcccattagctgcaggataaagtcagatgcatcagtaggtctgtgaggccctccttgttttctctccactctgcgtctaatccaccaccatcaatacctggagcacgtgctccagtcacgtggtgctgctgtgagctccttggacacccagcagttattcacactcagggcctgaagtggagctgctgcgatctccttggacgcccagcagttattcacactcagtgcctgaagtggagctgctgtgagctcctcggacgcccagcagttattcacactgagggcctgaagtggagctgctgcgatctcctcggacgcccagcagttattcacactcagtgcctgaagtggagctgctgtgagctcctcggacgcccagcagttattcacactcagggcctgaagtggagctgctgcgatctcctcggatgcccagcagttattcacactcagtgcctgaagtggagctgctgcgagctcctcggacgcccagcagttattcacactcagggcctgaagtggagctgctgcgagctcctcggacgcccagcagttattcacactcagggcctgaagtggagctgctgcgatctcctcggacgcccagcagttattcacactcagtgcctgaagtggagctgctgcgatctccttggacccccagcagttattcacactcagtgcttgaagagctacccagtgctccactcctctgcctgaccacttactcgctgcctcacttactcgctctcctgcagatgtttacttctccacctggttgatgctttctgttgccccgtttcgtcatgcttacctgttgtgcttagttcacatctcccctactgtaacctcctggggcagggccttactgcttttgaatccttggtgcctagtaaacagtaggttcataataaatatggtttaacaggactggattttttttttaactgcaagagtaaaaggagaaattatgaaattagttctattttatgcttatggctttctttgaaagtgaagatacatattattttgaccactacttaaacaaattaatttctttcctagttgtatgaagcatgtcgttaccttgcagctaggtgccatgtaagtatgctcataatttcatttttatttggttgaataaaatgagtgttatgcatctcttaaatatgtgtgagaattttagtgatggagcttagcaggttagtaaagtatttcatgaggaagtgttcctttccttagtcatgtttgctataaaatactgattcttcgtttaccacatgctgacatgcatgaagaaaattctactttagacatttcacatttaaataatgggcatagtatatgttatcctttaaaaattcggatcatgtgtttcgtgttagaagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcagtaagtagtactgtgagcacagctcagtaacggcggcgagaattgccctcattacgtggcagaaacacattatcttcttttacttattactatattaaaacaattgtggttgccaatttatttaatttgcccaccaaaaccaaaaaagattctgagacatttctgagcccttagttgcaagctgtaattgtatccgcagatgcctgcatccaaaataggctggcttgaaacttccttctcatatttgatgccttaagctactccctaaaagtggaataatttttcttctcctttctgtgtttcagcagtgttttggacctacaccaagaaactttgattagcgtacattgtttctttccaggaaatggttttgtgttctgtttgcttcaaagtacattgctatgtaattgtgtatatttcagtttgtatacttcatatctccatgaaattgcacattccttgctggcagacatcatatagtaacttattaagtgacatttacagatcactaatctggatttaaaaaaaaaaataaaaacttattgaggtataatttatatgccatgcagttcccccatttaaactgtatggtttgattccttttagtgtattcacagagctttgcaaacctcaccatggtcaattttagaatatttttattattcagaaagaatccctgtaagccttacctgacctaccaatttctctttcttcccacatcttttttttttaaattaagacagggtctttgctttgttgtccaggctggagtgcagtggcacaatcacagctcactgcagcctcaacctcccaagctcaagtgattctcccacctcagcctcccgagtagctgggactacaggcgcccgccaccatgcccggctaattttttgctattttagtagagacggggtttcaccatgttagccaggatggtctcgatctcctgacctcgtggtttgcccacctcggcctcccaaagtgctgggattacaggtgtgagccactgtgcccggcacagttggctaaattttttaaaaaatgttttgtagagacagggtctcactgtgttgcccaggatggtctcaaactcctgggctcaagtgatcctcctgccttagtttcccaaagtgttgggattacagtcatgagccactgcacctggcccatttatttatatttttggtagaagtttattacttgacttttcaccttagatagttatttttaagcataaaagaatattacacattctaggtttttgtttttgtttttttttctggccactcattaatgtatgtgttgggaagcagattcttctgttaagaaatgcatttatgaaagtgtgtggtacagtcattattttgggacctcttatccattaacttatttgctatgaaatgtgtgatttatttgcaacgcattattatttattttgtgaaattacatttttaaaaaacaactcctaggatattgcttagttcgaagactctcataattcattattttttctaaaattttactttatgaatcttcttcatatccttaatgatactagctgcctgttgctggatcatctttaaattcagttatgtgttcgaggtccagagtctagaatgtgcatcagatttccacatcttcgtgtttatggtagtcgtgagatggctgttgaacgccttactatgtgctagcaccacagagatggtagcatctctagccctcacagacttctataagttagatagtaaagagttctataagttagatagtgtttttatctttttacagatgaggataggaaatggaggccaagagaggttcaatcacttgtccgaggttacaagtaattggcagagctggggtttgaactcaggtctgtgctgcctcagcaggccattgtgctgactgctgtgaccactctgctgcattgctgccagtttctgctcattaagatccttttgaggggtgtctgcctatcacactgtcaatcttggagttttatacacatgcacacacactctgccatctctaaatcattgcactgttttggacaaaacaggtaatgaacctagtagccgtgacatgtacttttgttataaagatgtgttggaacagagcagttgaagcccagggaaggtgaattgaagaagctttgctgtgcattttttgtgtgtttttatttatgccttgacagttgtgattgactaaatccttttaaatgcaataaaaacttctcagcattcaaatacacaattctctatcaaaagttaagtttaagggccaggcatggttgctcatgcctgtaatctcagcacttcgggaggccaaagtgggaggatcacttgaggccaggagtttgagagcagcctaggcaacatagcaagattgtctgtacaaaaaatttaaaaaattaactgtttgtggtattgtgcacctgtaatcctagctactcaggaggctgaggcaggagggtcatttgagatcataggagttcaaggctgcagtgagctatgatcgcaccactgaactccagcctgggagacagagtgagactctgcctctaaggagaaaaaaaaaaagttaagtttaaaagtactgacttaatatgtgactcatcatttttccaacagataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaaggtttggaaactcaggcttttttgttttatgtttagcaaaattaatattgtttggattttttgcctctgaaatcttctaagtcaacaacaggccacatacaggtttaaatagacctactcactttcttaatgtcttcaaatgtaaagcacgttgcagaatgcagtattgtacggtgccttgtgctgtccgaatctagggattgtgataggaagaggccatctttttgagaagtgattgagatagtataaaccaggatttcagtatctcatgcagtgattctcaaccgtgttgctctttacatccttgggaagacagagaaacatccatgtccagttcccaactccagagcagatgctttaaagctcccaggtgatcctaatgtaccacaggcactgagaatcagtccaagtatgttggcagtggtgtgaggtgcgtcaacaagggaaacagaaaatagagtggttggattaatgggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggttagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctctataaatattatgaggatattcttttttttctcaccatttttaagaaaaagaacttcttgaatcactaccccttagcaagctgtgtaatgaagaacaggaattgctgcgttttctatttgagaacaaattgaaaaaagtaagtaaaaccaaagagttagcacttgctttatgtaaatatcttattccataaaatttggcatctagtcttatattaagttttcaaaattaaaactttttaaatttagcacatttttaagaatagagcgtttaagatacataagattccaaaaaaaaaaagctttcaaaaatacctttttcctctgaaagactccttatactaaaagattgaattaccaagtaaatgtaaatggaatggtgttgcatggaaatgaagatttttttgttatgcttcctgaatgtttactttgagaaatacgtcccgctgtggaattctgttctaaaattgagaagggaattaaacttactgagaggagtacttataaaacctaaagttataagttttcagaggctctcacatttgttcttgtaaatgttttaaccacttgggccaaacacaaattgaatccacattttattttgtttttgctcattgagtttatgtttacatttctatgtgtttcagtataataagcctagtgaaacggtcatccctgaatctgtagatggcttgcaagagaatctggatgtggtagtgtctttagctgagagacattattataactgtgattttaaaatgtgctacaagcttacttctgtgtaagtatatccatccatttttctgtaggaacatggagttcactccatcttacctaggtgattcacggacgtgctctctgaataatcttgaactagatgataatttaagttatctttaccaattgtagagcactgaacagggtgctgtcttaaaagagcaatttacagacatgaatttgtgcatatttgtagatttattacattaacttgggagggatatacatgttgctcttactgatcttgataatttgcaagtttgaaaattccattttggcacattgttttgtaaaatttattctcaattatgagactcacactgtagatactaggtgtttaatatgctgcacgcagtagctaagccatctcccacatgtatcagttttccagtgtacctaatttaaactttagctaaatgacatatgctattttttgtagatcttggttcggtttaaaatccttgaaattacaaaaattttaattggcaaatacacataacctatttattagtttggtgcaaaagtaattgcagtttttgctgttgaacgtagtggtaaaactgcagttatttttgcaccaacctaataggatttcctgttggttttgattcttttaaataagcggcctacttattttatgtattacaattctgttgacttaaagtaaatgtatgtgataatgtttatttttattcctttcaaataaaccagaattttttctttcatttgtaacttaattatggccttaactgaatcaacctgaagataatggagtgaagaaagtgaagtgttacaacccacagcatcatatgtgataccataatgactgtctacacatagccgatcgtcgtgagtgctgtcacctgctggtttgggggtagtaatgtgtcgctttaactttcagagtaatggagaaagatcctttccatgcaagttgtttacctgtacatatagggacgcttgtagagctgaataaagccaatggtaagacttttttttaaattaaagtaattcttagacataaaacaaatcttttctgtaacttgaaattttgtctctgaaattctggatagttgagattgcaggtaacaacataatggaaccctactataaaagtaacaactggggaggaaatgtttaggaaagtagcaaatggccaattttgttttcccatcagaacaattagttctttatcactgcttcctactaccttttctcaaatatcatttatgtttcaaggtttgttagctttaaattgttgggtgtcagttctgcctcccccccccttttttttttttgtaaattccactggaaatctgatatggtaagagttgataactacttagaaattggaaaggagcagattgtttgctcatgttttccgtatttttaacatttgacatttagttgtgtttggggatgcatttgtccttaaatttttctaaactgaatggtgagctctgtcaggaaggaaaaccctcaccgaatccctgctgctcagagtgtggttcgtggaccagcaacatcgcatttgtggaagctggttggaaatgcagcatctccagctgctctggtctactgaatccaagtctgcatgcaggaaacatcatcttgaaatgccaggatttacacatttctcaagattaaatagtatcattgatctgataaacttgaaagtttgttcagccaaattggttgtgggtgattatgatggtccataatgggcccttggtgtgacaggcatgagcttctaagagaggtgaggtgctttgctgtatcctctgcagtattcgggaagtgctgtcttagggggtgtctgttcccaccttgcccacagtgtgtccttcatctaactctccagttagagagttaattttttatctagaaggaaagacaagtatgaaatcattgctgtaagagcagaattatatgattgtgaagagttgtaatgaaatcatgtcttaaattacatgtgatacgaacaattgttctttttctgctttttcctgaacagaacttttctatctttctcataaactggtggatttatatcctagtaatcctgtaagtaatataacttttagtcttagtttttttttttttacctgtactttaagaaaatgcttaactcgtatttagacaatagcttaagttcaagcaaatgatgttttattaaagtgttgcaacagaatctcctagtgtttattgtacttacaaaagcagcattaacttttcaacccatgaaggtattttttaattataccaaagcaaaaaggtttttaaacccttttttctgattatagaagttatacatgcttattttaaaatacttagcgtatagcaatataaaatactgaccatgacagtcacgcctccctttcctaagaaatgtggataattgtttggcagctttctcacattgcacatgtaagacaacctgttgaattgtgtactgattccaaactgtcatggatcggaatggagaactaggaatggaaaatggaatcagggactgcgtctttaaggacaaaatcaggaatcagggtgtaagactcagacgacaagaatttgcaccctatcccagtgtgaaaccagagcaagagaaaaccagctaaatagtcagaactcggacagagagcaaggaagagccagggtcaggctgggggagatgagcagtgcaggggagtcaggactcacaggctggtttttgaaacagggactcctcaggggccttgtcttgtgtagacgtctccttgagaaagagccatggagtgtctgccctcttctcttggaccttagtagactgtattagagaaatgtctaacttaactagaatatgtgataaggaacatgtagtataccctctgtctaccctaatttgttgcagattccaattagatattccaattccaatctttgtttatggtaaattttgaactttttaggtgtcttggtttgcagtgggatgttactatctcatggtcggtcataaaaatgaacatgccagaagatatctcaggtatgaatttatttttttcctctctagttaacctgtagaattgatgtcttgctcataagctttcaagtagtaattagtgagtactttaaaagcaatgtgaaagaataaatgtttttttttttcttcctttcttttctttctctctttctttcttgccttttcttttccttctcacctcccctcccctctctctcgagggttctcactctgttgcccagactagagtgcagtggtgcaataatagctcacctcaaactcaaatgatcctcttgctcagcctcccgagtagctgggactacaggcaccaccatgcctagctgatttaaacatttttttttttttttagtagagacgaatctcactgtgttgcctaggctggtcttgaactcctggcctcaagcagtcctcttgcttcggcctccgaaagtgttgagatgacaggcatgagccaccatgcctggctgaataaatgttttcttcaagtggtttgttctttataagatgccatggggagagagagaaaaaaaaaatcagtgatgtagaccctattctcagggaacctacatattttatttattaatgagaataaatggccaggcatggtggctcacacctgttatgccagcactttgggaggtcaatgcaggtggatcacctgaggtcaggagttcaagaccagcctgactaacatggtgaaactctgtctactaaaaatacaaaaaattagccagatatagtagtgggcatctgcatcccagctactcgggaggctgagacaggagaatcgcttgaacctggaaagtggaggttgcagtgagctgatatcgcaccattgcactccagtctgggtgacaagagcaaaactctgtctcaaaaaaataataataataattaataaatgagaataaatatgaaacaatagagaataatgtagtttgaaagtttctctctttcgcttacagagatcctgttaaccttttacttttaggatttcttttattaatagttgtgaaattacacaaaactttatgtaaaattggggtcactaaatgtgactataaaacagaattcttagcagggtgaactgattcatgtaatgatttgctgtggttttaacttaaggaaagccatgcagcctagtgaagctatttaaccagtattattcaagtttagaaaaatgtcaagtatgtgaagaattaattacttaaactctgtaaatgttctaatttctgtggtttcttccgtgcaaataaaacagaattggtctctaacggaaacagcataaactttggagtcaaatttgaattctaatccaagttctgtgacttaccaactgaaattccttgggaaagttaatttctcctgctctctctttctttaaaaatggggatgtcagccaggcgtggtggctcacgcctgtaatcccaacactttgggaggccgagacaggcagattaccttaggtcaggagttcgagaccagcctggccaacatggtgaaagtctgtctctactaaaaataaaaaaatcagctggacatggtggcatgcacctgtaatccccgctacttgggaggctgagggaggagaattgtttgagtccaggaggtggaggttgtagtgagctgagattgcactactgcactccagcctcgccgacagagtgagactctgtctcaaaaaaaataaaagggagtgggggtgggggagatgtcatactcatatagcaggattgttaggaagactgatgccacgaaagtaccctgtactaggaagaaactagaatgttccctggttggttgtatgttcagcattttagaagaacttctacatagaaagatgattagtattgtaaaagttattttgagctatgctgctttgatctagcgtgcaattcagtgatggactcttatcagtggtccccaacatttttggcaccagggaccattttgtagaagccccccctcccagggtggggggactggtttcttgatgattcaagcgcattacatttatcgtgtgcttttttctattattattacattgtagcatataatgaaataattatacaactcactataatgaagaatcagtgggagccctgagcttgttttcctgcaactagatggtcccatctgggagagatgggagacagcgacaggtcatcaggcattagattctcgtaaggagtgcgccacctagatccctcacatgtgcagttaacaatagggtttgcgcacttacgagaacctaatgcctctgatctgacaggaggcagagctcaggcggaaatgcaagtgaaggggagtggctgtaaatacagattaagcttttttttttttcaaatggcaagttctttcttgacatatgaagctttactcacctgcctgccactcacctcctgctgtgccgcctggttcctaataggccagggactgataccagtctgtggcccaggggttgggacccctgctctacatgaaacaggtaacatttggataaaagaaaacttaaaatacaaggaagtagggtatcaccccctatgtcttccacgttttgtgatatgttctctttattccttgtgggttaattatacagtgttcactgtatacaattattcactgatatatatgagtccagtccctgtaaccagggtatatctgttgaccatcatctataggatatcgcctaatccctcaagccttggtatacctgtctttaaaatataaatgaatttatcttgcaagttattaggatgagaggatgtatctactaggttacaaaatggagctcctggattaagtaatatctgtaagttctatttagaatgctaatgggttttgctacagtgcataaaaagctgtggatctcctcaaatttcttaaaattttgctatactattaaacagttttagttcaaatgaatcaacacaaatgttacattagtgtttaatgtggtgacagcttgtttactaaatggatgttaatgtttttgaggccatctccttatataaaattaacaattcaagaataaatactagctgggcacagtggctcgtgcctgtaatctcagtgactcaagagcctgaggcagaaggattacttgagcccaggattttgaggctgcagtgagctatgatcataccactgcattccagcctccagcgacagagcaaaactctgtctctaaaaataaaaaataataaataggctgggcgcagtggctcacgcctgtaatcccagcactttgggaggccaaggtgggtggagcacctgaggtcaggagttcaagaccagcctgaccgacatggtgaaaccccatctctactgtgaatacaaaattagccgggcatggtggcgggtgcctgtaatcccagctactcgggaggttgaggtaggagaattgcttggtatctggaggcggaggctgcagagagccgagatcgcaccactgcactccagcctgagcgacaaagtgagactttgtctcaaaaaaaaaaaaaaaagaataaatactatatgacttaaattaactcttttgttttagcaaagccacaacacttgagaaaacctatggacctgcatggatagcctatggacattcatttgcggtggagagtgagcacgaccaagcgatggctgcttacttcacagcagcacagctgatgaaagggtacggcagagcaaactcatcaaactccatgaagggatgtttttcctaatagaaatgaaatttctattactattactgctatttggttgctaaactaaacacaaacattttacttgccttttaatctagttgcttgtgattgtaaaataactatgaaagtggaggggagagaagctggtgtatgcatttgcctagcagttgattccaaccagtgcaagaagcaaccaggaaattaggccagtggaggagaggagttctggaagcccttcctcacatgctcatgcaagaataaaaatattcacgagcaaaattattatatcttatctattaccaaaaggtatttgatgtggcttagtggtaggtgcaggactgtatttgccagtattctagatttatatcaatattaaatgtattgaaactaagaatgtgttactttgaggagtagagtattgctgttcacattgactgtttggtctcaccatcggttacaacttacagggttggtttgtgtggactgcttctattgactgatgactgcatccctgcctggagaggtagtgggagtgcagtggtccagaggcctggtctggagtcatacctcctggactcttcctggctcttccactcccagccatgtgacgttgggcaagttttttagcctcctgagaaataggaataatagcaaaatttactcactggcttattgtgagaagtaattgagataataccaattaaagactttgaagagtgtcttacacatagaaagcactcagtgaaagttagctacttgtgtttatttacttgtatgcaggggtggaatcatatatttatctgtattgaatgtcatcctgttaggtttggtctctttgcaaactgttaggctctttttgtcactcagttctgcgtttaaattagtacccacctcagtcagtagtcatagtaacttggtaagtatcatagctccttagctgtattagtcagtagggctgccataacaaaataccacagactgggtgacttaaaggacatttattttttcatagttgtggaggttgagaagtccaagatcagggtgctggccagtgcagttcctattgaggagtctcttcctggtttgtagataactgccttcctgctgtgtcctcacatggcagagagagctctggtgtctcttcctcttgtaaaaacactagccctattggatgagaaccttacacgaaccctattggataaaagccttacactagccctgttggataagagccctacactagccctgttggataagagccctacactagccctgttggataagagccctacactaaccctgttggataagagccttacactagccctgttggataagagccctacactaaccctattggataagagccttacactagccctgttggataagagccctacactagccctgttggataagagccctacactagccctgttggataagagccctacactagccctgttggataagagccctacactagccctgttggataagagccctacactagccctgttggataagagccttacactagccctgttggaaagg

SEQ ID NO: 35582 - DNA, 5702 bp, Homo sapiens
cggaagcggcggagtagagcggagcctggcgggcgtgggaacccaggccccgccgaggcggccaggttagtgcagcaggtgggtgggtgggctccccggtgcgggcgggagaggaggtggatcttggctccgaagcgtgggcgcggcgcagatgtcaccggcggctgctccagccagctggtggcggcggtctactgagctgttcgaacaccgtgggaggcgggggacggtacggaatttggcccccgcaggctcctcgtccctgccagcactttcgaggtgcagtagggccctgcaggagagagggtgggggagaaggggctggttctgaatactttccttgagcggagacccccttgcccaccccagccgatcgcacgtgcgaaaccccagcttgagggtgggctagtgggagcctgggaagctcccctcaagcgctcgggagctgcgtagctgagtagggggtgtgcccggcgggtcgcaaggagtcacaggctttcagttctgggccacgcccacaggctgtctctgtccacccagccagaggtggggctgcccccgggactgttaggtgttcagggggcaccgtgcgtggctcgtccctggaaacaggcgcagaagttgttaggtcggtacctaagcgccccacagtctccggccaccaaactttctcaggacccagcctggaagcctcagccccgcccaaaaagggacgactcctggtgggtggggcgcggggcttcccaaggaggggcttccgtgaaagaacacgtaagaagagctgccagtcggcggatgcgaaactagggccctggcctctttaccctgttaactcgacctccagcctggttcaccttccccatcttctagtactagtgagtgtgagaaagcatccccagtctccaggttcccagtactccccacctccccctcgacccccacagacctgatgggcagacaatggtcctgttcggtccccacttccaccccttggggtgggaccataaccaagtcaagcactctcaagtcaaggggccagaaagacatgaaagagggaatgtttccaggggaagttcccactctctcctactccccaggccactttcgaaggactccccccttatctcacctccgtggctggctccctattatggacccacttgtcacctgcagagtttcctgttttttcttgttttgcttttaaagaaaacaaatttattttgctcttttaatacaaagaaaatatgtctacttcacataaagcagaaaatattgctaaatacaaagaaaataaaaatcacccacaatccttccccacccccacctaccttccttcatcctgcccagagataaacaaaatgcaaacttcctgttactatccagactgtggtttggcgtaagtacacaagtattaatgttttctatgaaaagattagaaggctgggtgtggtgcctcacacctgtaacccagcactttgggaagctgaggtgggcagatcgcttgagcccaggagtttgagaccagcctgggcaacatggtgaaactccatctctactaaaaatacaaaaactagccaggcatggcggcgtgtgcctaaagtcccagctacttgaaaggttgaggtgagagggttgcttgagctgggaaggtcaaggctgcagtgagctgcgatagtgccactgcactccagcctgggtgacagagcaagaccctgtctcaaaaacaagacaattgaaaaaacaaaggtcgagagtagtgccttactcctgtaatcgcagcactttgggaggccagggcaggaggacagcttcctgttcctcatgtaaacagatggcagctgggccaccccatctgtcctgccccatagctaacactcaacactcctcttagcccaccatatataaaccctgatgagagtacaggagtgtgactgatggggcaggaggtagggccttgagcccatgattataggaaaagggtgggtaggaaaagggtgaggtggggagaaagaggaggcagttttctacttgctgtctcacggggtagtaactgggagaccattgagctgtaggtcagtgcagtggttccttggctgggaattttgcccccgctggtccagagctaggtttttgtcagaagatggaggaaggagatactatactagcaccaaggggccctggctttttctggacagggaaggaatagagcaatttgtgttggaaatgactggagccgaactccaagggctttataacaaaaaggaattatttagctcacataactgaaaagtccagtgtgcaatggcttcagggacggctggatccaggggcctagtatgcttaggaatgcacttctccatctcttgactctttctttctgtgtcagcttcattcccagccaggctcttcccaagcagtgctaaaggagagctaccttttccttccagttcagccccaagggaagggaaagtagtgcctctttcctattggctcaaccagagtcgcagcgttgattctcatgggtccaacttaagtcctataccccgccctgaactaatcactgcagaaatgtgaatggaatatgcagattggccaggtctggtacacaagcccgacctggaactagggagtgggacacaggcacatggattgagaagagggaggagggaagtccccaaaggtaagtcaggcttggggagagaatctgggtagatgcaaactacaggtgcccttcgaagtgaagacaggaggtttagtcttaggctgaggtcctccagaaatgctgggctcaagtctactcagaaggcaaggccaggatatgggtctggttggctttggggcatgggcaccatccagaatgaagatgtctcttgtccgcattggtaagagagacacacaggcctgagaaggaagcagagaagccccattgcaggatctgcctctgctccccctccactgtgaccttgggctctttctccaagaaggcagtggagggacagtcctcactgcaagcctggggcgggtgggactctgtacagagccaggagctcaaggggcttcctgtgagatggtgaactcctgtcccaagtatgccaaccagtggtggggacaactgaaccatgtgggacttgaggctactgtggtggggacagctgaaccacgtggggctgggtagttgtctccagggtggagggaggggggatgaactggatacctgactgtctgcatctccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcaggtgcgtggatgggcgggcatgtggagaggaaggggtggcctggagcattttgtgggtgggcctgggtttagccacctttaagaagaagatttggggtgggaggagcaagacggaggacccctggctgtgcagactctcttctttgcttgtggcatgaccttgaggataggcgtgtgttctcgagtctgtgtatgatttaccaatttgtgcactaacgtcctttgctccatccccgcccccctccaccagccggctcactcctttctactaattgtggatgtctctctcctcttttcctctcttactgcagcactccttgctcaagacccctccccagtacctacccttccaggcccccctttcccatctcagggcagaggccacaggaggctgaagcgggttgggggatctgttcgtggcctcagagcggcgagagcccctcttcttcccgagcagtgggagtcgcgcttggtggaggccgaagacctgagacctctcgccctcctctgccctgctggccgcctacccagacggcttgtttgcccagggcacacgcccccttttctgtgcttcgaagtccctctcttttgccaaccctcatttggggcgtgagagcgggggttaggtggcacccactctgtcttagggtgctccctgtgacagatcctggtcttctttctgggttattgctgtttgtatcccaattttgcttcccagctgggtactctggggtaactgcaccctaggtcaggggatgggacgcggggcttcaccacgggcttcgcccctcctccggccgtttggagaacggccgagcttggggaccgcccggcgcctgaccgcccgcctccgcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcaggtgcggccgggctagggtcaggatggggtagggcggggatccgcggttaagtcccccgtgacggcacgttccattcccctagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtaggtgaggcgcaggtggagaggcggggtcaccaggaggttggagtctggggaggggcaggggtcgttgccgggtggggatgggtgggaccggcgctgggggtccccgccctcaccccgtttccccactccctctgcagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacgg

SEQ ID NO: 35583 - DNA, 6150 bp, Homo sapiens
ctctttccgtctcaggtcgccgctgcgaagggaggtgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgtaagtggggcccggatgcgtggctcctgcgggaggagggtcctgagtctcttgactctgggtcagagggcgggaccttcgcatgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctacttt

SEQ ID NO: 35584 - DNA, 48188 bp, Homo sapiens
ggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggtgggcgccagggctgaggggccggggctgagcagccggggcgggcgcacccccggctcctgcacggcccgcgggtcgcagctcctcgggggtctcgttctgccgtcagccgtagttttcgggacgggagtcgtggctaggggcgcgggcgggttcaggggcgccccgcgtcccggggcgagcgggcggctcccagtgtgaggggcaggcggggaaatggagatgcgggccgtgaggctcggggcggggtgacggccgagcccggcctctgcgcttgcccccagcggaagcggaggggaggggagaaggccgcccgggccaagggtcccgctccccggtttgggccggtgacctcgcccggttggaaaccagcacccgaggcggaggggacggtgcaggcctcgcggttgcatttcctattccgcctcggccgctgccccgggtcagtctggctgccaaagccgagtacggggtttcctgacaagtcttggataatcactgcttcggaactgctagggcttgattaacttatatttttggcgaaaacgtggaaattagtcttttaatcctttctcccccctgctaatgagaagtattattgaatccttttagccaccctcccttctcacttactgagcatctgtagaattggaattgagttttttcaaaacttgtccgtcaaatgctttcgcacctgaccttcgccgccttttccttttgtttggtgggttctctgcctcctttgtctcttctggactgttttcccctaagaattgggttggtgatggattgctaaaagccaagttctctgtactccgaagctttcttcagggagttggaagataataacatgaagaatgcattgtaatatatgaatgcaaggtgtacctaatatcatggtatattgattttcctggttatctgtttctaagggaactttaggtaatctgtagataacgcaggcaggttctgtagtttgtactttttctgttcttttttttttttttttaaatgttcatcttgcaaaagaattcactttggagaaaaccattttaactatcaatttttggggaaatttgaaattctaactttgggctgcttgatcataattaagatgaatactgatgtaaatcttgtgtatcctatgtactctgacttcaaattcctgagtcatttaatgtagacttccacttcaaattttttgaaatttattataatctctcagggtcaaaccaatttttttttttttttttacaggtaacatcccaaaataacacttttagatgtctctaggcaagagaaaaccttcgaacttttatttggctaattttttaggaaaggtttgtgaagaattagaatcgtgtttttctggtctgtcatttttctgtttatagttatatgcaattattagagaatattcattctgaatacttcgttatgtttgaccaatccaggaataatcctgtgtctgtctttgaaaagctggaagactgttggatgcctaaatgaataggccctacccactgcaggttttgtgcttttttttttttttttttaagtgcctaattgggattccaagctgagcttagtagtttgtggtggattttgcctgttggaatgggtagtgttgctgccagcgtgttttaagagccggttagttccaccgtttttctatggttgttgctggtctttcagatttgctcacaattgaggtcagttaagcatgcacgagtgagtgcaaatccaccatcatgcaggcttccacaagcctcgttcacatcactttgtatcaaagatggtgaaagtgtttttatataacaagttaagataatgagctttgtttaaattttcattcggattgtgaactctttgatgaatggtagatgcatacttaactagaaatcagacctgtttctgctgtcattttgtagctgtgataactttaatctctgtgagccttcctaagttttctgagatgttctttgataattatatcaattcaggacaatcacattattaccatcattgataggagtagtgatgacaggatgattttgataatgagaaatcatatatccttatttttagtgttaccaggaattagatgattaaaaattagaagaagagaaaaccaaagttagcactcagaattaacttttgaatgtctggagttaattaattttcttaaaatttactttagtgcctgagacttaagaacctaaaaaaaggcaagtactttcagtgttaggaacttgttacttttaaagaagtgtaaggaagtgctggagttgctgtgttgcttagtgctgccattgtttgtatgagttgttaagtctaagctcataatcacaaatattgatagttatcttaatcaagaagatacaaaacgatttggtataaaggagtaaaatcttcattctgtgtgtaaaagaaatggaatattccacacaattgaattttctgaggaactaaaggttatctctaaagagcacagcttttggataatgcctttctaaatgctgtcacaacttctttaacaaactaagaaacataatttacttgataaccaagttttcacatagtgaagattaactattgtgttatgctgtaacatggtgaagccatgaagaccccgccagctttgtaggaacttttgccccctttactctcaggctgctatgctttttgagctcttcagtttactcttcatattttttccctctatcttactttactgttaggctggcaacatttacttttctctgctttcagcatgtgtaggcagcctctcaccacataatttgcacatagttcactatggacttggaaataaattcacgagtcttgttagacatagtagattaaaacaataagagtaactagttccacagctgtttgtgcttcccagaggtttttttcttcccattttttgttctacacagtaagaatttatgaatagaaatatatactttagtgatgtataccagatgattctcagcatcatatgtttaaaaacttgctttacatcccagatacttttcctcatttctctttatcagaattttgtgatttcagattcagagaaggttttatacttgattttaaaattctgaactaaaattcagattgcctcttggatttgcttaatctttgatttgctctttgagagttcttgcttatagctgtgttagagttctgtagacaaaggactttctattcactacagtagtgagcataggatcaatatttgcaaatgctgttacacttgggagctgtgttgtaggcagtttaaaccagcgttaagcatcctggccaaaagaaaatataagtgaaattagacatattttagcatgtagagatgacaatagtgtgacattggtttttaaagaccactggtagatgttcacatgcgtgatacactgcaattacctctgtcttccctcccatggtacctgattggagactcttactggagtaatagtttcagtttcagttatttaaacccagtgactattgtgatcagttatgggcagtaaaaaggtaaacacagaacctgtctataagtagcttgttctcgtgttggagagtaactaataagaattagtatgagaaagcattaagtcccctaagaggtgcacttatatgagttcagtcagggaatcaggaaaaccttcgtaaagaaggagatatttagctggctttaaaaaaatattggcaaggtttgaatggaggaatgattttttaggcagagagcagtcagtgtaagtcaatgctaagtcaaggatgtatgtagggaatggggagtggtttgttttgcttgaaacagaagctttggagagagattctaggctaagaaatgtgaaaattatcttcaaggcagtgagagaggactttgagcaggagagtgatataattagccacatttcaagagaaggtatcttttgacagtttttttttttgtttttttttgagatggagtctcactctgttgcccaggctggagtacagtgatgtgatctcggctcaccgcaacctctgcttcccaggttcaagcagttctcctgtctcagcctcccgggtagctgggattacaggtgcctgccaccatgcccagctaatatttgtatttttagtagagatggggtttcaccatattgatcaggctggtctcgaactcctaacctcaggtgatccacccgcctaggcctcccaaagtgctgggattataggcatgagccaccgcgcctggctgacagtttttaatgagatgcattagaggggcagagtcatttaaagaaacattcttcataaaacagccatttttattatgttgctgtaagatacttgccattgaaatgaactgatttaaaatttttctggttaatttctcatgtttctaggtaagtagttttgaaaaggcactttaatattagttattagatactttgtactcctgatcacatttgtgtgtgtgtgtgtgtgtgtgtatttgtagtttttttttttttttttttttaataacaacaatactttttatttctgagacagagctctctgttacccaggctggagtgcggtggttcaatctcagctcactacaacctctgcctccccggttcaagtaattctcctgcctcaggctcccaagtggttggaattacaggtgctcaccaccacgcccggctaatttttttgtatgtttagtagcgatggggtttcaccatgttggccaggctggttttgaactcctgacctcaggtgatctgcctgcctcagcctcccaaagtgctgggattacaggcgagagccaccgcacccagcccataacagaactttaaaatgcagtaggatttgatagggtgtagaggattttttgtttgtttgtttttgagacagggtctcggtctcttacccaggctggagtgcagttgtgtgatcacagctcactgtagcctcaaccttccaggctcaaatgatcctcccacttcagcttcccaagttagctggaactacaggaggcatgtagtttgggtattttttgtagaaatggggttttgccatgttgtccaggctggtctcaaactcctgggctcaagcagttcttctgcctcgtcctcccaaagtgttaggattacaggcgtgagccaccttgcccagccagggtatagagtttagtttgtcactaggaaggtatatcaaaatattaataaattttggctctattcccttccaagtctaaattgctctgtaatcggggttggggagtgggcattaatttttcagcataccattgttactggccgtggaaacaccatgtaggtgtaacaattcatatatagaaatttcattcagcctcttcaggtgctttgtctaatatatttgggtgttgtccaaatgagttattctgtttttgatgattgcaactctggtggtatgtgtagggtgctgaaggaagagaacgtcagtatcgctgatggttctgtcccccagccccacatccacatatctacacgtactagcactttggtgcaattaaatattaaaaaccattttggttggttacctgtttttatgtaggagaacgtcaagtgccaggtgggtggcagatgctagtgtcatacagaacttggattctgaagatggttttatagtcttagtgattttggatgtgaatatgtattcttatcctgcttaggtcatttgtaggtgagtttgaagttacagtgggtactcttacctgttacatttacaactcatgttggtgaatattcattcacatacaagtttcgtggttaaagttacttgatgtacatgatagatggaccagcttttctagtgtgaaaaagagaagcttagtttttatggctttaatgtgctttgcttgtgaatattgtgtattcatcagataggttgtagtagaatttaattttgagctggtaattttggaaaaatattaaaattttaggatcattaatatatactgtgcccagatatgactgataaattctatcaattaatgacttcacccatgttttaaaacaaagcttattatgtttgtgctattatatattcttttagcagtgtggaagcagtcttttataatagttgggtatagaggaactagtgggcctgcagattttttattagctttagttagctcttgtcatatttgctccaagtggtgcctttgaaggtagttgctgtcagctctttggactcggccacatctttaaattactgggccctttattttaggcctcagtgcttgctttacggccatagtccagtgggtcatgcttagtgtgaaaggttatatatagaagctgtgcaacactccaatttgcttgctgagattttgctttcaaaagtctgcagtctacttttgtcagctgggaatgtaactgtcttcctctgctgtgtcataacttatttttaagatagtaaatattttattttcatatgtggaactatatgttggtgctgctttaggttgttttcttcccccaccccccaaaagtaaattgttttagtcagtattagggttgatttttgtagttgttaaaataccttcatttccttttatgaagacataatgaagaaagtgaaaaggcaggccacagaatggaagaagataattgcagtacatgtaactaataaaggatttatatatagtatataaagtacttttataaagcagcgagaaaaagcccatttaaaaaatggggaaaaattttgaataggcacttatcataagtgccttatcacttagcttgatcatcagtaaacgtttttttgtttttttttttttaaattttcttttgtagagatgggggtctcactgtgttacctgggcttaagcgattctcccaccttggcctcccaaagggctgagattataggcatgagccaccatgcccggtccctaatcattaatcaactatttaaaaagtgttcaaccttatttgtcctcaggaaatgcaaattaaatcacttcttaactagaatggctaaaattaaaaaggcaacagtgtaagtggtcaaggatttgaaacagtggggactcactgcggacaaaagtgtaaattggtacaaccgtttttggaaagctgtttggtaatatctgttgaagttgaatgtatttatactcttcttgatatataacagaaatgcacacttagaagacacatgcgagaatgttgatagagcattatttgtaatagtgaaaaactggaaactatccaaatatccaccaggagtaaaatggagaagtaaattgtggtatagtcattcagtggaatcgtctacagctgtgttacccaaagtgtgctgcatagatcagctgcatctgcaacacctgagaatttaccagaaatgcggaagtttaggccccaactcggatattacacagaatcagaatctacagtttaacaggatctccaggttattcttatatataataaaatttgcaaacacagctttagtaattcttgaaattggtcctggaccagcatcatcagtatcacctcatcagcatcagtggtggctgacacctgtaatcccagcactttgggaggacaaggcaggaggattgcttgagcaaaccttgctttgcaaggccaaggctgggctacatagtgatatcctgttgctacaaaaaattaaaaaatttggcaggcgtggtggcacatgtctgtagttccagcttctcaggaggctgaggttagaggatctcttgagcctggaggttgaggctgcagtgagccatgatcacaccactgcactccaggctgggcaacggagtgagaccctgtctgcatcctgccaacctttttttttttttttttttttttaaagagcaaattctcagatccaacctcagacctactaactcagaagctctgtagatggggcctagcagtctgtgttttcaagccctccaggtgatttggatacaacctgaagtttggaaatctgggtagaatttacatttctaacaagttggcaggtgatgccaagtcaggaaccacactgagatgccctgcttgcagggttagccatacactctgaaaagctcccgatagtagccgggtgccatggctcacccctgtaatcacagcactttgggaggctgatgcgggtggatcatgaggtcaggagtttgagaccagcctgtccaagatggtgaaaccccatctgtactaaaaatacaaaaattagctgggcgtggtggcgcacacctgtagtcccagctacttgggaggccgaggcaggagaatcgcttgaacccaggaggcagaggttgtggtgagctgagatcgtgccattgcactccagcctgggcaacaagagagaaactctgtctttaataaaaaaaaaaaaaagctccagatagtaaatattttaggttatgtagacgttctggtctctgtcacagctgcccaactctgctgtggtactaggaaaacagccataaacagtatgtacatgaacagatatgggtatttaccaataaaacttcacagaaatagccttcaggctggatttgtctcatctctggggacctttgctctatagcaatgataataaatagaccatgcacaaaacatgaaagaatcttaaaacgtgttgcataatgtcagacgcagaaagttaatacacatgattagatttttagagttcagaagcgggcagaacaaatctttgctattagaaattatgagagtgctgggggatggtggtggttatgattggaatacggcatgagggccttctggagtgctcagaatgttttgtttcttgagctaaagaaagaatgattcaggctgggcgtagtggttcatgcctgtaatcccagcactttgggaggccaaggtgggcagatcacttgaggccaggagttcaagaccaacctggccaacacggtgaaaccccatctctactaaaaatacaaaaattagccaggcgtgatggtgcatgcctgtaatcccagctatttaggaggctgaggcaggagaatagcttgaacctgggaggtgaaggttgcattgagccaagatcgcgccactgcactccagtctgggcaacagggtgagactcctatctcaataaaaaaaaaaagaaagaatgattcacactcctatagtgaaatttgaacctcatggtaagtaatttaagacatttaagaaatactaaatgaatagatatattatggaagaaaacttgaaatttgtgtgaattttaaaaatacgggtttcaaagtcaaatagacttgtagagaataagattgttctttgacatctagggtcctttggataaatttgagaaatattaaagatttataaagatacatggaatttcctttgtctctttaagaaataaagcactgatcactcaaaccctttttgagtgattatatgccccatctctgtgtttcttcacattaattgtattaattttttccctcttcttaatttggtttgtcttagtgtattcatgcttgctttatctttttcctgagagtggtcatttatacttttcggttgatggtcaatttattggtggttgtcctatatgctttgcttagggctctagttttcaaactttttagtctcaggatctgttcacgtgctaaaaaattcaggaccttgagcttttgtttataaaggttgtagctattgatatttatcatattagaaatggaggaataaataaatcactgacaaataataaaccgattacatgttaacatgtataacaattttaactgtatatgtactttttttttgttattgagataggatctcactttgtcacccaggctgaagtgcagtggccttatcacggctcactgcacctttgccctcatgggttcaagtaatcctcccacctctcagcctcttgagtagcagggactacaggtgctcaccaccacacccagctaatttttgtattttttgcagagatagggttttgccctgttgcccagactggtctccatccaactcctgggcttaagccatctgcctgagtatattttctaaaacaaaattgtgagaagactatcaatatttcacgttttctgcaaatcctttaatgtctggcttaataaaactgaattcacatacatgcttctgtgttcagttctgttgcgatatattgtctaggctgaagtatatgaaaacaggtctcacacagacatgtaattggaaaagggaggagtaatttaaatatagcctttcaggttattgtagatattctttggtttacacaaaagcacaagtggtagtttttaagagatagcagtatgaaatctgaagccacattaatgaatgttttatattctgatatattaacacccactgatctagcttgcactttgaattcctcttttttcctcctgtgtgattttgtaatttcattcacccgttatttggaaaacaaggtttactctgagtaaagtgggtcttaatgttgacatgtttcattttacattatcaaaacatcatatttgttagtattgtcactgataatgttagaaaagttcttcatgtattggggaacctgacgtgtgcccatggtggtagttgtaagttttccataattctttttttttttttgagatggagtcttgctctgacaccaggctggagtgcagtggcgcgatctcggctcactgcagcctccaactccctggttcaagcgattctcctgcctcagcctcccgagtagctgggattacaggcatgcgccaccatgcccagctaagttttgtatttttagtagagatggggtttcaccatgttggccaggatggtctcaatctcctgaccttgtgatccacccgcctcggcctctcaaagtgcttggattacaggtgtgagcagctgtgcccggccaagttttcggtaattctaattttcatttaaaatttgacttattggcagcacgtgtcagttattttcctttaggttttctttgagaaaatgtcaaatacctaaatctgaataatcatagtttgttggtcagttctttcaaataaaaatgattattcataaaaaaaagcggctagttcagcttacagatcagtggcacaggttttccctgagctgaagtgctgtctgtattcttcccattttttcacacacaatgtttaaaagatgactattgaagggtatatgtttattaaataactttattaattctttttgctactcagtcttgctctgtcacccaggctggagtgcagtggcgtggtctcagctcacagcagcctctgcctcctgggttcaagcagttctgcctcagcctcctgagttgctggaattacaggcatgcaccaccatgccctgctaatttttgtgtatttagtagagacagggtttcaccgtattgcccaggctggtctgaaattcctgggttcaagcattacacccacctcggcctcccgaagtgctgggattgcaggtgtgagccaccatgcctggccaataaagttactttttaatgcttttatcaaggacatccttttttttgttcttgagatggagtttagctcttgttgcccaggctggagtgcagtggtgtgatcttggttcaccacaacctctgcctcccaggttcaagcaattcacctgccttggcctcttgaatagctaggattacaggcatgtgccaccatgcccggctaattttgtatttttactagagatgtggtttctccatgttggtgaggctggtcttgctcttctgacctcaggtgatccacctcccctggcttcccaaagtgctggggattacaggcgtgagccactgtgcccaccctatcaaggacatccttaaatgaatgcctggcgatgaagactgtaatgatgactagtatagtttagagccctgtcttaatttgttttatccaccattgattttacatcatcagtggaagtgtcaacactgaaaaggtgactaggctgggcacgatggcttacgcctgtaatcccagcactttgggaggctgaggcgggaggatcacctgaggtcaggagttcaagaccagcctggccaacatggtgaaaccctgtctctgctaaaaatacaaaaaattagccgggtgtggtggcgggcacctgtaatcccacttactcaagaggctgaggcaggagaactgcttgaatccttggaggtagaggttgcaatgagctgagattgcgccattgcactcctgcctgggcaagaagagtgaaactctatctcaaaaaataaataaaaaaaaaaaattaaaaggtgactaatgtcttagtgttattatgaaacagttttaatcttgggatgcataggagcccacagaccacacctggacccctggtttcttaagggctttcttcataaattatgtcatgttgcatgaatataagtgtaattactaagagaatgtgtaatggcaggcttgaaaaaaatgatctgttttaaatatgctgtagaactttcttttcaaggtactatgctttttctataggaatgtatcctgtcaggtataatgtcagtgaatggcaagaaagttcttcatatggatcgaaacccttactacggaggagagagtgcatctataacaccattggaagatgtaagtgttagtcaaatttcatacgcctctcacactttgtgagtatttcacttgtgaatctctaccttattccttagagatggtcttaattttgttttgttaaatggaatatctggagcactgtttttcaggagcttctggtttgaagctcatagaaatttacattttgacttttgttgctatgtggagcagttatctcttagcattaacagagaatagtctaggaagggagggtagaggatcgtctgatgtgccagcgcaagtccagtgctttcctcatggctttatttattttctcagtccctcaaagattttttttttaatctccatttaacatagtctctgtggggttaaaatctgagatgggttgtaaacccaagttacatgactacaaagcttagttccttttgctatactgccttgtttcctactttttttgaacgtggacacatagcatttccacagtgtgttttaatatattgattgtttttctgcgtgaggtttgttgaacacctacgtatatggatatgatgtgtactgtgtcttatgggagatagatatcatcaatgactttaatcagtgacttattagacaatacttaccaaaaaggatttttttctatattcagtaatactgaaaagtttaaagaataatacgatgtataaaaaaatcttccatcagagttcagcagttaaagtttgctgtatttttttcatgtctctttttttgttactggttttgatccattgaaagtgataagacatcatgaggcttgagcaaaatatttcagcattcatctgctaagaataacattctcctgcataagcataataccattatatcatatccagaaccatattcaaatttcccagtggtcccagtaatctcttacgtagctgtttgtatttggtataattttctctttattctcttatttatttttctggagacagaatcttgctctgccgcccaggctggagtgcagtggcacagtctcgcctccctatggcttccaccttctgggttcaggtgattcttctgcctcagcctcccaagtagctgggattaaaggcgtgcaccaccatgcctggctaatttttgtatttttagtagagacggggttccaccatgatggccaggctggtctggaacccctgacctcatgtgatctgtctgccttggcctcccaaactgctgggattacaggcatgagccaccacgcccgagcgctttattctttgttgttgttgtttgtttttaagagacagggccttgccctgttgcccaggctgaagtgcagcagtgcgatcgtagcttgctgtagccttgaactcctgggctcaaacgatcctcctgtatcagcctcctaagtagcggggctaaagatgcataccacctgcctggcttattttattttttgtagagatggggtctctctgtgttgcccaggctggtctcaaactcctggcctcaagtgatcctcctaccttggtttcccaaagtgttgggattataggtgagagccaccatgcctgggcacctctttattttcttaatctacaaatctcctcacaatttttttcttttcttaattttgttttattttatttttatttttatttttttgagacagtcttgctctgttgtccaagctgatgtgtagtggtgcagtctcggctcactgcaacctccatctcttgggttcaagtgattttcatgctcagccttctgagtagctgggattacaggtgtggaccaccatgcctggctaattttttgtatttttagtagagatggggatttcttcttgttggccatgctggtctcgaactcctcaaatgatctgcctgccttggccttccaaagtgctgcggttacaggtgtgagcctctgtgcctggcctagtatatttcttagctgatcttcaatacaatgagtaagatttcttttcttttttttctccccagatgtattgagggagtcatgaattttttcttttttttttttttgagatggagtctttctctgtcacccaggctgcagtgcagtggcacgatcttagctcagtgcaacctccacctcctaggctcaaacgattctcgtgcctcagcctcccgagtagctggaattacaggcgtacatcatcacgtctggctaattttttgtatttctggtagaggtggggtttcaccatgttgatcaggctggtctcgatctcctggtctcaggtgatctgcctgccttggcctcacaaagtgctggaattacaggcatgagccaccgcacccagccagaatttttattgaataaatacttactaattttgcttattcttttccaccttagcagtaggattcatgagctcaagtgactgttctctaactttataagctttttgaaatctgagcttcatttcaattcatgtgaattataaattaatttgagtattcttaccacaaaacatcataaaagaacaaaaggacaattttggaggtgatggatatgattggtaccttatggtgatgttatgggtgtaccttgtgtctagactcaccaaaatgtatgcaggaagtaggcagttctttatgtatcagttatacctcagtaaagctcaaaaattataaatgaactagaactaattttaattatcttttctgattaggaagaatctaaggtttattttgaattccttacataatacaaaagcaaaattaagcctttgatagctttttatttgggagagaatgaatttagatgattgctatttgtcagtgacaccctagttctgcatatacagtccgtatagagaactatacagtgtcattgacaaataatcttgttttatttatttatttcttgagatggagtcttgctttgtcactcaggctggagtacagtggtgccatcccagctcactgcaacctccacctcccagattcatgtgattctccacctcccagattcatgtgattctcctgcctcagcctctcgagtagctgggcttacaggcacacaccacaccccgctaatttttttttttttttttttttttttgagatggagtctcactctgtcactaggctggagtgcagtcacgctatctcggctcactgcaacctctgcctcgcatgttgaaacgattctcctgcctcagcctcccgagtagctgggattacaggcatctgccaccatacctggctaatttttgtattttcagtagagatggggtttcaccatcttggcctggcttttcttgtactcctgacctcctgatccacccgcctcggcctcccaaagtgtttgggattacaggcatgagccaccatgcttggccaatttttgtatttttagtagagacggggtttcactatgttggtcaggctggtctcaaactcctgacctcaagggatccacccgcctcatggattacaaagtgctgggattacaggcatgagccattgcgtctggccttgttttatattctttcttttctgctagtgaaaaaccttacttctgccatatttgttaattttaacatttatgagtttagtaattaatttacatatatattggaccttgctaaaaattttatctgataaaagatgaaatgcccttatactttactagcatggtggtgtttagttatactaaaagcacttaataaaaaatatgtacatattgtaataaaaaattaaattttgttaacattatggctatgtttttccttgcttttagttatacaaaagatttaaaataccaggatcaccacccgagtcaatggggagaggaagagactggaatgttgacttgattcccaagttccttatggctaatggtaaagaatttctaacttaaatttatgacagtactttgattacaattttaatatcaaaactaacttttgacagagtactattctgggtatgaggaactggattttgttgaatgaaacagcatggtgagtaacatggtccattagatgtctggagtcaataagttaggaaaggaaggaaggggttgtgacttactagtaattggttctggagaaacaaatgatgctgtggcataatacataacaagattgtaagcctttggcacagacttacctgttgatgcttatgacagtcttaaataactgggccttttgaaacagcattattttaatgtttttctagtttgtagggttttaaaattttcacatttttttaattttagaggatctaagttttctttttctttttttttttttgagacggagtctcgctctgtcacccaggctggagtgcagtggcatgatcttggctcactacaacctccgccttctggttcaagcaattctcctgcctcagcctcccaagtagctgggattacaggtgcgtgccaccacgcccagctaatttttgtatttttagtacagacagggttttaccatgttggccaggctggtcttgaactcctgacatcaagtgacctgctcgcctcagcctcccaagtactgtgattacaggctaagtatttttttaaattgctgtaatattagtacttttttctgagatgacattgaaaaactaaatttttggttataggtctgtttgtgcacatgaaataaagcatctgctatcctttttccttgtttgagtttatattctattgtttgtttttattaattttttttagagacaggggtttcactctgtcacccaggctggagtgtagtaatgcaatcatagcttactgaagccttgacttctaggttcaagtgatcctctcacttcagtgtcccaccacacctgggtgttccaccacacctggctaatttttttgtgttatggtagagatgaggtctcactgtgttgtgtgggttggtcttggactcttgggctcaaacaatcctccctccttggcctcccaaagtgctgggattacaggtgtgagccacctgtgcctggccaataatactataattccaaacctcatatctctaataaatttttcattgcttttgcaaaagcaagttgatagaattattaacctttaagttgtaacattaaaaaaacctatgtattcaaccttgaataggaaaaaaagataaaaaataacaaaaacgtgtaatatgcagtgcaataagtttgcattctggttgtcctatttaaaatacagctttggaggttattttgggccaggcgcggtgcctcgtgcctataatcccagcacttgggaggccaaggtgggtggattgtttgagcttaggagtttgagaccagcctgggcaacatggcaaaaccctgtctctacaaaacaatacaaaaaaaaattagccaggcatagtagtgccaggtactcaggagcgtcaggctggaagcttgcatgagcccaggaggctgaggttgcagtgagctcgtgattgtgccactgcactgtagcctgggcaacagagggagactgtgtctcaaaaaaaaattattttgttggagttattgaacatcgttagaaaaaattttagaagctgttagtattagtaaatgttctttataatttatagacttaagttatagtttgaattatgtgacttttctaggtcagctggttaagatgctgctttatacagaggtaactcgctatctggattttaaagtgactgaagggagctttgtctataagggtggaaaaatctacaaggttccttccactgaagcagaagccctggcatctagtaagtagttttattttctctagtaactagttttattttctcagaataatgagattttatactggaaaagagtcttagagaggacccagtcaacaaatatttattgaatgtctatcatgtgccagacactgttctaggcagttgggaacacatcagtgaacaaaatgttcaaaaattcctacccgtttgaagcttagagtttaaatgatcatctatagatcatgtaccttgtggctggtggatctgagcttatctagggttaatagtgttcttttcacagtaattcataatagctatgctttctgttgagtatttcctgtgtctaaaggctctgtactgaacactccatattgttttcttatttgacttctgaaacatctctatgacatagggtctccattttataggtgatgaaactcaggcctaaaattgcatacgtaataagtagctgggataagtagctgggttggaagtgaaatgctggtagtgtggctccagagccctggtgcttaatcatgttactaagcttaccctacgctatattacccaacgtgccaacaggagaagtactcattctgatgatgctcatcttctaattggtcttgttagtaattcccaatatctttgattttaggaactcctggtgagttttatatatatatatatatatatatatatatatatatatatatatatttttttttttttttttcttttaaagacagagtctcgctctgtcacccaggctggagtgtgatggcgcgatctcagaggctcactgcaacctctacctcccaggttcaagcgattctcctgcctcagcctcctgagtagctgggactataggcatgtaccaacacgcccggctaatttttgtatttttagtagagatggtgtttcaccatgttggccaggctggtcttgaactcctgacctcaggtgtttcacctgccttggcctcccaaagtgctgagattacaggcatgagccaccgcgcccagccttggagtgatcttattctctgcccaacattatttcctctgttgcctcaccaaagagttctggttaacatttcctatttcagcgtctctcttaaatagcaaacagtccagaaaagacctttttgttcttcaagatgttttagtccttgtatggagcagtttggagaaggataaatttgtataactaagggtaggtgagggctctaggagcttagaagagggaaagtgctcataagttctctcataattattttggcatcagcgctgaaaagttttctcatctgtaaacctaatttgaattattttggcagtttcctctattaacttctgattaggggagaaaatattgggtataaaatattaaagacatagccagaaagtaaaaaatactgcaaagaatcagggctaggttaggactgataattggggaagggaaggaacagtttctcattcagttgcgggtagttagtagtgtaatcatgggttcgaaattattttaaatcttttaaatgactatgaaaatttaatccaaataaagtatcttcatagaagtaggagtttgagtttgaatagaatcctttttaacagtggtgtggtgtggtggctcacgcttgtgatcccattgctttgggaagccgtggtaggaggattgatttaggccaggagttgaagaccagcctgggcaacatagcaggaccctgtctcttcaaaaaataagaaaattagccagatgtggtggtacattactgtagtcccaggtattgtggaggctgaggcaggaggatcgcttgagtccaggaaatcaaagctgcagtgagctgtgattgcatcactgcgctccaacctgggtgacagagggggaccctgtctcaaaattttttttagataaaaataagaaatagaattttttttttttttttttttggacaaaggtcgtgggttctttcttttacattttctttcttggagctcttacttatattaaagcttcagttacctccttcatctaatagaaattatcgtttggcagttttattttctctgattttttcagatatataaaacatttacagagcttgaaagttaaaaggtatatttcgagtcttggtctcattcttacttttctacttccattctttctgacctgttaggtaatcattttctggcttatccttcttctgttttttttttttttgaataagcgcatatgcttctgtatatatttttaaggctaggtttattgaggtataatttatgtacagtagaaatcacttgttttagtaaacacttttatgcattttgaccaaatcactaccttatcagcatctccttatattaatggaaaggattttgaaatcttgagttgcaggcaagaaaattctaggcagaatgaaggaatggggtaaggaaaggtggagaggtggcaaagttcaagagatgggtggataagtaccagttgttttataattttaataagaactcagttttttgagcacttacatgctaggcatatatgtattaagtacttcatgtgtattatctaactttacatagttcttcactgcaatcgtgtgagatgcaggtgctattactattttttattttacagatgggaaagctgaggtataaaaggaaagcacaaagtagtatagctagtaactggtttggagccaggtctgtctgactttagaatcccacactcttaaccacaagaaatactatattcttacggtatataaagctattaatatattgctttttagatattttaacaatgattacataccttctaattcttttttttccaaagtaaatacttgagtctccttagttgtttctcatataatatgctatctagatctcttggccactccttggaaattctctaattagtcaagatcctatatataatatggcagccagaccagagacagtatcccagatgttttctgctcattcagtgtaaacaggactgtttttttctttgtcccccaggctagagtgcggtggcacaattttggctcactgcaacctctgtctcctgagttgaagcaattctcctgcctcagcctcctgaatagctgggattacaggcgcacgccaccacacctggcttattttttttttttttttctttttttttgagacggagtttcgctcttgttgcccaggctggagtgcaatggtgcgctcactgcaacctccgcctcctgggttcaagcaattctcctgtctcagcctcccgagtagttgggattacaggcatgcaccaccacgcctggctaattttgtatttttagtagagacggggtttctccatgttggtcaggctggtctcaaactcccgacctcagatgatccgtccgccttggcctcccaaagacctggggttacaggcgtgaaccactgtgcctggccataatttttgtatgttttagtagagaccgggtttcgccatgttggccaggctggtcttaaactcctagcctcaagtgatctgcccaccttggcctcccaaagtgctggggttacaggtgtgagccactgtgcccggccccagaacatttattattttatgtatttatttttttgaaacagggtctcactcttgctctggctggagtgcagtggcatgatcacggctcaatgtagccttgacctcctgggctcaagtgatcctcctgccttagcctcctgagtagctgggactatagggatacacatgcctataatggtgcaatttaaaaaattttttgtagaagtgaggtcttgctatgctgcccaggttggtcttgaactcccggactcaagcagttacctctcctcagcctcccaaaagaggcatatcccaccatgcatgcctatagtggtataattttttaaattttttgtataaatggggtcttgctataattgtctaggctggtcttgaattcctgggctcaagcagtcatctctcctcagtgtcccaaagtcttagcactacaggcgtgagccactgcacccagccaagaacatttataattcatgggaggaggtcaaaataccaacattaaaaagagtttggaagaagtgagttttaaccctcttagatcactttcagagattaagacttcaagacttttgacacttctgaaactactaatagcctgttgttgaatggaggccatacggataacataaatagctaagtagttgattaacatttattttgtatgtgatttttttttgttttttgagactgagctttgctcttgttgcccaggctggagttcaatggtgtaatcttggctcactgcaacttccacctcccaagttcaagcgattctcctgcctcagcctccccaagtatctgggataacaggcatgcaccaccacacctggctaattttttgtatttttaatagagatagggttttaccgtgttggtcaggctggtcttgaacttctgatttcaggtgatccacctgcctcgttctcccaacgtgctgggattacaggtgtgagccaccgcacctggccttgtgataatgtattatatactgtgttcttacaatcaagtaagctatagaaaagacagtgcccttaagaagatgataaggaagagaaagtacatttacagtaccatactggacttattggtaccaaaagtttaggttgtatgtgtatgagatgaattgtctgtctgaaatggcgggcaactgcagccgcagacctgaagtcagttggtacgtttcaaggaattcaactttttcttgtaatgtcatgactttgcttcttgggagcacttccagcatcagtggcattccctgtgggtcctacgttttactcagtgtttatggtgttgcactaaacacgatgaaaaatatgtgagaacaaggagagatcactttttactgtgacagataatttactggagaggtgaactgctcatgcagagatgattattgtcacatagagttttaagatattcaaacacttgagctcaccacattagcaacaaaaggtggctccagagttattacagtagtacagtatgtactgcagttaatcttacgcagttaagacttaatactacatctttctttgtttacagtggcaccgtgtatggtctgtgtttgtgtgcctaagttttgtgattaaattttaactttgaaatagaattgcatatatttatgatagtaaataatatctacatatattttagcattcatgacatacataacttttttctaatttttttggtatttctaggctatgcggttcatctgcaagttttttcaaattgtcacaaatctgctgggcatgttgctgtgcacctgtaatcctagccacttggtaggccaaggcaggaggattgcttgaacccaggcatttgaggctgtactgtgctatgttcacacctgggaatagtcactgcacctctagcctggacgatatatccttatatagcaagaccctatctcttaaaaaaaaaatcatttggccggctactgtggctcatggctgtaatcctagcactttgggaggttgaggtgggtggatcacttgagcccgagagttcgagatcagcctgggcaacatagtaagacccctgtatctacaagaaatagaagaaaaattagctgaataccctgtagtcccagctactcaggaggctgatgcaggaagattgcttgagcccaggaagttggtggctgcagtgagctgtggttgcgccactgcactctagtctgggtgacagagatctcatctcaaaaaggaaaaaaaaaaaatcaagtaaaataaaacgtagaactgaaagaaaaaacaaacctggctgggcatagtggctcatgcctgtcatcccagcactttgggaggctgaggcaggcggatcacttgaggtcaggagtttgacaccagcctgtccaacatggtgaaaccccatctctactaaaaatacaaaaaaaaattagccaggtctgatggtgcatgcctttaatcctagctactcgggatgcttaggtgggagtattgcttgaacctcaggggcagaggttgcagtgagccgaaatcgcgccactgcgcactctagcctgggcgacagagtgagactccttttaaaaaaaaaaaaacatgcaaacctccaaaaattttttcagtacatttattgacaagaaaaaatctacatcaagcttgtcctgtctgtggcctatgggctgcatgtggtccagggtagctttgaatgcagcccaacagaaatttgttaactttcttaaaacatgagattttttttcacaatttttttaaagctcattagctatcgttagtgtattttatgtgtggcccaaggcaattctttttcttccaacgtggcccagggaagccaaaaaattggacacctctgatctacataaaaagtggcagttcagatgtgttattcaagggacaactgtaaatacagaaaggcatatcccatggtgatccattgctgtgggggaaagaggaaggagggagtgtgagaaggacgctttaaataaagtgatctgggaaggcatcagcatagataaatagtagttgtaaaaaattatctacctagtagggactaggtgcagtggctcacacctgtgattccacactttaggagcctgggagtttgagaccagcctgggcaacatggcgagaccttgtttctatggaaaaaaaaaaaacacagtaggaaacacgttattgatttgaactttttcaattaggagtttttcagaatgagcactgggtgtttgaagtatttgtaatacaattatatctggttctcatgctgttaacagctagtcattgagatcactatttggcgccatgcatagcaacatggaattaagggatggaaaaacagccaggacgtctctactgtgctgtgtaaaacaggagtggcactgatttctatccctctctgggtaaggatcaggtaatggaggaaaataaaggagaggaaagagaaggaaacatgatagatttttattttgattaaaacaaaagttggtaacagcaactcaggtttctattaaataaacaaaagttgggagatactccaaaataactgttagtaatagctttaagttctgacaggctgtgccgaccggaatatgatacctaagttttaagtgcattgaaatagtgattcatgtttccttttgcctgtcttatacccagctcttacaactacacttgtgtcttaagtatagtgctgatgtggtaataggatatttctattcagccttatgcctttactgtgtgtacattctgtccatttaaaaggctgaattgtaaatcttaattttaaaaaattaaatgtagtcagttgtcattaatagcctcatgtttcttttttttttttgagacggagtctcactcttgttgcccaggctggagtacaatggtgcaatctcggctcagtgcaatctctgactcctgggtttatcaagcgattctcctgctccagccttccaagtagttgggattacaggcgtgcgccaccacacccagctaattttgtatttttagtagagatggggtttcaccatgttggtcaggctggtcttgaactcctgacctcaagcgatccaccctcctcagccttccaaagtgctgggattataggcgtgagccactacgacctgaccagcctcatggttttaattttcagttttgttggctggaaaatgatcttggatgtaatattaaatctatcaaaacattaagctgtcaatagaaacatttgagagtttgtttttaaaactgtagttgtattttaaaaatagctgtacagcttaggaatggggggagaagggagataaaatcagaaaattttcttttttgttggctatttgtctatcatctatgattagttgaaatacagcctagtaataaaagctgaggatttataaagtggtaatttgtagcttcttcatctgttttttagtgtaaaatgcagcgaattggttgcttatgtaggacttcagtaaaataagtgactagcagcagtagcagcagcatcgaaattttatcgaggtcaatttgttcttgttatcttaagctgttatcattaagtgcccggttgtatcttagcatacagaggcggaaaagcaagagcattcagaatttaggcaattggctgagtgtagatcagagttgtcaaagggagactcttcagatgggtggcttcatggatacttgttcagagtcacatttaccttgtacctagtaagaaacataatttgacatttttcattcagttaagtagtagttttaattacttgtaattgtatggtagaattgaagactttataagtaacctgttataatcgtgtcagtttaaggtgttgtgaaactggaagccatgctgtccaaactcccatatcttaaattgcatcctgcattttaggcgcggtggctcatgcctgtaatctcagcactttgggaggccgtggtgggcggatcacctgaggtcaggagtttgagaccagcctaacatggtgaaaccttgtttctaccaaaagtacaaaaattagctgggcgtaatggcggttgcctataatcccagctactcgggaggctgagacaggagaatcgcttgaacacgggaggcagaggttgcagtgagctgagattgcgtcattgcactccagtctaggcgacagagcaagactctgtctcaaaaaaaaaaaaaaaaaaaaaaattgcatcctgcattccgcagttgataacaaggcatgtttaaactttgctctcatacttcgttctcctcaatgtctgattgtgagtgtgctttttgaaaaattcttttttatttaggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgagtaagtattttggtttttagatttgtatttttcttgaaattctcactaaatttcccaagtcttccaagtggaaattctaacaaaacaaatacttagccatattgcactatgaatgaagaggttctagttgaaattagtgttgggaccttttaagtgatttaaatataaaggtagtgggccaggtgtggtggctcacgcctgtgatcccagcactttgggaggccaagttgggtggatcatttgaggtcaggagttcaagaccagcctggccaacatggtgaaaccccctctctactaaaaatgcaaaaattagttgggcggtagtggtgcgtccctgtaattccagccacttgggaggctgaggcagaagaatcacttgagcctgggaggtggaagttgtggggagccgagattgcaccactgcactccagtctgggcgacagagtgagaccctgtctcaaaaaacaaaaaaacaaaaaagaagatagcggattgaaatcgcttcaaaaaaaattataaattgaacaccatgaatgaaaactaaagccctttcctaatactcatttcctttcttccagttacttagatcaaccgtgttatgaaaccattaatagaattaaactttacagtgaatctttggcaagatatggcaaaagcccatacctttatccactctatggccttggagaactgccccaaggatttgcaaggtaagagcctgtgtttaaaacctcagtgatccaaaacctcatcttcaacataatgtgtatatgagatatagtttaaataatgagatgagatcagtctatgagtaataagatgctttttatttttattgaaataaaattaacatataatgatatgcatggatcttcagttaaaaaaaatccagttttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaatttaaggtaaaggggtggaaaaatatatttcatgtaaatggacaccagaagcgagcagaagtagctattcttatattttttattttataactatatatattttaaaaaaaatcagtttgataaatttatagacctatccctgtcctgggtttaactaaaacctgagtgaaggtatagaacattttcctcaccccataaagttcccttgtgtcacctcataatgaatactgccccccatccccagcaaccacctctgtgatttctgtcactatagattacttttgcttgttttcaaagttcatgtaaaaggaataatacaatatgttctcatttgtgtctttttcattttttgagattcatccatattgatgcatgtgtcagtaattcttttttttggagatggagttccactcttgttgcccaggctggagtgctgtggtgcagtctcagctcactgcaacctccaccccctgggttccagtgattctcctgcctcagcctcccaaggagctgggattacaggcatgcaccaccacatccggctaattttttatatttagtagtgatggggtttcaccatgttggtcagtctggtcttgaactcctgacctcaagtgatccacccaccttggcctcccaatgtgctgggattacaggtgtgagccattgtgcctggccaattctttttttttaattgttgagtagaattcctttgtatgaattatatgagcatataattctccttttggtggacatctagttagttttcagtttttggctattatgaatgaaggcactgtgaaatttttatgtaaaacactttctgtggggatataggttttcatttccttttgggtaaatactgggagtgaaattgctgactaatgtggcagatagaagtctgaattcataagaaactgtaaaacagtgttctggagtggttgtgtcattgtgtatacactcagcagtgtatgagagttctcgttgctccacatccttgtcaacatttagtattgtaagtttttaattttaattgcccaagtgggtgtgaaatgctatctcattatggttttaatttgtatttcttgactcatgttgctcaccttttcatgagcttattgaccatttgtataattttgtgctgtgattgttcaagtcttttgcacatttctaaagattggattgtctttctgtttttgacttgtaggagatcttggtgtatgatggtggcaagtcttttgtcatatatgtattaagaatattttctcccagtttatggctggtcttttgataagcataagtgttaactttttttttgagatagagtcttgctctgttgcccaggctagactgcactggcatgatcttggctcactacaacctctgcctcccaggttcaagcaattctcatgcctcagcctcccgagtagctgggactacaggcatgtgccaccacgcctggctaatttttgtattttgggtagacggggttttgccgttattgaacaggctggtctctaactcctgacctcaagtgatccacctgccttggcttcccaaagtgctgggattacaggcaggagccacagtgcctggcctagaagtgttacattttgatgaagtccagtatatcaaagaaaaaatttttttaatgtttatagctttttgggtcctattttagaagtcttttttttttttttttttggagacagagtctgggtgttttgcccaggccggattgcagtggcactgtctcggctcactgcaagctctgcctcctgggttcacgccattctcctgcctcagcctcctgagtagctgggactacaggcgcctgccaccgcgcccggctaattttttgtatttttagtagagacggggtttcactgttagccgggatggtgtcgatctgctgacttcatgatccgcctgccttggcctcccaaagtgctgggattacaagcgtgagccactgcgcctggccctattttagaagtcttttacttgcccccaagggcacagaaatactctcctattgtctttttttttttttttttagaagttttataattttatctgtgcatttaaatctgattcatcttgagacagtgttggtgtgtgggatgaggtaagacttgaggttcttttttttttttacatacgaatatttagttgttttagctgcatttgttggaaagacttccttttctaggtagtcgtggtgcctttgtgggagatcagttggctacatatgagtttgttttgggactcagttttgtttcagtgatttgtatttcctatgccagtactacactgtctggataattatagttttatattaagtcttgaagtaggtgataacactttcgccaactttttcttcagaatttgttttgggtgttcgcatttccatatacgtttttaaaatcaggttgtcaatttctagaaaacatgcttgttgggattttgatattgagttaaatttgtagatgagtttggagaaaatgatcatcttaattatgctgagtctgccagtccataaatatgattgttctccatgtggttttcttctcagcagtgttttacagctttcactgtagagatctatcacatttttgttcaatctctttgtactgatgccgctgttaatgtattttgtattgatgctgctgttaatgaaattgtcttaattttatgttgaaattgtttgctgctggtatacagaaatgtaattgtatgttgacgttgtatcctatgatcttgtacttaagttttactagttcacttactagtttttctagttttatatatttcttagaattatccttctacacagtcatgtcatctgtgaataaagagattcttcttttataacttttatgtgtttttcccccacttacctttattgcacttgttaggacttcctgataatgtcgcagggatgagaatggacgtccttgctttgttcccagttttacggggaatctagtaaatattttactattaaatatgttttctatagttttttttttttttgtagatggttttgtcacattaagttcacttatatttatagtttggtctgtttttttgtttgtttgtttgtttgtttttttttttggagacacgatcttactctgtcacccatgctagagtgcagtggcatgatcttggctcattgcaacctctgcctcctgggctaaagggatcttcccatctcagcctcttgagtagtagggactacaggcatgcaccaccccacctggctaacttttgtattttggtagagatggagtctcaccatgttgcccaggctggtgttgaacttctgggcttaagtgagcatggtggctcatgcctgtaattgcagcactttgggagggtgaggtgggtggatcgcttgaagcccaggagttggagaccagcctaggcaacctggtgaaaccctgtctctagaaaaacacaaaaaattagctgggtgtggtgatgcatgcctgtagtcccagctattcgggaggctgagtgggaggatcccttgagcctgagaggttgagactgcagtgagccgtgatcataccactgcatttcagtgtgggtgacagagcaggaccctgtctcttacaaaaaaaaaaaaagcatcaaacttttttttttccccctctctgtgcttcatatcggagaatgcctgttcatgtggcttcaagtttactgaccttttctgctattttcaataggctgttaatctcattcagtgaattttaatttttttatactgtctagatctagagttctcattttctatagttttattttttcttattttttttttttcgagacggagtcacccaggctgaagtgcagtggcgcgatctcagctcactgcaacctctgcctcccgggttcaagcgattctcctgcctcagcctcccaagtagctgggattacaggcacatgccaccacactcgggtgatttttgtatttttagtagagatggggtttcaccatgttggccaggatggtctcatctcctgaccttgtgatccgcccgcctcagcctcccaaactgctgctttacaggcatgagtcaccgttcccggcctatagttttcatttttgtgatattctctatttacttgactgttttgagtacatttataacaacatatttatccttgaatatgtatctttgaacaaggatatttgttctggaacatattcttgaacatataatatccttgaacgtatttataatagctgcttttaaactgcgtattttaacatttgggcatctgtttctgttgtttgtttttctgttttctttggatcacagttttctgtttcttcccatgtctagtaatgttggattgtatactggacacatgaattgatagtttgttgagatgccggattcttcctctgaaaagttggttttggtttgagtaggcagttacatttttttattgactgttcatcttgcatttgtggagactggattttacaccttgttaaagtgggtccttttagtttttccttttgttgtttgctgatttgttttaaatcacaatttattgatttcttacaatcaaatactgccaactagcattacttccactcatgcatcattaaaagcaaaggatatttcctccttggtatttttaaatggtacattatacaataaacaaagttagaacttaaaatgcacccttattaattatgtaaactggtaatttgtttaaaaaagcataactaataatttggttcctttcttcataaaatggaaatttaaatatttctcctgatagtcttgaggtgatcattagtagtgcaaagtgtggcacacacgtatagtttcatctagaaaggtgtgtctcttacacaacttatttaaacaaaatgcacattaacaaaatgcatatagtcaatgcatgaaagaaagcatgtttcaattacaaggcagcccctcgggccaccatattatttaagttttgcatgatcatttatggcattatagattaattatgcataacatacttttatacttttttttaaattatactttaagttctggggtacatgtgcagaacgtgcaggtttgttacataggtatacatgtgccatggtgttttgctgtgctcatcaacccatcatctacattaggtacttctagtgctatccctccctagcccccatcccctgacaggccccggtgtgtgatgttcctctccctgtgtccatgtgttgtcattgttcaactcccacttatgagtgagaacatgcggtatttggttttctgttcctgtgttagttaactgagaatgatggtttccagcttcatccatgtccctgcaaaggacatgaactcatccttttttatggctgcatagtattccatggtgtatatgtgccacattttctttatcccgtctaccattgatggatatttgggttggttccaagtctttgctattgtgaacagtgctgcagtaaacataagtgtgcatgtgtccttatagtagcatgatttataatcctttgggtatatacccagtaatgggattgctgggtcagatggtatttctggttctagatccttgaggaatcaccacactgtcttccacagtggttgaactaatttacactcccaccaacagcgtaaaagtattcctatttctccacatcctctccagcatctgctgtttcctggctttttaacgatcaccattccagctggcgtgagacggtttctcacatggttttgtggttttgatttgtatttctctaatgaccagtgatgatgagctttttttcatgtttcttggctgcataaatgttttcttttgagaaatgactgtgttgagatggagtctcactctgtcacccaggctggagttggaatggcatgatcttggctcactgcagcctccgcctcctgggttcaagcgattctctcacttcagcctcctgagtagctgggatttcaggcacctgccatcatgcccggctaatttttgtattttttgtggagatagtgtttcaccatgttggccaggctggtcttgaactcctgacctcaggtgatccacccgcctcggcctttcaaagtgctgggattacaggcatgagccaccgtgcctggcataacttttatgcattttaaccctgaagacaagacaagtaattgttgcttgaaaaaattattctatgtagccatttggtttgtatctggagaaactgaacctccatgaatttagtgtgtactaagttggaatcattagctcgagtcagtgaatcagatacatttcacagtgactgtttgccaagtcctggcaatgcctcttctcccacagtctgccagatgaagcatttccgggattacccttctatgtggttttcccttttaatttttttgctggattaactgttttcgcattatttcctcttctcccctcttctctggccttccattttaattattcataaatcctttcagaatatcctcagctccataaggggaagttctggagatggaaaatccaagggaggaagattggggattggaatgtccttggctttcctggtatttgctgcaaacttctgccaggttaaagaggctgtagcagtttctgaatgtggcggcaagctccataactctgacttttctacaaaatcagcatctacatccagctccttttctattggaccatttagaagtctgcccttttcagccttgagttgtttattttctttccttaatctttcattctcagccacaaggaattccacatgcctcttcaaatctgcttctctataattgttttatctttcgggcctttgcttctaatacatggctctgctggctcactcttttgctaaagtaaaaatagtagcgtgtctggatccctgtcaaagatcccttgaatctcaggcaggcatttctctgtgaaagggctgtgcttctgagaaagggggctctggctctctgcatcctcagcagagggtttgtgagatgggcagctacatcctatgttctgctgggctttcagtcttttcacgctgggcccttttccacctgtcttggatgaggaggcgctgtttcctattcctttgcaattccagtgaaaaatgagcctgctcagactgtcagcttcacggcttctgaaggatatgccgcagcctttttgtgacaagaaatagcttctttgtagttgctgataaatggtctgttcatctgctctgttgatgagccaggttgagggatccattattttcatagactccggggtaagtggcagccttaggaaggggagcagtggcgcaggggaacatggaggggactgcagggaagcgcgatgcagccgcagggactgtggcccctctctgcgttcaagagccagcagcggggcgcagagggagcaacaacctcaccacttcctcctccagcactgctccacgggcctgccacctgcgctgctgctgctgccacgcacggtgccatgacgtcacacgcgcaagtggcctctgcttattcttaaacgttactcctctggagtaagcaagctcctttgaacatggcaattttaaacttcagacacattttttcttctgtccttcctctataatctctgctaacctctttgagcctttcagctgtttatttctggtggattccttcgcttttccctcctgtgtgagcacttctggaggtagttaaggatttgaagatattttatcatagatttgttggctccttcttttgaggctccctcttttgtgaaactttcccctacaattttcatctcctctggccgccccaaattctgtcacatctcaaatcaataggactgcaggcattgtgcttctgttgtagctgtaccatgttgcaaggactagggaagttgctgcctgaggggaaaaccatataaactacataaagctctcacccacttggttcctttcaagagtttcttcagtctctggtttttgctgctttaagtcattctccagtgctgcctttccccccactttattactatctttttttgagacagcattttgctttgttacccgggctggagtgcagtggtgtgatcacgacttactgcagcctcgacctctcaggctcaagtgatgctgccacttcagcattccgggtagctgggactacagatgagtgccaccatgcctggttaatttttctatttgttgtagaaacagggtttcagcatgttgccaaggctggtcttaaactcctgcgttcaagccatctgctggcctcggcttcccaaagtggtggcattaggcgtgaaccactgccttcagttccttctgatagtgttttaagtccatagttttatttatatgccagaggattagactaatatagctattactggtcaacccttcccttggccttgcccttgcccttgcccttccccttcccctgggtgtgaatccagagaaatggcagatttgcctctgatgtggatagtcccgcgactgcacaaggccattttagaacacacacacaaggaaaaacaggagaatagacagtgtggggttttgggaaagagccgattttagttgaagaagcagagtaaaacccagacatcgcatggctttaggctttagcctcaccacactcacgagcctcctgtccaggagggccattagtgtctcaggtctgctcagtgtggaccccgaagagccatccatcagggtgagcgaggagggataagctatggatgcagagccgctgcggccgagaggaactgttccggtgattggttagcaagcgggagagtggaaaggggagaagaaaaccgtgtatgggggttgaacgcctccagccaaagaaaatgaggtgtagaggtctcttactactagggaatgtatccgagtcacacagcaccaaatgtgttgctggtggaaggtagccgagtcacaggcaccaaaatatgttaccgtgctgagatgaatccgtacgggtctgcagcaacctcagttcttttctcctcagaagaaagaatgaccaaggggcataaggtagaaggagagactgaggcaagttttagagcaggagtggacgtttattgaaaagctttagggcaggaatgaaaggaaggaaagaaagtacacttggaggagggccgagtgggcagctcgaaagacaagtgcctggttagtgattttttttgacttcgtatttataactgattatgtttgtgtttttgactctgttttcttgctttaatcacttctaagctgacatctttctagaaggaaattgaacaaatgtatattgtctgtaactcattaagatctaagaaaggggactttaggagttgaaacaactatatattattaattgggattttaaaaattttccaggctaagtgctatttatggaggtacctatatgctgaataaacccattgaagaaatcattgtacagaatggaaaagtaattggtgtaaaatctgaaggagaagtaagtagcttttaaaatgaaaaaaattactatgttcttgtgaagaaagttgtgtattctaaatattgattttggtgtggacactgatgcatatgatttctgtatgggaagttagtatttattgtgactaaggactaattacagttgctgtgctttgttttaaaagcatcttttttgttgtcagttgttgattattttaatattgaaatatgcattatgggtgagctctaaatagtaagtattctgtatttatagagtttgggttgtgcctgtctcccaaattttcattgaaattgaactgtacttgcaggccacctacacgggtggggttttgagcagcatttctcaaatgtgaattatatataaagcatcattaatctggttctagtgcatgttctaatcagtaggtctgagaaggctctgcattttcttgaaacctcttaggtgatgtggatgctactgaaaaaaaaaatcacaaggaaaaaaagatcgtttccctttatcaccatatgaattaattcttctgccatttgacactgttactatctgcaacagttcttgcagtagaggatgcacttcaaagtgcactgctttactgtctcactggaattctaaaaatctaagctttatctttttaacattaagctgtgtgggaatgtagcaacctcctgggtggtggggtggggggcatcttcagttatttaggtctcactggaaagtttgagatcagagtttggtaggtggtgtaaggggacaatgagtaagggagagaaaatacaggactgacttggggcaaaaaacgcctgataataatttgtgaagcacattttcaaactcatttattccttacaaggatcctaagaggcgggtattatgtccaggttatacctggaggcttaaatgaagaaacatctacaagggcacacagtttaatgaatggctgaggtagaattggaattaaggtgttccgcacccacagccctcagtcgttatacacctgaggatgtaaattcctgtgctgggtgatgttagatttgtgtgttttatctactaaaatgttatttatttatttatttatttgagacatcaaatcgttttgctctgtcgccgaggctggagtgcagtggcgtgatctcagctcacttcaccctccaccttccaggttcaagtgattctcctacctcagcctcccgagtagctggaattacagatgcatgccaccatgcctggctaatttatgtatttttagtagagatggggtttcaccatgttggccaggctggtctcgaactcccggccccaagtgatccgcccgcctcagcctcccaaagtgttgggattacaggcatgagccactgtgcctggccttctagactgttacttaattgggtcttttgaacatatattttaggcaacttctttataaccctgtttcatcttgactgtcgtagtgtgattggcttatctgctttaaatgaagttacaaagcacaaaagaagtcatattttgtttgacatgtacattactaggttttgttaatgctaacttaattctcaggtatatcagcacaaatagcactgtttaccatccaggtccaacaaacttcactcagccacctttgtggggttggggtcatcagtatcactgtcttccatctccacatcgtgttccactggaagatcttcatcagggacagtaacactgcttgtactttcagcataatagttgtttaggagatagagataaatggtgtgtttttttttttcttctcagtcaccaggctggagtgcagtggcacgatcttggttactgcaacttctgccttccgggttcaagtgattctcctgcctcagcctcccaagtagctgggactacaggcatgtgccaccatgcccagctaatttttgtatttttagtagagatggggtttcaccatgttggccaggctggtcttggtttcttgacctcgtgatctgcctgcctcggcctcccaaagtgctgggattacaggtgtgagccaccgcgctcggccagggataaatgttttaatctgtcttctgaaagttacttttattctgtatttttcttttgtttcattctttgtgtttctgaaacttcagggctttgatatgaaagggaaggaggctataatacatttatcttgcaattcaagtttttcttaggaagcatagccttaagatgataaggattttagtctatgtagagtacatttactgagcatttattttttgtcaggacacccacctataatgacagacttttttacaccatttcatttagttcactaatgtccaaccttttggcttccctgtgccacattggaagaggaagaattgtcttgggtcacacataaaatatgctaacagtaatgatagctggaaaaagggtctgtgcataatttcgtgatgtctgccaccacaaataagcaaaaatgtccttgcattcaaggggctggacgtggctgaattttagtactaacaacaatcctttgaggttaggtagagccaggatttgaaccctgatctgcccaattctaaaacttatacttctgaatactgtgcaacacagttttcctagtatttgaacaggatttacagttcatatatctgttcaaggagaaaatagtagggataattggcaaagctagtttcagtagttaccgacagtttaataattaccttgacttttatattcattagattatgaagataacagattatattcaagggaaaattacattaatatactgtttaaaacattatagacactgaatattagtctttttccctccattttttttttttgtgataaagtacccataaaatttaccatcttttttttttttttttttttttttgagacagtctcactttgttgcccaggctggagtgcagtggcgtgatcttggctcactgcaacctctgcctcctaggttcaagcaattctcctgcctcaacctcctgagtagctgggattacaggtgcccaccaccacacccagctaatttttgtatttttagtagagatggggtttcaccaggttggccaggctggtctcaaactcctgacctcaggtgatctgcctgcctcggcctcccaaagtgctgggattacaggcgtcagccactgcgcccggccagaatttaccatcttaaccattgttaagtgtacagttcagtggtattaaatatattcacatcattatacaaccaccacaaccaccattcatctccataacacttttcctcttctttttttttgagatggagtctcactctgtcgcccaagctggagtgcagtggcatgatcttggctcactgcaatctctgcctcccgtattcaagtgattctcctgcctcagcctccccaggtagctgggattatagatgcataccaccacgcccggctagtttttgtatttttagtagagacagggtttccccatgttggccaggctggtcttgaactcctaacctcaaatgatccacccaccttggcctcccaaagtgctgggattttataggtgtgagccactgtgcccacactcacttttcctcttctaaaggaaactaccaattaagtaataactcctcgttctctgcttccagccactggcaagcaccattctactttctttctctatgattttaactactatattttatataaacggaataatatagtatttgccttcttgtgactagtttatttcacttagcatgatgtccatggttcatctgtgttgtagcatgtgtcagaatttcctttttaaggctgaataatattccaatgtatggaaagatagaccatagtttgcttatccattcatcgatacctggattgcttccatgtttttgtgaatgtattgtgaataatgctactctgaaaatgggtgtacaaatgtctcatcaagaccatgcgtttagttcttttgggtgtgtacccagaagtggaattgctagatcatatggtaattctgtttttaatgtttgagaaactgccataccattttccatagtggctggaccattttacattcctgtcagtagtggacaagaagttccagtttctccatatccttgacacttaattttgttttgatagtagcaatcttaacggttgtgaggtagtagctcactgaagttatgattagtgatgttgaacatctttgcatgtgcttattggccacttacatatcttctttggaaaaatgtctattcaagtccttcgattttttttttttttttcttttgagacggagttttgctcattgcccagcctggagtgcaatggcgtgatctcggcttaccataacctccatctcccagattcaagcgattctcctgcctcagcctcccgagtagctgggactacaggcatgcgccaccgtgcccagctaattttgtatttttagtagagacgaggtatctccatgttggtcaggctggtctccaactcctgacctctggtgatccgcctgtcttggcctcccgaagtgctgggattacagacgtgagccaccgcgcccagccctttgatcatttttgaatcagggttttttttgttgttgttttaggagttcttgatgtattgtggatattaatcccttatttgcagatattttctctcattctgtgagttgcctcaactcttgattagtgtcttctgatgcaaaaatttctttattgtttttttaaaagagacagtgtcttgctgtgtgttgcccaagctggactcaaagtcttgggctcaagcaattctcctgcctcagcctcccaagtagctggggttacaggcacatgccaccatgcctggctatgcacaagatttttaaaattttcatgaaatcctgttttcatgaattctttcctttgttgcctgtgtctttggttttagatacaaggaattactgccaactccaatgtcatgaagcttttgcactgttttctcctaagagttttatagttttagataccacatttaggtctttgttccatttttagtttttgtggatggtgtcaggtagggtccaacttcattcttttgcatgtggatagttttcccaggacggtttgttgaaatgactttttttcccctcattgaatggtctttgcaactttgtcaaaaatcactgtactgtggatgcgagggtttatttctggctctctcctcgtttcattggtccatacgtttgtcattatgccagtaccacactgaattgatcactgtagctttttagtgagtgagtcctccagctttgctgttcttcttttaagattgttttggttgttccagaattcaatcccttgggaaccaatatgaacttgaggatggtttttgatatcttaacaatactaagtcttccaaactatgaacatgggatgtgtttccctatatccttgtccgcttcagtgtcttcttaaatgctttgttatagattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcaggtgaggtttgaagaccagcagatgttggtagaattttgtaagatataatttgctttgtgttttatcccaaattcctaattttgtatgctgtattagtgaacagaccttggtttacatatgggggaaaaaaatctttgtacctcctcctgctccggcagcattgtgtcaacgcggacagattcaactcggagccagccttggacttgtgtccatcacctgtagaatgaacagactgggcttggtgaaccctgcgtctcccagctctaactaacagtaggttcctgtggaggtttatgcttaatagttaactgacccgagtatattcttgagctaatgacatagctgcttctgtgtccttatttgtaatcctagtacctacatttgattctagcagtgtccacctttcatttctgtgatcaggacatggctctaaaattgcaagtcctaacttatttgtcttagccagttgtttgtaacccttcgatgttcccattttcctttcaactagaagccccaaatctttttatttatctaaaattcagcttaaaaagggtaatcaggctttatgggacaggtaagagctatctgtataatgattttttttcccccatataagaaatgaaatcatgggaggccaaggcaggaggcttgcttgaggccaggggttcaagaccagcctgggtaacatagtgagagctcgtctctacaaaaacaaaaaacaaacaaacaaaaatggctaggtgtggtggcacacacctgtagtcctagctacttgggaggctgcggtgggagaggatcacttgagctcaggagtttgaggttactgtaagctgtgattgcatccctgtctccaacctgggtgacagagccagactgttaaaacacaaaaaaaaaccaatcacaaaagatgatctgtagaacaaagggactggacttaatcttccacaaggttcccaggcgggtcctgggtccttgcaagtctgaaaagaataaaggaggtcccagagttttttttttttggcctttaaatgctctcctatccaaatgattttctatcctggaaatgacacagttaactggatgagtggtatacagaccaagtctaatcgagaattctatcgttatgccaactcaaaagtggtttatgtggattctgcagttttacattactgtaataagtaaatgaggacgtcagtactaagtacatcctttcttagccattcagaacctttctaaatgcaaggtccagaatggaagaatctcccagaatagttaatatggtttggcaggttttttagttaggtatgacagagctgttaagagatctcattccaaacttcagcagttcgctaccacttcaattcttaatctctagtaggttaaaagaaattcctattgttaaatatctgtgtactttacatccaactctgtcaccatttagaacttaagtgtagaagatcttgcctattgagagtaattttaactcacacctcatgacatatgggtgatacctgagtatgttgggtcccagatggagacacttgaggcagtgagctggtatcatttgtttctagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaagtgagttgtgttcttttatatctgccgagatgcaaactgaggcctttgattgtggctccatggtgggacgaatgtgagggcaaggcaggtagctgctggctgctctgtgggattcatctgtacctctcagttgacctcaggcagagccatggtcaggtgtgggaccagctcacctgactgaattctctctccctccagatttgttagcatcagtgacctcctggtaccaaaagacttgggaacagaaagccaggtgagtatggaagtgtgaaaggatatgggcaggtttcactggaagacatccctccatggtcttaagtcttcgtaatttttgttttcagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggctttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 35585 - DNA, 38720 bp, Homo sapiens
gtggtgggctagacgagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataaggtaggaactgtggcgaaacagggacaagccgccatcttggtaaaggagaagaggctacgcttgacctccccccccacccccagcctctatatggccaactgccgtgggaggagcacggcgcttgcgcagaggcggacaacgcggacgactctgggcttgcgcactcggaagccggccgcatgggggaggggaagaaggccaggtcgcactgagccaggaagcagttggcaaaggggcggggtgacgcggtgacgcaatccgcctgcgcgctgggcggggcggggcgggctggggcgggctgtgagcggaccgcgagcgctgggcgggtccgcggcgcggtcggtcggcgcctgttctcgggctgtttggcgggtgagtgtctcgccggtgtaccccgcacaagttgtgggccggccctcccgaggagctgcgggggacgcgccgctcgtcccatactctcgggcggtggtcggctggctctggggtgccggcggggcggtgtgggggaggggcggccgagcccaggctcttcggcacttatcgtgggctcccccgtcccgggcggtcctagtgccggcgacagtggctccgacacgggcaggcccgggcgcgggagtggggattccggtgaccccttgttgaccctgcgggaattcctctgcactgtcgtcggtgctgggcctcggggcgtcgagtgcggtcgaggtcgggaggtttggtgcttggagggaggatacaggtttaggcccgacaaacacttagagcttgtgtggccatcttgtctttctaacggtgccatttcctccctgaggcgtggaggactggccagcccccaaacctccaagcccatcggctggatgccgtggataagcgaggggagagcgactaggccctgtctgcgggtaccttcggcgaggagaggcgacgaaggtctgcaccagcgaggcacggacaggcagcagggggtagggtatagggttggaggccgccgagttggcccggggatgaggagcaaacctgtggcttccgtggtctcagtggagtcccaactgtgacctggcctactggcccagacaaacctggcttgcttttttaccttttcggtctaattcttgtcagtgccaccagaccttgtcctctctccacggaaacacacgaaccaactacactgaacttcttgtagttcaaacttctgcacctttggccattgcccaaactcttaaatctggctacttcccaccttaactgccttctccttacctagtctgtgcttgtgggattccgcccaaattagatttcctccagacaggcttaggtgtttacctgatgttccagatggtatttgtccagtggactattggtgctgtgagggcagggcacatgttgtcacccatactcattgcctcggttggtgtctagcacctagtaggttctcaaatactttttgaatcacagtgcctgccgatatatttaatgtttcaaaatagttctgccgtcataaagaaaaacatcatggtgtaggggtcatgaaagctgattcttgatacttctgatttgagcctcattgttttcagtgatttttgatagctcccattaatgggttctttgcaccacccagcatcctaactcatgatgtgtactgttatgtataatcttggcattgatctcattagctataaaggttgtcctgattttttttcctcaacttccaccttgatttctctcaccagtgccacagccaggaataaagaacaagagcgttttaattagatcagatttacattctgactggctcttaaactagcaaggtgacctagggaaaggggccagggtttccctctatcattcataaatgtaattcagggcccctttttatccccaataccagcatacagaaactgctgtaaaagaagaagttgtgggtatttttttttttttttttgtctggaggaatggggacaccaaaactcatttggcagcagaggtgaggtaaggccatttgtattgtctgttctgttagtagtcatacatgccacttatccctgccccagtccctgttaggagtgttatgtgggtatactgaacgtggaccttccccgaatccaaagaatccagatgctttgaataagatcatggaccttccgggttctacatcgccagatgttgttcatcttctatcttttgttttgcgaaaattggttttttatgtgtattggggttattctgtggaagaaataagctgtgggtcaagattaaagaactttaaacaacttctggcatgtggaataaacacgatctgaaggaacaaaattttcatttgactacatttttggtccaatttgcacccagtgtttaagttaatcacagtgcttggcagtttgtgttgctggatcaaggctttctcactgaaaaccatgtgcttcagaggttcataattcctctttcaccttccatttcacattagttaataaattatgagagaaaacattgtggatccaagttatgtttcagaaaaaaaaaaacaggaaaaaaaaaagatggcaggagaaacttggtaaagtcaaagcaaagttgaaatgtcagtttaagacaaatagtttctccattttcccatatgtgtgcacagggttcagtgaggctgaggggttctgtggaggtgcgggagaggtgctctatggtatttctatgttgcactgtgtgggtttgaaatcagatacatgtaataggtgataaggtaagtgcctgctcttttctatcctcagcattggcatttaatctttccatgtgaacttaaagctcattttatccaatcctttaagaaaaaagccacaccgttagggattccagttagaaatggactaaataacatactcatttggggaaaataaaaatgatttgatttatgtaggacctgttttctagtttggtccctacttgtttggatttttaaaaattctgttgtaaatgatgtgcccccatttctattccttgatatttgttgctggtacttgacttacttgagatcttatatttagctaccttactaaattatcgtattctagaatttttttaaccagagtatttgtattttctttttttttttttttttgagacaaagtcttgctctgttgccaggctggagtgcagtggtgcgatctcagctcactgcaccctccacctcccgggttcaagtgattctgcctcagcctcctgggtagctgggattacaggcaggcgccaccacacctggctaatttttgtatttttggtagagacggggtttcaccatgttggccaggatggtctcaatcttttgacctcgtgatatgcccgtcttggcctcccaaaatgctgggattacaggcatgagctaccgcacccagccgagtatttgtattttctgtgtattcagtccaatcagcaaaaaagtgttttcttttgattttcttgtttcattatattcagtaaactcaccaaggtagtattaaataatcatggtgaaattgcaatatctggatcttacttggatcttgattcacatgaaaaaaatgagagaatagagaatatgaatactgattggatatttgattgcattaaagaactagctatgtgtaatggtttgtcatttttaggagcccttatttttagatatgtgtagtggaatataaatgaaatgttacatctcgtatttgcttcataatcatccaggcagtggcattgatgattgtggaaatagatgaaacattattgaccttcagttgctaattgttgaagctggataatggatagcacatgggggttttgtttgctttttgtataggtcttcatgtaaaagttttcatgtaagtgcttaaaaataattatggaagggcattcctgccgaattatcggttgtaatttaaatagatttaattttctattgtttagaaaacagtatttgcctttggttttcagaaatatcctgaattagatttaagcagttttcctttttttctttttttgagacagtctcactctgtcacccaggctggagtgcagcagcaccatctcggctcactacagccttcacctcctgggctcaagggatcctcccacctcagtctcccacttagctgggattacgggtgcccgccaccacacccagctaatttttttgtattttttgtagagacagtgtttcaccatgttgtccagactggtcttgaactcctgagctcaagcgctcctcctgcctcagcttcccaaagtgctggtattacaggcgtgagccaccacactctgccagcagttttcttactgttttcattatgattggttgctgaatttcatatgcctcatcagcatctattaatgcatgattttttttcccctatactgtgttgttggattaatattggtagatgcttttgatacattcctggaatctaattgctagcaaatattgtattcaggatttttgcatttatatttgtgagtgagattggcctatggcgttcattcattcctttgttcctttcttatgtctccatctgggtttgttattaaaactgtgctgtcttcataaaacaaattgttttcccttttctctgtagaggcttggaatagttaaatgactttggtcttgtccaaggttagatggagttcaactctaacgtcaagtcttggtccttttcattggtatgtctttaatcagctgcttagtgatacttgttttagtcagattttccagtttttggttctgtattggtaatttacagtgcccattttttctgcattttcagatttggggccattttgctacatgtagtcttctctgtcattattttagctacttttctatatttgctattttttcctgaattgggcttgtgaggaatttgttttagaaaaccagcttttgcggccaagcacggtggctcaggccggtaatcccagcactttgggaaaccagggtgggaggatcacctgaggtcaggaagtttcacctggccagcatggtgagaccccatctctactaaaaatactaaaattagctgggcgtggtggcgggcacctataatctcagctattccggaggctgaggcaggagaattgcatgaatccaggaggcagaggttgtagtgagctgagatcgcgccagtgcactccagcctgggcaacaagagcaaaactccatctcaaaaaacaaaaagaaaaccagcttttggatttgtttacccttctttttccccccctcataattcattttttctctttattgatttcctgttttatctcctaagttttgcttttatcttccttccattgctttctagagattgcttatggctttgcttttgttaccctccttgatcctggggatatccagtaatgtaacaaattactgggagttacttttcatctttttccacccaatttaagcagataattatttgagaacattgactgtaaaaatgtttttcaaattttgtttaggcttttttttatggtagatacatgacttcaaacattttttaaggtattgattcaaatttctctatgtctgctaaatcagatgtatttgttgtattactcagttcttctctgtccttgcacatactgtgtttactgaatctgtccggttctcagagaactctattaaagtttctcacttgaatttttttttttaagtttgtatttttcctagtccttgctttatgtgtttatctacagtgattatttgaatatacaggcttatgaatattacatcttccctataaattgtttcttttatcattatagcttgttatccctgttattctgcttatttttactttaattcccaccttggctgatagtagtgttgtctctcctccatgtttgcactagcctgctattttttaccttgtccctttattttcagcctctctttgttccttttgctttaagcatatacgttatagctggacggtttgttgtttttgttttttttttcccttggtttttcaggccaatctgtcttctcctttaagcagagaatttggttatttcacatttatactgataactgatattcttgaattttgtccccattgtcttgatttaggattacttctgattttgtttcttcttgttccttttccatatttttgctggtttgatgaagttgctgtttcctccatatttttctcttaatttggaagttctcattgttattttctttaatgattacctttttttttactttcataatcagatacttatctctgtattatttgaaaacgagatgccaactccttctgccaaaactgtctgtattacatctgacccttctctttccctttaggaagttctactcctccacactcacacttgctctcaattcttaggttttgctgaaattaaaggctcttgaaccttactgctactatcccttggttaaccaagccaaataacactggggatgcagggatctcatttcttccaaagtagctgggaacatttccagtcaaaagggaaacagaggacacagtattcaggaagttaagatttgggggaggggaatcgagaggcaaagtgagagaagctttttaataagtttctaagctccagagggaaccaaatttgacagcagtcatctttcttggggttgttactgaaggttagccaacagactccatgctttccaaagcttcagggtttctaaaatttgtttaaaaattccacatatctctggctgggcacagtggctcacacctgtaatcccagcaccttgggaggctgaggcgggcgggtcatgaggtcaggagatcgagaccatcctggctaacacagtgaaaccccatctctactaaaaattaaaaaaaaattagccgggcatggtggcgggcgcctgtagtcccagctactcgggaggctgaggcaggagaagggcgtgaacccaggaggtggaggttgcagtgagctgagatcacccactgtacttcagcccgggagacaatgcgagactccgtctcaaaaaaaaaaaaagaaaagagaaaaaaaaattccacatatctttaaaaatattgtcacatttttcagacactcagatgccttcagtactatttcctttcctcataaatgtagttcacattgctctctgtaccccagtgtcaaaatctagttctcaggtagctctaggaaactccagtgggtggcaaacatgttcaagttacagtgctctatgtaatgaagtcccttactccttgaaaggtttcaaagagagaggggaaatgacataattccagaggtcagggaagtatgtatccgtgtgtatcccatttgtgtccctagtgtctaacatatagtcagtactgaaaaaaaatttgaatattattgaaaatatggaatatgtgcgtacatatatatatacagttgcttttatcaacttaaaaatttttttaattttttaattttttgtagagatagggttttgctatgttgcccagattggtgttgaatttttggcttcaagcagtcctgcctctgcttcccaaactgctgggattacaggcgtcagccactgcacccagccaccatctaattttttttttttttttaatggagtctcactctgttgcccaggttggagtgcagtggcatgatctcggctcactgcaacctccgcctcccaggttcaagcgattctcctgtctcagccttctgagtagctgggatcacaggcacgcaccaccacgcctggctgaatcagtatttttagtagagacggggtttcaccatgttggccaggctggtcttgaactcctgacctcaagcgccaccatgcctggctgaatcagtatttttagtagagatggggtttcaccatgttggccaggctggtcttgaactcctgacctcaagtggtctgcctacctcggcctcccaaagtgctggaattacaggcgtgagcatcacgtctggcctaatttttttaatcgaatttatttttgtaatgatagatgcttgtcttattcctagggaaatatttgaagtaattgagatgctgtcacctaaaataatcaaaaggctcctgattcagttaaaagaattcatttaagtacagagtgtaagcgagctacaccaaagaatggtgattagcgctcccagggtggggaaaaatgaggattgtttatataggcaaaatggaggtgccaaacagaattataacattttcggaactaaggctcatttaaagatacaaatttgattggctactattgattacacttgaagggatttgtttaacttccttttgtaaagaagtaacagtcataaggatctctcatctcccagtcatttagtctagttttgaataaagaatagggggtctggttaatatatacatctaaacacaaaagtcagaaagaataaaagtagtgatgttacacgagccagctgtcagtgcttaacttttccctttggcctaatgcatttggaaggtcctgaaattgtattttctttttacattgcctatgtatgtgtaagtcttcttcaggtcagttcacgctgttaaatatacgtgcgtatacatacatactatgtatgtgcgtttatgtgtgtctgtgtgttttttttttaacagacgaagcttcacaaaagatgtctaaggtaagatcatacttcatgtatctacagcataaggagaaattgctttatgttttcagactgttgacagtcgggacttatatgattcattatttttaatacaactgatacatttgattcattaacacaaagagttctaatttagttgtctttttttttttttttttgagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacaggtgtgagccaccgtgcctggcctaattgtcatcttaaaagcttggagctttctcttttttcaggcttctactttcttttctctacacacatcagtaacagtccttttggcccccttagttcattcccagcagaccagataatttagaattctgataatttattatgatgaaattgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaagtcattatttcaccactcaggaataaccactgttaatatgttacatatattctttttcacctgtgtgtgcatttgactatacatttacaaaatgtaatcctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgaccttctggaagtgtttatactttttaaaaaatttgtgaaaactgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtaagaaattaatctatagtctccaacttactaaataaatatctcccctttccaatctctggagtatgataacgtgacctataaagaaagaggaaaatttggcagagtcaaataacttgagaatttgaacaaatatatgtgtattcattagaaaatttttctcaggagcaaaattatttttctgtcactttcttatttatatgtagtgaaagtttactcattgtgtcagctaggctccaaaatggcccccagtgattcttatctcctggtattcacaactttcttgtcccttcctgcattgaatagggttttacctgtgtagccagtaggacattgtggagatgaaagtgttgtcattttctaagactaggtcataaaaggcattatggccccccaccttgcctcttctcaaattactcactctggaggaagccagcccttcctgcattgaatagggttttacctgtgtagccagtaggacattgtggagatgaaagtgttgtcattttctaagactaggtcataaaaggcattatggccccccaccttgcctcttctcaaattactcactctggaggaagccagctgtcatgtcaagagaacactcaagcagccttacagggaagcccaccaagtaaggaaccaaggcctgccaatggctgtgtaagtgacccgtttcagaaatatcctccaggccaggcatggcggctcacacctgtaatcttagcactttgggaggccgaggcaggcaggagttgaagatcaggctgggcaacatggtgaaaccctgtctctacagaaaatatgaaaactagccaggcatggtggcatgtacctgtagttcctctcacctgagtccaggaggttgaggctgcagtaagctgagatcatgccactgcactcaagcctcaagcctgggtgaatgaaaccttgtctcaaaaaaaaaaaaaaaaaaaaaaaaaaaatccaggcatttacagtgtaacattcacaatgtctaatgtctaatagaaaattgtgtggcatcaaagaaacaaaaactgtacataatcaggagaaaaagcaggcaatagaaacagatccagaaatgatagaaatggatctcgatggcaaagaagaactctattacttaaaggaaagcatgaatataataagataaaggaaagatacaacagaaaaccaagtggaacttctaaagattaagatacaaccgaaataagaaattttcatgataagcctgacagcacattatacactgcaggagaaaaagcacagtagaagcacagtaagggaaaagctggaaaaaaaaaagaaattgaatgtgccctcagtgtcctttggtacattgtgaacagtctaatatatggattatattcacagagaagacaggaaagcaaaaaaaaaaaacatgaaaaaataatgcctgggaattgtgcaattttcagcaaagttgtaaatgcacagatccaagaagcttgacaaataccaggcaaaataaatataaagaaaactacaccaggacgcatcataacacgctaccagaaactactgatgagacaacaagcagaagaaataatagagaaaagcacaccaaagcctgtaataagcaaatagaccatagataaacagaaaggtctttaaaagtagccagatcaggcctggtgtggtggctcatgcctgtaatcctagcactttgggaggccaacatgggtggatcacttcagcccaggagttcaagaccagttcaagagcaacatggtgaaaccctgtctgtacaaaagatataaaaattagccagccttggtgggggatgccggtagtcacagctacttgagaggctgaggcaggaggatcacctcagcctgagacgtcaggcctatggtgagctgtcatcgtgccactgcgctccagtctgggtgacagagtgagaccttgtctcaagaaaagaaaaaagtagccagaacaaagaaatttattacatacaggggattgaagataagaggagtgaccactgaattgtcattaggaataacataactggtcgggcgtgatggctcatgcctgtaatcccagcactctgggaggccagagcgggtggatcatttgaggtcaggagtttgagaccagcctggccaacatggcaaaaccccatctctactaaaaatacaaaaacctgggcgtggtggtgcatgcctgtgacccagctacttgggaggctgaggccaggagtatcacttgaaccagggaggcagaggttgcagtgagccaagattgcgccacagcactttagtctggcgacagagcaagactccgtctcaaaaaataaaattaagtagaaattggctgggtgtggtggctcatgcctgtaatcacagcatcttgggaggctgaggtgggcagatcacctgaggttgggagttcaagaccagcctgaccaacatggagaaatcctgcctttactaaaaaaaaaaatactaaattagctgggcgtgttggcacatgcctgtaatcccagctactcgggaggctgaggccggagaatcacttgaacctaggaggtggaggttgcagtgagccgagatcccatcattgcactccagccggggcaacaagagagaaactccatctcaaaacacggtggctcacgcctgtaatcccagcacttgaggaggctaggcgggtggatcacctgaggtggcaagttcgagaccagcctgaccaacatggagaaaccccatctctagtaaaaatacaaaattagccgggcatggtggtggaggcctgtaatcctagctacttgggaggctgaggcaggagaatcacttgaacccgggaggtggaggttgcggtgagccgagatcgcgccattgcactccagcctgggcaacaagagtgaaactccatctctcacacacaaaaaaggtagagatttaaaaatgagaaaaggtgtatgtggcggggagtagaagtaatgtaaatcttttgttgttgttgttgttttgtttgtgtgttttgtttttgagatggtttgagatggagcctcgctctgttgcccaggctggagtgcagtggcacgatcttggctcactgcaagctccacctcccgggttcacgccattctcccacctcagcctccaagtagctaagattacaggcacccgccaccacacctggctaattttgtttctgtatttttagtagagacggggtttcaccgtgttagccatgatggtctcgatctcctgacttcgtgatccgcccgcctcggcctctcaaagcgctaggattaatataaatcttacacagacatcttcatgaaatagatgagtaggaaacacctaccagcctattttattaagccagcattatcctattacaaatgacaagaaaactacagactaatatatgttagaaatgcttgtttttcggtgccataaagaaatagtacttgaacataaattcagtttcctcagcaaggccatttttactttctacagaaagggtacactcgccagcagttttgtcaagagggtacaccgaacaaagaggatcatttgtaacctgggtcatttataacctgatgcgtctaccttactgctgtgtctggtttccactggctggaacggtacctcacattctgtatttgtcctgattggctagcaacttagaacttcttaaaagaggcaaaggcagaggagaacaaaggaaggaggaatgttgagaaaggtaaaatcaccttcaaataaggaagagcaacaggctatgacctaatgcttgcttggaccagcataagcatgccagggcaaatatttaggctgaattgtgcgagctaagaacataaagtactttgatttcctcattacggccagcagatatttaagaatgttagcacaggtctttgaataaattatgcttctaagagaagttagtattattcctaattagacggggagtaaagcctttaaagaggagcctctactttttacatatacacgagctagacatggacatcttaattaaatcttaccgagtccagcaatatatctaaataaaaagtcaatgcactgagtcctgctatgatgcaacccgtgtgtttctaaaaaaatcaccatgccatacagcatgatgaataaacaccacagggcttgtgcagaaaacagggacacaatactcagaaccttcatcagcgacacaatgggaaaaaagataggaacgtaagaattataccagtccacatgtaaatggttaaaaaataatgactgcaccatagaagccctgaggttggtttgtgcaagtggacatcaggagggttgcagcttgtgtgcttttgtgtagctgtggagggagggttttctaaagttggaaagtcataacactacgtgtaaatgggtgtggctcataacaggcagtgaagaaagatagctgatagatatttaggggtgtgtgttgggaatatccccaagtggtttgattctgttggatgcagaattaaacactgtcttctgtattctcctagtttctcaccaatgagatcatatataataagcaaatacgaaatttgtattactctgctattgttccgtaatgtatcaatcccattggaacaaattctcattttcaaattaggactgactaaacaaatggagtttatcttaggaatacatgatgcaacattcaaagtcattgtcatgcagtgtagttatcaaggaggaagatgatgttagctgaaaaacgaatttgtaaaaatccaggacccactaaagataagaaattaggctgagtgcagtggctaacacctgtaatcccagcactttgggagcccgaggctggcagatcacctgaggtcaggagtttaagaccagcccccccaacatggtaaaacttcatctctttagtacttttgtaaagtactgaaattagccggccgtgatggtgggtgcctgtaatttcagctatgctggaggctgaggcgggagaatcgcttgaatctgggagggggaggtttcagtgagccgaggtcatgccactgcactccagcctgcatgacagagcgagactccgtctcaaaaaaaacaaaagaaaaaaatcacaaacaagagtattaataattttaagacagtaccacttaacagtcacaaaaaatattgttcagagataaatttaacaaaacgtgcaagacctatacactgaaaactacaaaacagtgctgagagaaattaaaatctaaagttgttaagatctgccccatttgtggattggaactattatgccctttctcccccaaattgtcccatattttttctgagacagtcttgctctgtcatccaggctagagtgcaatggtatgattttggcaacctccacctcccaggtttaagtgattctcgtttctcagcctccccaagtagctgggactacaggcatgcgccaccacgcccatctaatttttgtatttttagtagaaatggcattttgtcatattggccaggctggtgttaaactcctagcctgaagtgatccacccttctcagcctcccaaagtacaaggattactactggcatgagccacagcgtccagctccaactttcagaaataaaaattaacaagctgattcggaagtttaaatgtaaatgtagagggcctagaacagacaaaaacagtttagaaaaagagcagagttggaggattacagtccctgatttcaagacttaacagcagtaatcaagacagtgtggtaagggtagatacacagatctactaaacagagcaacagccaagaagtagacccatcaatataataagttcaattgtttttttggtttcgttttttgagaaaaaagccaagttgattcagtgggggcaagtttagtctttttacagtctgtaacaactagatgattatgtgtgaaaaaatgaacttcaactcctgcttcacactgtatatcacaacctgaaattatagtagatttaaatgtaaagctataaaaactacaagaaaatgggcaaaaaaatttttatgactttgtagtaagcagatttcttaagacatgaagaatagaaattataaaaacaattgtgcattattaaaagtttgccttcttgaaaagacatcaataggaaaataaaacgtgaggaactcagaaagtattcatagtaccatatctgacaaaggatatgtgtccagaatatataaaaatattgcacagatcagtaagacgaatgacccacttacaaagagggggcaaaagatctgaatagacatttcactaaggaagataaacaaatagccaataaacccacataaaggtgtccacatctttggtggtcaggggaatacgcattgaaaccatgagatgccactacccagccactaagaggcaggcactccaggtgtcagcaaggatgtgaaacaactggaactcttactagtgagcatgtaaaaatgccacaaccagtatggaagccagtttggtacttccttaacagttaagacccagcaatactgcttgtatgtgtttacccacaagaaatgaaaacatgtccataaagatttgtatatgaatattcatagctacttttctcaaaatagccccaaactggggacagcagaggtatctagagagtggattaacaaattgtggtgtagccatacaatggaatattgccaagcactacaaagaaacgaactactcgtagatgcaacaacatgcatcagtctcagagctttgttgagcaaaagcagccagacacaaaacaggccatgttgtatgatgccatttaaaagttttagaataagcaaagctgatacatagtgacaaagtagattggtgtttgcctgcggtggggactggagagggtagacttcacagttacacaaagcaactctagggttatgaaaataatctttatcttgagtggagtttgattatctgagtatctacttttgtcaaaactgtacagtttaaatgggtgtattttagtatttgtaaatcgtgcctcaaagtggctttaaaataaaacaggtagggggttgagggtgagtagtgaaaagtaaaactagaaagccacaagaatcctcaacttttaaattgtagtattaatagctcaagaaaaatgggtgtatcaggaaaaccctaacacacctaattagtaaatgagagactattgaagaggaaaggcagtttttaaaattttgtcagacttctaaagaaacaggtaaaggggcattgcaccaccgtttattaaaaggatgacttaatgggataacaggcatttagtcaaatttttacactcatatttaggcatgttcaacacattgttttgttcttttcatgtgtgaaaattgcagttcacttaaaatgcagtcctaattttgtatgtctgcatgtttctttttgttttgttttgttttttgagatggagtctcgctcagtcgcccacgctggagtgcagtggtgcgatctcggctcactgcaagctccgcctcccgggttcacgccattctcctgcctcccgagtagctgggactacaggcgcccgccaccacgcccggctaattttttgtatttttagtagagacggggtttcaccatgttagccaggatggtcttgaactcctgacctcatgatccgcctgcctcggcctcccaaagtgctgggattacaggcgtgggccaccgcgcccggctgtgcgtctgcacattgcaaattcacttatttgttcttgattttcccagaattgttttattctgtaagggacagggtctcactctgtcacctaggctgaagtgcagtggcatgatcatagcctgctgtaatctctaactcctgggctcaagcaatccttctgccctagcctcccaagtagctgggactctaggtacaagccacaacacctggctaaggttttggggttttttttactttgttttggttttttgggagatgggggtctcactattttgcccaggcggggtcttgaattcttagcctcaagtgatcctccagccttggtctgctaaagtgctgggattataggtgtgagccactatgcccagccagaaataatttttcaaaagagatgtgtactccttcctcatgctttgcagaacttaacagagggtggtttagggtacccagaggacagtccagcaccagtagtaccaagatcagaagcagttctccatgcagaattgagacctagatgatcatctgcaatgaagcagtgggatttgtgcttccttcaaatgtaaaatttaatttttggtattttgcatcttttttgaagttaaatttcaaatattcagaatatgtagtcacagtagttcaagagagattctcacctcattgaaagcttacatggatatgtgtcacctgaattagtcgtgtgaactcaacaaagtgagcgggaaagttgcccgacatatgacagttgccagtgctgggaaacggggatggatttaaagcaggaagaagacaaggtggcagaagggggaggttgcagagtgagggtgtgcatgtgagcccaccagaccacaggccctgtcctgctcacacgtttctgcagctcgggaagcacaagggttgttgacactatgggatagatatgttcagttttctgaaaatgtggtgagtttagtgactagcagaactgataattgaaaacctgctttgcattctatttgtcaaaaataaaaaccaacctctaaagtacattcctcacatttgtgaacagttatgtttctaattatatgatgttcaagttctgtagtctcatagacctggattcaaatcttggccctgctctggatagtactctgaccttgggcaaattagagtttctttgagtaccctcaaagatcatactgcaaacatagtagtactgtaggtactaaacacagaatgatgtttgtgaggtacttagcccagtaccaggccttatgtaaacacttaaccgattgaatggtgtcatatgaataaggtcatgacaaggtttttctttttatttaaaggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtaggtgtgctgcaccgaggtccttggatttgggttgtagactttctttgacacgtatccatggatccatcctctcttgagtttgtctgtaaaatgtaataagtagtttctgcctatattaaatatttgatggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattggtatgctcccccatgcccagggatctgcatttgtttacttaatatacttcataaatttatagatagtgttaatgagtgattattaagtttgggattgctgtatataataaaacacctagacaatttaaagcgtgttaaatgttgactttttaaataaggaattttatagagagtaatttttttctggtactctactgtaatttgagatcgcaaagccagtcatccatagactgctagtataaatgaaacacctggatttgagccgtggttggtgaccgagatactgtagtacatcctttctatgtggaaggaagtgaaacctgttagagagtgggttgagtcgtagtgtctgtaaatgactgctcattggcatcattttcacaaataaggaaatgaagaagtagaagatagagcagtctgtcacctgtaccgtgcaaagaatgccacttttgttgtacaaactccctcctggttctattcctgtcaacataaagcatcaggtttccaccactagatgaaaaggggaaggttctgttatctttctcctacatttaggaatttctcccttcttacatgtgaaagtgctgtactgtttcccagctcagttaaatgctgtttcccagctcagataaacctgttcttgacccatgttctctaccaccctgttcctctgccccttttcacagtcacgttcctgaaaagaattggcagccctggctgggtgcgatggctcatgcctgtaatcccagcactttgggaggctgaggtgggctgatcacaaggtcaggagttcgagaccagcctggccaacatggtgaaaccctgtctctactaaaaatacaaaaattagccgggcgtggtggcgtgtgcctataatcccagctacttgggaggctgaggcaggagaatcgcttgaaccctggaagcagaggttgcagtgagccgagatcacgccactgcactccagcctgggcaacagtgcaagactcagtctcaaaaaaaaaaagaacgaattggcagccctgtctacactggccctctctcaggtgcatcataacctattccattcaggcttttgactctcagcacttaggggcagttatgcttggcatagtttccaaaaacttccatttgccaaatctaaaagtcagtcttctgttctcatcttgaaaatgaattattaaattatgtatatttgggcggaggcacttgttttccctttgaagtcagggaccccctgttttataccctatgattattgttaatgtttctgtttctctcagttttaagacaattatctcctatattgatgagcaatttgagaggtacctgcatgacgagagcggcttgaacaggcggcacatcattgataatagggtgcattgttgcttttactttatttcaccttttggacatgggtaagtaattgtttatcgtggagaaatgctttactacatgggtttgtaagttttacccaaactgtgtattttaatataagaattaagataatttgagagagaagagttttgtatgtattttttttaaataagtgacaattctaaaattaattttagacttaagcccttagatgtggcgtttatgaaggcaatacacaacaaggtgaatattgtgcctgtcattgcaaaagctgacactctcaccctgaaggaacgggagcggctgaagaaaagggtgagtgaggctggcgtcctgccctccctctgggtgcgactcgggggcatggggatgaagaaaggagtgtgttcccacgctcagtctgctcaggtgtcgggaggcagggcgggagaatttttcctgcattttagtggtggttttcaaggagaacctgatggttacaaattttaatttttgccttcatgaaggtatcaaatttctattctttaaattctccttatatttaaaatgccctcgatgagtagcagttggttacacacaagtaccttccatgggagttaaatgactcaaatatagaaatgtgatctctccatgaagtttgttattttacctaaattctttactgcaaatgacccatacaaggatgtatctaagtagactggttctctgttctgtttggaaacatagcagttgtcagccagcgaagcgcctctcacccgccagcagctcctgtggtgtcccagttttagtgcctcttccgtgtatgtctgtaaagcctctttattgattctctgctatatatttttaaattgcttactttgttctgattatatgctccttaagaaagtccaaatagtttatatatgctaaactctaaaaatacaaatccctaactgaacataccggtacgtgcataaaaatacaaatccctaaatgaacataccgatctgtgcgtgtaatcacagttgctggggcagggtagggggatacagcagggggttcaggcaggaggatcacttgagcccagaagttggaggccaacctcagcaacatagcaatacgctgtctctaaaaaaatatatatatatattttatatatataatatataattaataaatatatataatatatattacatatatattatatctatattatttatattacatatgtaatatatattatatttatattatttatataatatattatatatattatattatttatatgtaatatatttatattgtttatatatattatatttatattatttatatataatacatattatatttatattatttatatataatatatataataaatatataatatatataaaaatatatatatttaatatatctataatatatattatatatattatatataatatatataattgtacatatatttattatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacgcctgtaatccctgcactttggaaggctgaggcaggcacatcaccagaggtcaggaggtcgagaccagcctggccaacatggcaaaactccgtctctaaaaaattacaaaagttagccgggcgtggtggcgggcatctgtagtcccagccactcaggaggctgaagcaaaagaatcgcttcaacccaggaggcagaggttgtttgcagtccagcctgggtgacagagcaagactccgtctcaagaaaaaaaaaaaagaatttctgtaattacccacagaaagaacaactgttaagtatatatccttctagaacatagcttatgtttttggttttgcagaatgaaatcacatagtaatactattctgccatttgatttttctatttaaaaatatttggaagcatcctcatatatatactgtatcctaattcttcctggatgcacagcattccaccatatgaatatactctaacttgtccagtttcctgctgatgaatatttggcttactttttgttttactctggccccttttcttctttgaccaaatttactgtttctttgccccttgctcgctgcttttgctagtgataccctctgcctggaacagtcttccctcagatacctgtgtggggaactccctcactgagcccaacgctgcacacaagatttcacatctccatcccctgctctgctggtagcactccccccacactgcataaagtatttctctagcgtgttttttggcttctcctgacccctgaccccaggtcctgagatcaggaatctgctttgttcacttatgtattcccagagttccgaataatgtctggcacataatagatttgttgcataattgttgtaatgaacactggtgtacatctatcttttcacaattgtgtgagccaaacgaattcttaggaaataagtatacatttaaatttttgaaggatgactaaatttgctctaaagtaagtttgtaacaatttacatttccaaagtgtactcttctctccaccccctaaaactgtcctggttatgttgccagtttttgtaatgtgtttcctgtctgagaaattgtatctcatttgaatttgcctttccttgattgccgatgtgagtatctgtgctggtgttgatgccggttggtgtattctctcaggttgcagggacttggctcttgcttttttattgacttaacacatatacttatttttagatgttgactatcacgttgcagatgatttcacctggtttgactttcattttttcacatttttcttggtgcttttttccaaagcaatttttaagcagcatgtagtcatgtttggcagccttttcctaaattgtctcaagtgcctgccagttttttagaaagtatttgaacctttgaagaacccctggaagcgtagacgtttttatgctaataaatactttagtaattcctacttaagggaacttcaccttttgtactctgctatattaaatttctttgaggtagaaatgggggtggtgtcagggttagaatgctgtaattctaatctctaatcctgtatgcgaaacatttagtgctggattacaacatctgagatgaatcgaaatacttcgagcttttatcccttccttcttgggcctcattaatcacttctcttcctccagtttctccttgatgcctaccagtttgttcattctgccctatctacaagaacctcttgcctcctgccagcctctactagcttcttgccttcaccagcctttcttctagtcagacacttactggtagctgttatctgccctccccatgatcctgttcactcaggcttcctgtcatccacctgcaattgctctctcatgggcttggccaacagttcagttctcagatgtgggccccacctgtggggtttgtgtgattggcaattctacttctgaaacttcccttccttggctgctgaaccactgtgtttgcttttctatctgctgttttttaccaccttccttcctgatccctgaaggtcagtattccttagtattattttgatcacattatttctgtggcttctgatttgcccttccaggtatcttatttcttgttgtgaaccacatttacccacaggagtcctcttttgaccactgatggactcctgtccttccagctcccctgtctctttaaatggtcccacaattcttgaaatcatccagactgagaaatgtgtaaattattttttactcatcacttctgactcctctgctcacttttaaatagcttactaactgtttccgaactcttctctcctccaaagtgtaagctccatctttatgaggccagcataggacaaaagatgaggttagcatggatggatagtagaccaggaaaggggccgtaagatgaggacaggtgagcaagttcatgcttcttattgctcagtttctcccagagataagatggttcctcccatttaggaataaggatttatgaaaagactgaaggtcgagttacagagtaaaggatgtagagaggagggccttttctggagttctgaattagtgcagacattgtactaagaccaaatctctgaccattcaaggccctttttaggtcacattaaggctttccattcttaaaaaccagaaagcaaatccagtgcacagtttgaggtcgggatattttctgctcacgttgctcttgttctctcttccctgaatggctcaggtactgaggtgagaccaaacaaaactgtggcctgcctggtgcctgtgagaatgcccaccatgcaatgagcatttgagtgctagggttttaattgattgactgatgaatgcattcgtatttcaacttcagcccagttctttctcccctcaagccccatcccccacactactgcctgcttgataggtccgattgtgggatttcactgctgactgctggctgcctgttgaatgaaatacagatccccaggtcgctagcctggtgttgatggaactctccactttgtaattccaatttttgtttccttatccaactggatgtcttagattccaaccttttgaatttcttattctcaaaatgcaccccatgtgtcctctctgtgcctttgacgaggttttgtttttttttctttctttcttcctttttttccatctggggtacttctcccttctctctgcttttaagactcctgcctgttctccagggtcttctcatgcctgtagcttctctgtggcaattacccttcttgaggctgattgtggtgtgatttccattttagctgttgtgctggggctatcgttagtcttcctgctgctttgtacattgagggtagtggtgcattattgctaatgttatttttattctgtacagaggatcctcaaaattcaagtataaatacctttctagcagttttgtaaattttttttttttttttttttttttgagacggagtcttgctccgtcacccaggctgaagtgcagtggtctcagctcactgcaagctccgcctcccgggttcacgccattctcctgcctcagcctccccagcagctgggactacaggcgtccactgccacgcttagctaatttttttgtatttttagtagagacagggtttcaccatgttagccaggatggtctccatctcctgaccttgtgatccacctgcctcggcgtcccaaagtgctgggattacagacgtgagccaccacacccggccgcagttttataaatttatttgacagtaactttcgtcatcagtttgattattgacatttgtatgatttccaatatatttcttacaagatgagctagaattggctacaataacatacgcagtttgctaaaattgatcctggttttgtcattctctcagattctggatgaaattgaagaacataacatcaaaatctatcacttacctgatgcagaatcagatgaagatgaagattttaaagagcagactagacttctcaaggtaagaactggcttcagatccacaacataaataactcctgtttactgttgtccatgttgaggtgagagagattgcctgggtatgttcagttacgagagtatttttgctttcaatatattttaagacctcatgcagtggctcatgcctataatcccagcactttgagaggccaaggcagatggatcagttgaggccaggagttccagaccatcctggccaacatggtgaaatctcatctccatcaaaaatacaaaaattaggtggatgtggtggtgcacacctgtagtcccagccactcgggaggctaaggcaggagaatcacttgaacccaggaggcagaggttgcagtgagccgagatcgcgcctctgcactctagcctggcgacagagcaagactctgtctcaaaaaaaaaaaaaatttgatacagctatcacctaaagcttagaaattttattgtaggtttaatttgttttcgtacaatttgtcccatgtagaaagtatctgacacttttcaagaaaatgttacatacccccagctttccaattcagttttgtagtcaacagcaatgtgttaagtctgtgctaatgttctcgtgttgccagtgaactctggggttccctgtgtggagcctgtctactctgtgtgtctctttctaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatgtaagacatttggtgtgttccttctggcagaatttggcgtgaagaatatggatttcagacggggtgtacacttggcccccaagatagttgcagccagcagcttcattgccgccctcagtgtttctcacatcgcagaagtggtgtggggctgttgcagattggtgctgagaaccctcacccaggggccctctgtggcactactaaactagcgcttctgcctgtggcctgtagcctgcagtacctttccttcttgctaagatcttacatctttgatgttaaaaggagaaaaggagactagaacctaaactggggtctgagaggtccccagtgctggtaaggaaacagtcaggctgtataggcccctggtccactgctccaggctgagccacccctggtgccctgctcaccagtctgagactcattgtatggccctggttagctttttgtgtcttccatttattattaatagcaattacagacctgactacaaaaatagtcttctttaaaaatgaatttcatggctgggcgtggtggctcacacctgtaatcccagcactttgggaggctgaggcaggcagatcacgaggtcaggagttcaagaccagcctgaccaacatggtgaaaccccatctgtacttaaagtgcaaaaaataaattagccaagcgtggtggtgcgcacctgtaatcccagctactcaggaggctgaggcaggagaatcactgttgaaccaggaggcagaggttgcagtgagccaagattgcaccactgcactccagcctgggcgacagagcgagactctgtctcaaaaaaataataaattaaataaataaatttcacatattgtaacatgcatacattgcttttactcttgaaaaaagaggctgaggccgggtgcggtggctcatgcctgtactcctggcattttgggaggcccaggcgggcggatcacttgaggtcaggagtttgaaaccagcctggctgacatggtgaaaccagcctggccgacatggtgaaaccagcctggccaacatggtgaaaccctgtctctactaaaaatacaaaaaaattagccgagtgtggtggtgggtgccggtattctcagctacttgggaggctgaggcaggagaatcgcctgaacctggaggtggaggttgcagtgagccgggattgcgccactgcactccagcctgggcaacaagagcaagacttcatctcaaaaaaaaaaaccaaaaagaacaggctgagagtattgcttaaactatacctctttaatcagaggacttcaaagaatgactgatgtggataaatcagtgttttgattagctgaaagtcgctacatatttgccgcatgtctcacttagtttagcaatttgtagtgagttaaaataagtaagcatgttaccatccaagctgtgtcaaacacaatttaatggttgtgtaagaagttaagcgcactcagcccctccagggctgcatccttgtggctatcctgatccccattattgaggggggtgtagaggctgaagacagggtttggggactttactttagtgtcagttgtgtgtttctcacaatgaggtagagtgagccactccttggctatctcaatccatttccctggatcctgaatcaataggaacgtgttacaatgtttgctcattcttgcctgcttttaagtattttgaataagctaggcaattaaaaaaaattttttaagagtgcttcataagatgaatggaaggttaagttgctgactaatattcttggatccagaatattagtccttcactttatggtcttgtacatagcttaagctaaccaactcttttttctcatatgagagtaatatataaattttgagttataggaggcatgaatattttcattacattttccgtaagtccttttagaagagtgtcttctatttcagacattgttgacctgaaaatctcttaaaatctgtctgccatcctgtggtagtgatggcctcacacaggggtggcagtgcctctagcagaaatccccctgagagactcagtcgagacctgtgtttgtatatcatttattggggaagaaagggagagctacacctcactagacatttccacggccatactcattatcctgaaatcccagcagctttatgtacaatttaccaagtaattttaattactgctatttcttctatgtacttgatgggtggttttttttctcatgagaatgtcatgtgcatgatgccaccttggtgcattcctcttctctttcagcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaaaaaaaaaaaaattaatttagccgggcatggtggcacacacctataatcccagctactcgggaggctgagttgggaggagcagttgagcctgggaggtgcagtgagccataattgcaccactgcactttatcctgggcaataaaacaagaccctgtctcaaaaaacaaacaaaaactttagatggaaaggccagaggcttgtgtcgagttctccttcaaaagcatcactctgtacgtgaggacaaacttgttgccattaggaaactgcagcacctgagttaagggtgaggccaggatgagtggcatccaagcagccagtggccgttgaagcagcagcttcgatcctcgcaaagtcctgcagccatcctcactcaccttttctttttaaccattctaatatgtttttatataagttttctgggaggccaaggcaagtggatcacttgaacccagtagtttgagaccggccctggcaacatagggagacctcgcctctataaaaattttttttaaattagccagatgtggtggtgcatgcctgtggtcccagctactagggggaggattccttgagcccagtaggtccaggctgcagtgagctatggtcgcaccaccacgctccagactgggcaacagagtgagaccctgtctcaacaacaaaagtttcctgtgttgtaattcattaaaattctcacattctaataatttgatggatttctagatacatatgttgtacacattgaagtctaattatgagtttggaaatgagacattaagaaagattttagaggcagcaagaaaattccaccctctggaagctgagtaggcgctggccctgagatggagattagtgtgctttgcagagcacagttctcaggtgtgcttggggagcttaccctttgcccctcgttcactcacgcagatcctgctccttaaatgtggtgactacattcgcattaataaagaataacatctcaaagcaaattcttcagataatacctatttttgagtgggtaacagcaagtgttgtcgctcaagcttagagtaagaaaagtctcttgaatgttccatttcatgttgttcgaactttttaaaatcattctgttccctttttattcattatatctttaattagaaaaatgataggctgggcgtggtggctcatgcctgtattcccagcactttgggaggccaaggtgggcggatcacttgaggttcaacaccagcctggccaacgtggcaaaaccccatctctactaaacacaaaaaaaattagctgggcgtggtagcacgtgcctgtaatgccagttacccaggaggctaaggtgggagaattgcttgaacctaggaggtggaggttgcagtgagccaagatcatgccactacactccagcccgtgcgacagagtgagacaccatctcaatataaaaagagaaatgataaatacatgtcattttaaattttaaagtagaattttttgggggggtagcaaataactatttgttgcagtgttatgattctgatttctttcgattcttaggaaagtggagaatgaggacatgaataaagaccagatcttgctggaaaaagaagctgaggtaagtaggaaagtactattggttggttggttggttggttgttttgtttgttttgagacagagttttgcaccattgcccaggctggagtgcagtggcgtgatctcggctcactgcaacctctgcctcccgggttcaagtgattctcctgcctcagcctcccgagtagctgggactacaggtgcccgccaccatgcctggctagttgtttttgtatttttagtagagacggggtttcatcatgttggccaggctggtctcgaactcctaacctcaggtgatctgcccaccttggcctcccaaagtgctgggattacaggtgtgagccaccgtgcccagccaaaaagtactattcttgtgactgaaggtgttttgtttacatccgtagatatcattggtaattaacttaaagtttatagttttttttttaatttgttgaggaggatacatataactactttattactatatatacacatctatatataataataaacatggatatttacatagcatacatgatgcttcatatatttagctgaaagactttggagacaatttagtaatgtcactgatatttgtaagtagatcataaatatggaaatatgctctgttgtaaaggtggcattcagatctgctggagttttggaaggcaaacacattattcagtaaacaataggatcataatgggctagccttttggaaacaaaaagaaaatacttctttggtcaaattaattcaatattgatcaaatatttaaatgttaaaaataaccacaaagtcacctgaagaaaatttaaatgttttataatactttcctggaggcatttctgaacacatacaaatcataatgataaggataaagatgaattaacatttactatttttggccaggcactgtgggttacacttatagtcccagcactttaggaggccaaggtgggagaatcacttcatgccaggagtttaagaccagctagggcaacagagtgagacccccctcgttctctagaaaaaaattaaaaaataattagccatgcatgtcggcatgcacctgtagtcccagctactcgggaggctgaggcagaaggatcccctgagcccaggagttcaaggatgcagtgagctatgattgtgccactgcagtctagcctaggtgaaagagcaagatcccatccctttaaaaaaaaaaaaatatatatatatgtatatgtatgtatatatattatttttattgtgaggccttcattgccctccagaaaagctgattcattcccattcccctttactttgcatttctcactgtcatcagtctctttccctccttttaggttagaaaacttctcatattggccgggcgcggtggctcacgcttgtaatcccagcactttgggaggcggaggcgggtggatcacgaggtcaggagtttgagaccagcctgaccaatgtggtgaaaccccgtctctactgaaaatacaaaaatcagctgggcgtggtggtgtgtgcctgtaatcccagctactcaggaggctgaggcaggagaatcgcttgaacccgggaggcggaggtagcagtgagccgagattgcgccactgcactccagcctaggagacagagtgagactctgtcttaagaaaatttatcatattgtcttatctttctttggttattgtttctgtttggcttgcatattcgtatcatttacttgattttctctttagctgttgctttttttattgattggtaaaaagtctttatgtaataactcctgtcatattttgggaaggtgtagaagttgaaattttaggaatcacagaacacccagaaataatgttcaaagacagcaaaccttgaaaacctataatgtgtgtgtgtgttcacagctccgccgcatgcaagagatgattgcaaggatgcaggcgcagatgcagatgcagatgcagggcggggatggcgatggcggggctctcgggcaccacgtgtaaggtgatgtgcacatatcaagaagtcagaggtaggccctgttgtcccttagcctggaagacaggcagttactaacattgtgtcagcttaaatatgacaggttcctccttaagcctcattaatattttgcattttgaagtaactccatcactaatcttaaacaaggagagattgctcctgaaaaacagaagccactactttgccacctactttctagtaaagatttttcatatttttgtctcttcttttttttttaaataatttcaacttttattttattggggtacatttgcaggttattttctaagcttgcaaataccaacattagaaggaaattatgtattaaagcacttttattagttgtattattggaaatttgttaattgttaaaacatctctttaaagggaataaaaacgtgttattaaaacagcttgtacagattaaaagtagagatggcacaaggaagaagaattatgtgaggtagataagggttccctggatggtgactgctgacctcctgttcctcagatagctttgtcccgactgatggtcattagtgaatagatctgtctggcatggtgtatgctggtctgcctgcttgaaaagaatctgcagactccagagactcaggaccaggaaaaggcagatgcccactcccctgtatcttatgtatcttatggacaggcaggctctctgaactgtccaggtggccactcccatcacttgccagaggaaaagcatgaaaggtaaagttaagtaatgacctaagagtccaaagaagagggtaggtcacatggagctggggtaaaggcaaacaaacctcatacaagagatctgattagagcttgaaagagagtttgagttggccaagatctgaggatgaaacgctgggaatttggtagaaggtctctactacaattcagggacctcattctggaagcatgagtgtgttcatgaaaacagggaggggacttgagccttcaacgacatacggcagggtgggttaggcagaaggcagggagtcttgaggcctccacagcatgtggacaggtggctgaggaaggacccagagtgacttgctggagccttagtcaccaaacgctcttgcagcttagtgggaaaggtgttcattgtaaaatacggtatttacacaaaatgcacaaaaatacgtatgtacagtttaataagttactgtaaggaaaacatccatgtcacccccaactgagtccaagttggttgctttagtttcatcatcacagtgacaccttagaatagtcctgagggtatgtgcttagttcacactttactgatgaggaaattgttgccgctccgagagtttaaaagtatttgctgatggtgccatgacttttaaacgatggcctgctgactctagaggctggtcctgcataaccagttaatggcatgtgactggggaagtgagggtacagtggaaagagacaaggatgcctcagcgatgcagctcatttgaagcaggaagcagtgacaggtgtttgcttattttctctgagcttcattttcaacctttatggaatgaaaattttacttttagatcgataaaattttatttctgtatactttctagttttgcagcatttccagtttccaggagcctcatgaatggctttttggtttagttaactttgtggtcatgtaagccctgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaa

SEQ ID NO: 35586 - DNA, 3845 bp, Homo sapiens
ctttccggacctggccgagcaggaggcgccatcatggtgagctcgctttgcggcgttcggggctggataatccgctgccatccgccgtggttttgggctaggggcacgctggagggcggcagggggtctgcggctgcccggagggagcaattcccgatactggggacctactctgggggccaggaaagcagggatgggtcagtcatagcctaccgcccccacttagtagatgaccaagtggaggtactcggaggctgatatgactgggtttacaaagccaggaagtggcagagccaggattccgacccaggtggctggacccgcagccactcttagttatttggctttgctgcctttatctggacctgtcactttctagtatgaaaagtcgggttcgatgggggccgcggcgggtgagaggatcgagagccgaataactggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacagtaagtgctgcataagtggagctattaaatagttcttgtaattgtcaacacagtctgaaaaacttaagttgctcagaaaggcagcagggcggtaggagcctggcgaggcggctcacgcttgttatcctagcactttgggaggccgaggcgggaggattccttgcccaggagatcaagaccagcctggccaatattgtgagaccctgtctccactttaaaaacgatgttttaaaaagacactatttggtaagggttgttggattgactgatgctgtaggagaggtggttctagtagtattgctaggttctgaataaggattcgttttcatcattactgccattggtttgatatttttggttatccctccgggtatgggaaccagttttgataacattgttgcaaaatacaagttgtaaagaattgacctttttgtattaagttaatatgattgctgtgttacgatgtttcagggttctgtgtgccatgggctgaaggctttgtaaacagcccctttttacagagggatcagtggcagcccacaggtctcctggtggtgggcctgggatttgagctggtgtgttcagacctgggcttgtgtcccagctctcagtttcagaaataagtaataattggctatggttgggggtaattgggtccatggttgcctcttcacccccacagggagtggacatccgccataacaaggaccgaaaggttcggcgcaaggagcccaagagccaggatatctacctgaggctgttggtcaaggtgaggctgggccctgaggtctttgggaagggtcaccccaggtctgacttgcagatcctccattctagtgctggcaccaagctcctcccaggggcctgcagagcagtctcgggtctctggttctgttccagggtctcctgcatttgtattttcagcctctaggctgtgtacagctcgggagtggagccaggattttctaggtccttggccaggaaggacctgggccagctttctccctctaggtcggtgggttgggggaaagggataaagattattttagtccagatcatcatgtgtttgccccttcactggaaggctgcgggggagcaggctgtcccagcttctcactgtcttcccgtccctccagttatacaggtttctggccagaagaaccaactccacattcaaccaggttgtgttgaagaggttgtttatgagtcgcaccaaccggccgcctctgtccctttcccggatggtgagtggctggtccagagagcacggtagacctgggagccgctgggtcttgtctgtctggaagggaggcaggacttggagctctgggagcaaccagggcatcaagggtttgtctcagccagtcgcgagcgtagagcttggactgttggttggaactgagtgtccatgggcagtgggcaagtctcctggtcctcctctccttctctttgtgaggtggaggtgtcctggtggcttcaggagattgccccaagtcataactgagttttatgtcaaaggctctgctgagggaggccctattgaacagtctgcatttttttttttatctggagctttccccagctggacctgaggagaggcctgtggggtttaaggggtgtggtgtgagtggggggtcccgttagagggcacagctgccctggcctggggatgcctcaagcggggctgaatgtaaacaccagaacaacttacgacgtacatcctccccaccctaagatccggaagatgaagcttcctggccgggaaaacaagacggccgtggttgtggggaccataactgatgatgtgcgggttcaggaggtacccaaactgaaggtgagctggcgggggctgggcagacccatcagacccttgctgtactgtgctgtgctgtgctgtgctgtgctgtgctgtgctggtccatcctcagtcttgccaccgctggtgaggcaagcatcctgcctgtctgagtggctttgaggattggtgtgggtcgtctctggcatggttgatggtggggtcccctgggcaagcttcttctggggcaagttgtaaactgttagtgctggcccctagagccagacagcctgggctcaagtctagactcctttgtcacctctgcacaggtctttttttggcccagcttccttgctgtagtttctagcataacaccagggatgtggtggtgaaagttccggaagtgttgagaactgctgctgtcagcccagggtgctccgggtagtaaacgatagtgttggttaccagggctctgctgcgccaaggcagtggagggtgagtcctggcagcccctgggtgaccacgcaggggtctgacccgccagccttgtcctctccaccaggtatgtgcactgcgcgtgaccagccgggcccgcagccgcatcctcagggcagggggcaagatcctcactttcgaccagctggccctggactcccctaagggctgtggcactgtcctgctctccggtgagtgatacgtggtcgacgggtttggactgagctgtgtggctactggcagccttcaccctcctggatctgggaggccagaagctgggcgccagatccctgtctcacccggttctccttccccttccctaggtcctcgcaagggccgagaggtgtaccggcatttcggcaaggccccaggaaccccgcacagccacaccaagtgagtatcaggcccccagccctgccctctccccagactcagcctgcagggccaggcctggccacacttgggctgcttctcctatccctcgtaccagccagccccaggccttctggaactctcagctgcctcatcctgcctgcttttcccttcaacactgcttggagctgtgttttccagggcctgagcaggcatctcctggggagcatgcagttcaccggcctttgccagcccaggctgggaccctccaggtggtggggcaggtgcttccatagcccctcctggctccttggcttcccactctgccaagcttttccagcagcattgactctcctggggctgaatgtgacaggcttgtggtgttcctgtgccactccacaatggcctcctttaagagggcccccctctcactccctcctctccccacagaccctacgtccgctccaagggccggaagttcgagcgtgccagaggccgacgggccagccgaggctacaaaaactaaccctggatcctactctcttattaaaaagatttttgctgac

SEQ ID NO: 35587 - DNA, 7524 bp, Homo sapiens
accagggcggcgcgtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttcttagggacacgatgccctcttttgctctgtgtaactttccccccgtaatagcagcccctagagccttcatactgtcggtcaagaatcgaaacctttgggttgattgtgccacacggtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggcggacattattccaggaaggcacacatcaaacttgttgctgtgccattaagtcaagaatagagatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttgtagtaaaatacataacatccagtgtcattcttttgcatgtgaatatccagttatccagtaccatctcctaaagagatgttttttttccctcaattgaatggccttggccacttgtcataaatcagctggccgtagttttttttttttttttttttttttgagacggagtctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttcattacagactttcagttatattccactggtctatatgtctgtctctatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaatcattaaagttttatctttgagataagatcactctctgtcacccaggctggagtgcagtggtgtgatcacagttcactgcagcctcaatacacctgggctcaggggatcttcctgtcttagactccaactagctgggaccaaagatgcatgccaccaaacctgctaccttttgttttataaagaatgaaaacttttttgttgtctgtaaagatgtcaggggacttaggcactatgcctaatggataattcagccttgtttttcactctgaatatcttgtagatcttggcttttctttccttcaggggtttatttcggggggtccaaaaacattttaaatattattattattttttgtttgtttatttatttatttatttttttgaaacggagtttcgctcttattgcccaggctggagtgcaatggcacgatcttagctcaccacaacctccgcctcccgggttcaagcaatgctcccgcctcagcctcccaagtagctgagattacaggcgcacaccaccacgcctggctaatttttgtatttttagtagagacggggtttcaccatgttggttaggctggtctcgaactcctgacctcatgatctgcccggccacattttaattatttatttattttttgagacagagtttcgttcttgtcgcccagtctggagtgcaatggtgcgatcttggctcactgcaacctctgcctcctgggttcaagcgattctcctgtctcagcctcccaagtagcggggattacaggcacatgccaccgcacccagctaatttttttatttttagttgagacagggtttcatcatattggtcaggctggtctcttaactcctgacttcaggtgatcagcctgcctcagcctcccaaagtgctgggattacaggcatgagccaccacgcctggcgttatttatttatttgtgagacagagtctctctctgcctcccaggctggagtgcagtggtgcgatctcggctcactgcaacctctgcctccccagggtcatgcgactttcctgcctcagcctcccgaagtgctggggttataggcatgagccactgcgcccagcccacaaacattttcattataggcccagataatgttttagactttgtgggccacactggccactgttactttttttttttttttttttttttttttttgagatggagtcgctctgtcacccaggctggagtgcagtggcacgatctcggctcactgcaacctccacctcctaggttcaggtgattttcctgcctcagcctccctagtagctggaactacaggtgcatgccaccacacctggctaatttttgtctttttagtagagacagggtttcaccatgttggccaggctggccttgaactccttgatctattaaacgtttgttaagtgcctgttccactagggaaataaacatcaatgggagttcactgtattttaaacacctgtgcagggctccactgttgggccaaacccttcctggggaatttggtgtttgcaattttttgctgcatagtgaaagccctgcgtgaatgcccttcacgagactgtgagttttttttttcttgcagccagactatgaaatagtactgagagtttcagtgtcctgtgttcttttcccatcattccttgtatttgtagaaacaggtattttgtgtatattctcagaggcaagtgatagaatggccttgggtacattttgtaatggaactatcaacagcagtctccttcgaatgcacatagctcctttcttcccctttacatactcaaggttaactttttggcatttttctagatttttgtgtggggatggctatgtaagtataagaagacttgttaaatgattgttttaaaactgtggttctgggccgggcgccgtaatcccagcactttgggagactgaggcgggcagatcatctgaggtcaggggtttgagaccagcctggccaacatggtgaagccccgtctctactaaaaatacaaaaattagccttgcatggtggcgtgcacctgttgtcccagctacttaggaggctgatgcaggagaatcgcttgaacctgggaggtggaggttgggatgagctgaaatcatgccattgcactccagcctggccaacaagagcgaaactccatctcaaaaaaaaaaaaaaaaaaaactgggctgagcatggtgacgcatgtctgtaatcccagcaacttgggaggctgaggcaggagaattgcttcaacccaggaggtggaggttgcagtgagccaagattgcaacgttgcactccagcctgggtgacagagtgagactccatctcaaaaacaaacaaacaaaaaacccaaaaacaaaaaagttctcagccaggtgcagtggcttatgcctgtaatcccatcactttgggaggctgaggcggacggatcacctgaggtcaagagttcaagaccagcctggccaacatgtccaaaccccagctctactaaaaatacaaaaattagcctggcatggtggcatgcacctgtagtcccagctactcaggaagctgaggcaggagaattgcttgaacctgggaggcggaggtttcagtgagccaagattgcaccactgccctccagcctggaaggcagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcatgcctgtaatcccaacactttgggaggccaagacaggcggatcacaaggccaggagttcaagaccagcctggccaacatagtgaaacctgtctctactaaaaatacaaaaaaactagctaggcttggtggcaggcccctataatcctagctactcgggaggttgaggcaggagaaccatttgaacctcggagtcgtaggttgcagtgagctaagatggcaccactgcacaccagcctgggtgacagtgagagactcaaaaaaaaaaaaactgaaggggttgccagtggcataccagatggctgttaaacatcctatagtgtgcaggacagccccccagacaattatctggtccaaaatctagtctccttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaagcaaatatattgccttgttttttagaaataattgagatggaatctcagggtgttcttgaattcctggtctcaaatgatcctgtcccctcagcctcccaaagtgctaggattacaggcatgagccaccacacctggccgccttttttgttgtcgtcggtttttttgtttgtagaggtggggtttcaccaagttgctcaggctggtctcaaactccctgccaaagtgttcctcctgcctcagcatcccgaagtgttacaggcgcaagccaccgtgcccggccgtctagcagtttgctgttgaggcaggtctcaatctcctgtcactggggacgcaacttcagcctgtgtgtgtgtgtgtctggacacttgctcttgtgaccctctatctgattgcaaatcaggcatgatgccaccacctcttgtctcagtgggcctatgggtgacaacgtggctggcagcatcagttgggagtggccccagggtgctggaggaccgcagtctgtccttctagcctgacccctgctgtcttcctaggccatctggctgctgtgcacaggcgctcgtgaggctgccttccggaacattaagaccattgctgagtgcctggcagatgagctcatcaatgctgccaaggtgggtgagggcactccggttggggggtcttaagttgggcatttgtgggggtccttcagaattcagagctgtgtgtctccttgcagggctcctcgaactcctatgccattaagaagaaggacgagctggagcgtgtggccaagtccaaccgctgattttcccagctgctgcccaataaacctgtctgccctttggggcagtcccagccacc

SEQ ID NO: 35588 - DNA, 8087 bp, Homo sapiens
cgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtccaaatgagccttgtccgcctcctgcctggggcagcaccgtagggggaagcggccgcggggcagcgcgggggtcgccgttcgcccttcccgctcgcctctcccccggcccgtgctcgccgtggctggagagcaagctgcagggtcgcggatgccgctggaggtcgtggagggatctctggtggaatagctcgccgttcgcgcgccccgccccgcaggccagggcccgggctttgtaaagggatcacggattcgggaaaacttctaaaacagccggagtggggctctgatttcacttccctcctttgatgagggaggcttggcgagatgctaaaggttccagggatttggaaactctagattcctaaccccgctctaaggagtgcttgtgattttgcaaacagcgtcggccctcaggccggaaaaagcccaggaactttcaaaactgtggttggtggtggttagcagctgcggcgctgacctggtcactccactccggccaaataagagcccgcaccctgttttcctagcatcatttgctcccggggaacgcggaatgttcgtagggtgtccgacctacctggggtggacgtattgatagggcaaggggagcatctgaggaagggcaggcaggaagcaccgcgaggcgttgatggctgaagagtcgactctgacagctcatccctagtatctcctcatttgcctcaaaaccggaactgggcatttttacccctaagccggagaaggctatgcctcgcttatttagtaaccgtgccattgtggtttttcaacagttgctatgggtcaagtgccatggtgtgtatttagctttttttctttccttcttatttttttagattgataaattaggggtttcaccatgttgctcaggctggtctggaactcctgagctcaggtgattctcccgtctcagcggatcaaattgttaggattacaggcgtgagcaacccgcccagcctgtatttagtatttttaacaatttatgaggtgtaggtactattttttttttttttttgagacaggtcttcactcttgttgcccaggctggagtgctgtggtgcgatcccggcccaccgcaacctccgccacctgagttcaagcgattctcccgcttcagcttcccagtagctgggattacaggcgcccgccatcatgcctggctgatttttctatgttcagcagatacggggtttctccatgttggccaggtttgtcttgaactcctaacctcaagtgatccacccacctcagcctcccaaaatgctgaggttacaggcctgagccaccacgccaggccgggatcaatggatttgaactccctcttctgtttttcgaatgcaaacttactatatgatacgctacattgtcatcttccctcattcctttcataatagaaaaactatcttttggtgtcactagatgtgaagattcaagcaaagcatttcatgtagtatcttatttaaccattacaataaccctgtgagataggcatactgttcacattagagatgtaaaaacttgattaaacacttacccagagatgactactagtaatttgcagaatagtgatttgaatgcaggctaattttatttatttattgtatttattgagatggagtctggctctgtcgtgcaggctggagtgtagcggcacagtctcagctcactgcaaccttcgcctcctgggttcaagagattctcgtgcctcagcctcctgagtagctgggattacagctgcgcgatgccatgcccagctaatttttatctttttagtagagacgaggggtttcaccaggttgcccagactggtctcaagctgctaacctcaagtgatccacctcccaaagtgctgggattacaggcatgtgccacagcgcctggcctgaatgctggccagtttttattcagagttgttctgacctcctagcagttctgcctctcccagtctgcattttacgtagtcaaggttgcactggatatggtcattgttgcttttagttctaaaatcttacaagtgattatgtgcctgtgacactgaacaatgccttcattagcacattcagctcctcttgtccacccaagctccaaggtcacactttctaccatccaatactggagaatcaacgtggcattcctgactctcctagagtcctaggaaagacttaaagtaattttattgaatatttatctcttttggcaaaattgtatccaaagaatgttttttgacaaaaatagttctccaaaccatgctgaaaaggtacacttagagttccaaggccaggcgcagtggcttatgcctgtaatcctagcactttgggagactgaggggaaggatcgcctgagcccaggagttcaagaccaggctggccagcagagggagacctgtctctacaaaaaatccaaaaattagctgggtgcagtggtacacgcctgtggccctagctattcaggaggctgaggtgggaggattgcttgcgcccaagagttagaagctgctgtgagttatgctccagccactgcactcagccttggtgacagagcaagaccccgtttcaaaaaaaaaaaaagttccacattcatcacaaaacactcatttgcatttttcttttgtcctttgagccttatttatttatttttttaaaagaccgggtctcactatattacccaggctggcctgacctgggctcaaacatcatgcccagctactttatttaccctcaaatactctcctatctaactggctactttttttttcctgttttttgggacagggtctctgtcacccaggctggagtacagtagtgtgatcttggctctgcactcccatctcagcctctcaagtagctgggactacaggcgtgcaacaccatgcctggctaaccgcctactttttatttccatagactttatggcactaggctttgtagaaaaatattaaggggttagtgtgtggtgtgcttttcgagaaaatgctcacgaagattagaaaaacactgatggtttattggcaaaatcaataatctgtcagcagttgattcttttttttctctgaattagccctcttatgagtaatctgtttgctcattcattataatttcatacctctaaaactgcgtgtgacagctgtaaaggttaattccagtatcatgaaacgtctccaaaccaaagcagaagtgcttcaggatcctgatttgtgtgtttttttcttcactctaggtttcccttttatgcttactactcatgcccctcacttggaaagtcacttggcctcctgaacagcactaactccaaacgttttttttgttgttgttgttttttttagagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggtatgttcctttcaaacagaatgagatgatacatgtaaaatacttaacacagagtctgtcttccaagaaatgatagctgttattcttcagtgcatgggacacgggggctttcttttcaatagcctgtgtgaagccttgccctggattgccaatgaggaaagtatcctgcaaatgaaattgcgctgggagtgcagccttggaagaacataaccatatttcttgtaaaggagttttctagtggtgagaaggaaagatgatgggaaaacttgagctacaattctaaagatgcttcttttggaatatacttggcatcagacatggtagaaaggcattcaaggagccagatttgaacaacttacccagccttggatcctgaagaagatcagattttgtggtggttttagaattaaatattttttaaaaccccgtaacttaagagtcttagagattttattggaaagtatagactatttctgtctagtgtttataagtgatgaaatgctaaactgggaggtttatctatcttcaaaatattaacacactggaaagacctggggccttctgcatattgcatgggagttttagggccctggtggaatgaaataaatcgaggagcctggcacctttttaagatgtgaatgtcacacaatcacagcatactcccatgtgcttaagagtgatactctcagtatctgcctatcttgtgtccctttgtaattttttaaccccagaactctattccctccttcaggatgtcatacattatctttttttctctccatgctgctctgaaatcctgcttagaaaactattaggaaatggctgcagtcctgagctgtgagcggtaaacacagcctttgagagcaggagcacatttccctttcatgacatcaggtagggttgtatgactcccgactagttttagcatctgagtcttaccttcccccccactgtattgaagaatgttggtgatcttttaagaggtactctgtatagtttgtcattcatacctacaagaaaacaaactttagattttttgttgttgtgttgttaccttcagctactctttggttatttcatgtctggtttcaaaattcccatgtcctgtgaaaccctgtcaagcaataaataattggtactgttaaatttcataatggaaaaaattggaactcaaagtattaggagtttggcattgattttaaaggacaaagaaagaggctatgaattctcaaagatactaaacctgtaatgggatggacttcttgctctgttgaaaaggcctggtctctggaagatgaacttaaaaccagcttctcaaggtggttcatttaccacacatacttcagtgctcttttctgatttcatgtcccttatcaaggtttatgatttggggaccctcaggatttaagtgatcatggagaaaggaccataggtattgctggctcttaacagggcagttaacatagctgaaggatgtgggctttcttatgttctccatgcctaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgaggtgggtccttgccttctgttgaggagcttgtactcaaatcactccacttgaacctgacctagcagaggtagcaagaggccatgccatttggtaacctcacagtaccataagagatctatcttaggtggacaaagccatggaatttgctatgcctaagtccttcagggtcatagctgaaagaagtatgcattcatggtacgtttgttttttaatatgctttattctgcatattagtatcacattacacagtttggtcatggtatttgtaacctggagagaatactagtgcagtcggtcttcataccaccccattcacaaccagcttaaatggcagtatccctctgtgaactcaactacccctcctgtgggtccaggctgagctctacaggtcagcctcttcatctcagcccttctaggtcctgctgtcagggctgagctgtcacttcacttttttcccagagtagtgcagcatcctctctgaaacctgagctatcatgacattttcttttttaattttataatttttatatttctctaatttttgattttagagacagtctcattatattgccgaggctgaccttgaactcctgggcccaagcagtcctcccacctcagcctctccagtagttgggactgcaggcatgcaccactgtgccaggctaaaccgtaacattttcttgtggttgattatgtcacccttcagactcagtagttcttgatgtctttccttgtaggaaagcagctgctgttttggatctcagtttgattgaggtggtgactatccctttggtaccattgagaccagaaaccagaccagttggacattgtttttttctggttatcctgtcctgccttactatgagatttacggatgtttggggacacaggtctctgggctcatttctttttctgaggattcatataattgcctagtttttggcttagaggttggtccttccctggtttaatgatgcttttgttcagactgtcctctaggacttgaatttgaagcagaaacagaacagcacctgatcctcagttatactgcaaagcagggcctcagaaagggtaactccaattactgactttcacctaaggtgaaaaagcatccggcttctttccccttggcatctttggatcttctgagaatggtggctgaaggcagagggcctggggacaagccagcctggacatgactcctctgctgcttattaattccttacctgaactactcttgggacctcgattccttcatgggcaaaatggtcacataatagcaccatcacaagacttgccaggaatctagagcaagaggataacgtctaaagcatctagctcaggtcctcacatctggaaggtattaaatacaggctagctccttccatagatgcccatccaaagatgcatacatgaggtggcaggggattaaactatatgacccctgagatcctttccagttcttagctttgaggggggtcaatggcagtaattcagatatattgtttatcatagttaattgagtatcaacatgtcaaattggcatttattgtgttaccttgggcaaatgatataacttaagtcttaattttcttcattcttgaaatgggatagtaagagtacctacctcataatgttatgaaggtttaatgagatagcctcatgccaggcacagagtacacagtaagtgctcaatacttaactattattgttagatgttggtttgcttattcttctggctctgatttttttcccctttactctttttgtttttgtttgcatttcagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattg

SEQ ID NO: 35589 - DNA, 83016 bp, Homo sapiens
agaaaaaaaaaaagagagagagagagagggaaaggccttcttgctccaatgggtagatttcctacactgtggaaatgccaacattgagaggttcatttggattaaacaattataaaccactcattttttagcatgagactcttccagataactgattgaaatctgcacaaaggaaatgggatttttttgtgtgtgtaggggactggggaaaggtgattttggaacatgggactttgtcgtaattctagagcactagaaggaaagttttgagggttgtgaacagcaagaaggcagggaacacaggacctgaaatgcctacttcaatatttgccttagtggtggtcctgccttccctattatcagaagtctatcaagttctaatcctcgctatccagtctagcctgtaatgataagagaggcaagtgggaagatggtcagccagtttttttttcttttcttttctttttttttttctctagttttcatttaatgtatttctgtgtgggctgggcgcagtggttcacacctggaggccgaggcaggtggatcacttgaggtcaggaattctagaccagcctggccaacatggtgaaacgccgtctctactacaaataaaaaaattaaccaggtgcggtggcacatgcttgtaattccagctactcaggtggctgaggcatgagaatcacttgaacttggtagacagaggttgtagtgggctgagattgcaccactgtactccagcctgagtgacagagactctgtcacacaaaataaataaataaatacataaatacataaacaaacaaaattggttcagacagtagaaactgggataggagagaagtagggcaaaggccaggctcggtggctcacgcctgttaccccagcattttgggaggctgaggtgagaggatcacttgagcccacgagtttgagaccagcctggataacataatgagaccccatctgttaaaaaagttttaaaattaggtaggtgtggtggcacacacctgtagtctcagctacttgggacactgaggcaggaggatcacttgagcccaggaggttgagtttgcagtaagctgcgtttgcaccacggcactccagcctggaagacaaagtgagaccctgtctctcaaaaaaaggcacaaaaaggaaactgcttccaccatttccattcttctttcataaaaaaatttgactttgaggtaacataagaaagaatctggctgggcgcggtggctcacgcctgtaatcccagcactttgggaggccgaggcgggcggatcacgaggtcaggagatcaagaccatcttggctaacatggtgaaaccccacctctagtaaaaacaataaaaaaaaatttagccgggaatggtggcgggcgcctgtagtcccagctacttgggaggctgaggcgggagaatggcgtgaacctgggaggcagagcttgcagtgagccaagatcacgccactgcactccagcctgggcgacagagtgagactccatctcaaaaaaaaaaaaagaaagaaagaatcttagggaggcttgccagaattaattgaacactacaaacagaggttactttaggggtaattatgctgctgggactatgaaaagaaatcactacgaaaacaatctcttgtacactatttctcctcctccttctcttctgctcctcctccttcttcttccttctttctcctttattctttcttttttcttcttttcttcttttttttttgatacaaggtcttattatattgcccaggatgatctcaaacttctaggctcaagcgatcctcctgcctcagcatcacaagcagctgggattacagggtgtaccactacacccagctcctctagttcttttagaaagctatttccaacatacattttccttattgttacaacaaacaaggaaagattagccaggcatcatggcacatgcctgttgttccagctacttgggaagctaaggcaggaggatcatttgagactaggagttccaggctgcagtgacctatgactgtaccactgcacttcagcctgagtgatagatagagcgagatcccgtttctaaaaaaaatagtagtgctcactttggcaacatacctactaaaattggaatgatacagagaagattagcatgtcccttgcgcaaggatgacctgcaaattcgttaagtgttctatttaagaggtagagatagagaaatcagggtagaaagtttattcaaagggataataacagagaacttcccaaacctagagaaagatatcaatattccaatgtaagaaggttatagaacaccaagcagatttaacccaagtaaggctacctcaagacattcaataatcaaactcccaaaggtcaagtataaagaaaggatcctaaagcagaagaaaagaaacaatatacaaaggagctcaaatatgtctggcagatgacttctcagtgggaatctgataggccaagagagagtggcatgacatatttaaagtgctgaaggaaaaaacttttattctagaatagtatatccagtgaagttatccttcaaaggagaaataaagagtttccaggccaggtgcggtggctcacgcctgtaatcccagcactttgggaggccgaggcaggtggattgtctgaggtcaggagttcgagaccagcctagccaacatggtgaaaccccccgtctctactaaaactacaaaaattagctgggtgtggtggcaggcacctgtaatcccagctagtcaggaggctgaggcaggagaatcgcttgaactcgggaggcggaggttgtagtgagctgagatcacactattgcactccagcctgggcaacagggcaagactccatctaaaaaaaaaaaaaaaaagtttcccagaaaaacaaaagctgagggatttcatcaataccagacctgtcctacaagaaatgctagtgggaatactacaatctgaaagaaaaggacattaatgggcagtaagaaatcatctgaagatacaaaactcactggtaatagtaagtacacagaaaaccacagaatattataacgctgtaattgtggtgtataaactactcgtatcttgagtagaaagactaaaagatgaacctactaaaaataactacaaattttcaagacaaagacaatataataagatataatagaaatgacaaaaagttaaaaaacaggagagataaagtgcagagtttttattagttttccctttcctgtttgttagtttgtgtgtttacgcaaccagtgttaagtgtcatcagtttaaagtaacaggttataagatgttatttgcaagcattattgtaacctcaaatcaaaaaaacctacaacaagccaggcacgttggctcacacctataatcccagcactttgggaggttgaggcaggtggattgcttgagctcaggagttcaagtccaggctaggcaacatgaaaaaaccctgtgtctgctgggcatggtggcttacgcctgtaaccctagtactttgggaggccaaggcaggcaggtcacctgaggtcaggagtttgagaccagcctgaccaacatggtgaaaccccgtctctactaaaaaaatacaaaaattagccaggcatggtggtgcattcctgtaatcccagctacttaggaggctgaggcaggagaatcgcttgaacctgggaggcagaggttgcagtgagctgaaattgtgccattgcattctggcctgggcaacaaaagcgaaactccatctcaaaaataaaaaaaaaaaaaaaagaaaaagaaaaaaccctgtctctacaaaaatacaaaaattgactgggcatggtggtgtgcacttctagtcccagctactcaggaggctgaggtgggaggatctcttgagcctgggaggcagaagtcacagtgagcccagattgcaccactgtaatccaacctgggcaacatagcaagaccctgtctcaaaagataaaataaaccaaaacagataaacaaaaataaaatgcaagaaattaaaacataccactggagaaaatcaccttcacaaaaaggaaaacaggaaggaaggaaagaaggaagagaagaccacaaaacaaccagaaaacgaataacaaaatggcaggaaaagttcttatttatcaataataacattgcatgtaaatggactaaatgctccaatttaaaagacatagagtggctgggcatggtggctcatgcctgtaatcccagcactttgggaaggccgagttgggtggatcacttgaggccaggagttcgagacaagccttgccaacatggtgaaaccctgtcttcactaaaaatacaacaattagctggaaatcgcttgaacccaggaggtggaggctgcagtgagctgagatcacgccactgcactccagcctgggcgaggagcaagtctccatctcaaaaaataaaataaaataaaataaaataaaagacatagagtggctgaaaggatttaaaaaataaataaataagatccaacaatctgttgcctacaataaacacacttcacctataaagacacacatagactgaaaataaagagatggaaaaagatatttcatgttaatgggcaccaaaaaagagcaggaatggttatatttacattagacaaaatagatttcaagacaaaaactatagaaagagatgaaggtcattatataatgataaaggggtcaattcagcaagaggacataacaattataaatatatatgcacccaatactggagtacccagatatataaagcaaataatattagagtttaagagagaggcagaccccacaacattaactggagacttcaataacccactttcagcattggacaggtcatccagacagaaaatcaacaaagaaacttcggacttactctgcactatagaccaaatggatctaatagatatttacagaacttctattcaacagctgcagaatacacattcatctactcagcacgtggctcattctcaagaatagacaatatgacaggccacaaaacaagtttttaaaaattaaaaaaattttggccagtcattgtggctcttgcttgtaattcccagcactttgggaggccagggtgggcagattgtttgagctcagtagtttgagaccagcctgggcaacatgtcaaaaccgcatttcttcaaaaagtacaaaaattagctgggtgtggtggcatgcacctgtagtccaagctactcaggaggctgaggtgggaggatggcttgaccccaagaggcagaggttgttgcagtgagccaagattgcaccactgcactctagcgtaggtgacagagtgagaccctgtctcaaaagaaaaaaaaagtccaaaaaattcaagccagcagtgagctataatggtgcccctgcactccagcctgagcaacaaagcgagaccctgtctcttaaaaatatgtatgttctggctgggcacggtagctcatgcctgtaatcccagcactttgggaggccaaggtgggtggatcacttgaggtcaggagtttgagaccagcttggccaacatggtgaaaccccatctctactaaaaatacaaaaattagctgggcacggtggtgggcacctgtaatcccagctactcaggaggctgaggtaggagacttgcttgaatccaggaagcagaggttgcagtgagccaagatcacaccattgcactccagcctgggcaacaagagtgaaactccaaaaaaaaaaaaaaaaaaaagttatacacacacacacacacacacacacacacacacacacacacacacacatgttccaactgtcctatacattaaataaataaattttttaattaattaaaaacactgaaattatatcaagtgttttttctgaccacaatggaataaaactagaaattagtaacgaggaattttggaaactatacaaacacagggtaattaaacaatatgctcctgaatgaccagtgggtcaatgaataaattaagaatttaaatttcttgaaacaaatgaaaatggaaacacaacaaaacctatgagatacagtgaaagcagtactaagaaaaaagttcataggccaggcgcggtggctcacgcctgtaatcccagcactttgggaggccgaggccggtggatcacgaggtcaggagttcaagaccagcctggccaagatggtgaaaccctgtctctactaaaaatacaaaaaattagccaggcgcggtggcaggtacctgtaatctcagctacttggaaggctgaggcaggagaattgcttgaacttgaaaggcggaggttgcaatgagccgagatcatgccactgcactccagcctgggtgacaaagtaagactccatccccccaaaaaagaaaaaagaaagaaaaaagttgataccaaagagtgcctacatcaaaaaaaagtagaggccggtcacctgtaatcccagcactttaggaggcccaggtgggcagatcacttgaagtcaggagttcgagaccagtgtggccaacatggtgaaaccccgtctccactaaaaatacaaaaaattagctgggcgtggtggcaagtgcccgtaatcccagacactcggcaggctgaggcaggagaatcgcttgaacccgggaggtggaggttgcagtgatccaagatcgcgccattgcactccagcctgggcagcaagagtgaaactccatctcaaaaaaaaaaaagtagaaaaaattaaaataaaaagcctaatgaagcatcttaaagaacgagaaaagcaagagcaaaccatacccagaattagtagaggaaaagaaataataaatatcagaacaaataaatgaaattgaaatgaaaaagaatacaaaagatcaacaaaacaaaaagtcattttttaaaaagataaacaaaattgacaaacctttagacagactaagaaaaagagaagaccaaaataaataaaatcagcggtggaaaaagagacattggctgggcgtggtggctcacgcctgtaatcccagcactttgggaggccgaggcaggtagatcacaaggtcaggagtttgagaccagcctgaccaacatggtgaaaccccgtctctactaaaaatacaaaaattagccaggcatggtggtacacacctgtaatcctagctactcaggaggctgaggcaggagaatcacttgaacctgggaggcagaggttgcaatgagtcaagattgtgccactgcactccagcctgggcaacagagcaagattccatctcaaaaaaaaaaaaaaaagagagagagagagagacattacaaccaataccacagaaattcaaaggatcattaaggctgctatgagccaataaattggaaaacctagaagaaatagataaattcctagatacatacaatctaccaagatttaaccatgaagaaatccaaaacctgaacagaccaataacaagtaatgagatcaacaccatgatgaaaagtctcccagcaaagcagtctgggcacagtggctcactcctgtaatcccagcactttgggaggccaaggcaggtggatcacttgaggtcaggagttccagaccagcctggccaacatgaagaaaccccatctctacgaaaaatacaaaaattagctgggcatggtggtgggcacctctaattccagctactcgggaggctgaagcaggagaatcacttgaaccaggaggcagaggttgcagtgagccaagatcatgccactgcactccagcctgggtgacagagtgagactccatctcaaaaaaagaaaaaagtctcctaccaaggcaaagcccaggacctaatggtctcattgctgtattttaccaaacatttaaaggagaactaataccaatcctactcaaactattctgaaaaatagaggaggagagagtacaactaaactcattctatgaggccagtattaccctgataacaaaaacaggcaaagacctatcaaaaaaagaaaactaaaggctaagatctctgatgaacattgatgcaaaaaccctcatgaaaatactagcaaactgaatttaacaacacattaaaaagattattcatggccaggcatgaaaattgcttgaacccaggaggcagaggttgcagtgagctgagatcatgccattgaactccagcatgggggacagagctagacaccatctcaaaaaaataaataaataaaataaatgaagaagacacacaaaaaatggaaagatatcccatgttcatggattggaagaatcaatattgttaaaatacccatactactcagagtaatctacagattcagtgcagtccctatcaaaataccagtgacattcttcacagaaatagaaaaaataattgtaaaagttatatggaaccacaaaagacacagaatagtcaaagccgtcctcagcaaaaagaataaaactggaagactcatattacctgacttcaaattatatgacagagctatagtaaccaaaacagcaatgacacttgcataaaaacaaacatatagaccaatggaacagaatagagaacccagaaacaaattcatacacctgcaggaaactcacttttaacaaaggtgccaagaatacacattgcggaaaaaacagtctcttcagtcagtggtgctgggaaaactggatatccatatgcagaagaatgaaactacaccccatctctcgccatatgcaaaaatcaaatcaaaatgtattaaagacttaaatctgagacctcaaagtatgaaaatattacaagaaaacattggggaaactctccagaacactggactgggcaaagatttcttgagtaataccccacaaacatgggcaaccaaaacaaaaattgacaaatgggatcatataaaattaaaaagcttctgcacagcaaaagaaacaatcagccaagtgaagagacaacccacagaatgggagaaaatacttgcaaactatccatctaacaaaggattaacatctattatataagcagctcaaacaactcaacaggaaaaaaatgtaacaatcagattttaaaatgggcaaaagattggaatagatatttccttccttcccttcccttccttccttccttctttttctttctttctttttttctttctttcttttcttttcttttcttttcttttcttttcttttcttttcttctttctttcttttgagatgtagtcttgctctgtcgcccaggctggagtgcagtggcgcaatctggagtgcagtggtgtgatctcgcctcactgcaagctccacctcccaggttcacaccattctcctgtcccagcctctggagtagctgggactacaggcacatgccaccacacctggctaatttttgtattttttgtagagacaggattttgccatgttggccaggctggtctcgaactcctaacctcaggtgatccacctgcctcggcctcccaaagtgctgggattacaggcatgagccaccacacctggcctgtatgtctcaggaggctgaggcaggagagtcgtttgaacctgggaggcagaggttgcagtgagccaagatcacaccactgcactccagcctgggtgacagagggagactgtgttccacccctaccaaaaaaaaaaaagtcatacaaatggcaaacaggtatatgaaaaggtgctcaacatcattgatcatcagagaaatgcaaatcaaaactacagtgagatatctcaccccagttaaaatggcttatatctgaaagacaggcaacaatgaatcctggcaaggatgtagagaaaagggaaccctcatatactgttgatgggaatgtaaattagtacaatcactatggagcatagttcggaggttttcaaaaaactaaatataaaactaccatatgatcccaacaatcccactgctagacatatacccaaaagaaaggaaatcattatatcaaggaggtatctgctctctcatatttattgcagcactattcacaatggccaagatttggaagcaacttaagtgtccatcaacagatgaatggataaagaaaatgaggtgtatatacacaatggagtacaacttagccataaaaaaggaatgagatggctgggcgccgtaactcacacctgtaatcccagcactttggaaggccaaggtgggaggagggcttgagcccaggagtttgtggccaacctaggcaacatagtgagactcggtctctacaaaaaaaaaaattttttttaatttagccaggcgcagtggtgcatgcctgtagtccctgctacttgagaggctgaggcaggagaaacacttgagccctggtgactgaggtggcaatgagccatgattgtgccactatactcactcaacctgggcaacagaacgaaaccctgtcttaaaaaaaaaaaaaaaggaatgtgatcctgtcatgtgcaacaacatggatgatggaattggagacactatgttaagtgaaataagccaagtatagatagacaaacttcgcatgttctcacttatttgtgggagctaaaaatgaaaacaattgaactcatggagacagagtagaatgatggttactggaggctggaaagcgtagtgggtgggtgggagggaagtggggatgcttaattagtacaaaaatatagttagattaaatgattaaatgaataagatctagtatatgatagcacaacagggtgaatacagtcaacaataacttattgtatattttaaaataactaggccaggtgcaatggctcacacctgtaattccagcactttgggaggccaaggtgggtggatcatctgaggtcaggagttcgagaccagcctagccaacatggtgaaaccctgtctctactaaaaatacaaaaattagtcgggcatagtggcaggcgcctgtaatcccagctatttgggggactgagacagggagaattgcttgaacccaggaggcggaggttgcagtgagctgaaatcatgccattgcactccaaactggtcaacagaacaagactccatctcaaaataaactaaaataactaagagagtataattgtgtctgtaacagaaaggataaatgcagctgggcacagtggctcacgcctgtaattgcaacactttaggagactgaggcaggaggatcacttgagcccaggagtttgagaccagcctgggcaacgtagggagaccctgtttttagaaaaaagaattttttttaaattagctggactaattggcacatggtggcacatgcttgtggtcccggctacttgagaggctgaggtgggaggattgcttgagctcaggaggtcaaggccacaggaagccatgatttcaccactgcactccagccttggcaacaggacaagaccctgtctcaaaaaaaaaccaaaaaaggtttcaacttaaagtgtgcttgaggtgatgcataccccacttaccctgatgtgattattacaggttctatgcctgtatcaaagtatctcatgtaccccataaatatgtatacctacaacgtagccacaaagattaaaaataaaaacaaaaaattaactgtaatcccagcactttgagaggctgaggtgggcagatcgcttgaggccacgagttcaagaccagcctgagcaacatggcgaaaccccatgtctacaaaaaagacaaaaattagctgagtgtggtggtgtgcccctgtagtcccagctactagggagagtgaggtgggaggatcactggagcccgggaggtcgaggctgcagtgagctgagattgttccactgcactccaggctgagtgaatttttaattttaattttttcataagttattggggtacaggtggtatttggttacatgagtaagccctttagtggtgatttgtgagattttggtgcacccatcacccaagcagtatacactgctccctatttgtagtcttctatccctcgccccctcccaccctttcctgactttttatttttaatttaaaaaaaaatttaatattaaaaaagtgaaaaaaaaaggaaggacaccatgtttattgatgaatatttcttaatctatcccttcactgtctaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtaagcttccaaatctaaatcttattttcgtatattaaggataagaaagttatattctcttaccatcaacaaagagcttagtctggatagagacagataattgttagagcgattcctggaacaggtttgtacttcctagatctttataattcctgctaattgcttgtatatagttttgttttttgtttttgttttgttttgttttgagacggagtttcgctcttgttgccaaggctggagtgcaatggcacaatctcggctcaccacaacctccatctcctgcgttcaagtaattctcctgcctcagcctcccgagtagcatgtgccaccaagcccagctaattttgtaattttagtagagacggggtttctccatgttggtcaggctggtctgaaactcctgacctcaagtgatcctcctgcctcggcctcccaaagtgctgggattacaggcgtgagccactgtgcctggcctgttttttgtttttttgtggttttttttttttttttttttttttttgagacagtcttgctctgttgcccaggctggagtgcagtggtgtgatcttggctcactgcaagctcctcctcccaggttcacaccattctcctgcctcattctcccaagtagctgggactacaggtgcctgccaccatgcccggctaattttttgtatttttagtagagacagggtttcactgtgttagccaggatggtctcgatctcctgacctcgtgatctgcccgcctcagcctcccaaagtgctgggattacaggtgtgagccaccatgcctggcttgttttttgtttttgagacagagtctcactctgtcacccaggctggagtgcagtggcacaatctccactcactgcagcgttcaggtaattctccctgcctcagcctcccgagtagctgggattacaggcgtgcaccaccatgcccggctaatttttgtatttttagtagagacggggtttcgccacgttgtccaggctggtctcaaactcctaacctcaagtgatccacccgccttggcctcccaaagtgctaggattacagacgtgagctaccacgcccggctgcttttatatactattaacattagaaactattagtacttgcaggtgagtagtctggaaaaaaaaagaaaagaaactgtagcacacacactcccttcaactccccatatcaggaacacaggatatgaacaccatagtaactagagagggattcatttctgatccactccacctgacatagatattataagtccattaacaatttttatttaattatttatttattttgagacagagtttcactctgttgcttaggctggagtgcagtagcatgatctcgcctcactgcaacctccacctcccaagtacaagtgattctcctgcctcagcctcctgagtacctgagattacaggcatgcgccaccatgcctggctactttttgtatttttagtagagatggagtttcgttatgttgaccaggctggtctcaaactcctaacctcaggtaatctgcccgtcttggtctcccaaagtgctgggattacaggtatgagccaccgcgtccagccgatataagtccatttaaatatattcacagttaggataaaacataattctaacttttgataaggtgtaagagtatgaatagtttctacagatattcttgggctaaaagctaaatggctctgttgtttttagaattcaaaaaacaaattatcacttatatgggtcgagtaagtttcactgcctctgattttgagactttttttttcttttcctgttttattttttcctttattttggctttggttctctgattccatgtgaagtagaggaaggagcactttactagaaggtggaagacctggatgttatttcatgctaatttaatattataagttcttttccccaaacttcatgtcattttaccagagccaaaattagaaatttcaaagtatttttatacctaatatctaagcaatatggaagatgtggtaagtgtaaactttgctacatgctgagtccctcagagtcagaaacagggctaacattaggttatatcttctagaatatctagttacgttttgagtgcctggttcattttggagaggagtattgtggacgattttagactaattagaagttaggcagactgttgattcgtagttgtcatttatttgcatgtaatctcttcgggattatactgaagtctatatgtaagtaaaagtcataatttgtctttgccaaaaatgaggaaaacattttctcattataggtgtttgaaaaactccaactcttctatccagagtgccaaccagagcagattctgatgcctataaattctcagctcaaactccataccaacaggtaaggaaaagggagaataaggaagtgccaggatctaagcttaagtattttcagtaaaacattgacatagaaagaacacttttgccttctaggagatttttcccaaataattttttgtgtgaggtgaaattcccataatgtaaaactattgtaaagtgtaaaattcagtggcatttagtacattcacaatattgtgtattcagcatctctatctagttccaaatatttttatcaccaccaaaggagatcccatacctgtgaagcagtcactcttctttctttcctcctcgcagcccctggcaatcactaatctgctttctgtgtacggtattagctatcctgaatgtatttcatataaatggaatcatacagtatgcaacgttttgtgttttttgtttttttttttttgttttttttttttttttgagacagtctcgctctgttgcccaggccagcgcacagtggcacaatctcagctcactgcaacctccacctcccaggttcaggcaattctcctgcctcagcctcctgagtagctgggattacaggtgcctgccaccacacctggctaatttttgtatttttagtagagatggggtttcaccatgttggccaggctggtcttgaactcctgacctcaggcgatcctcccggctcggcctcccaaagtgctgggattataggtgtgagccaccacgcccagccttgtgttggcttctttaagttagcataatgtttttgaggttcatccatgttgtagcatgtatcagtacttcttcctttttatgactgaatagtattccattatatggaaataccacatttagtttataatttcatctcctaatagaaatttggggctgggcacagtggctcatgcctgtaatcccaggcctctgggaggccaatgcaggtggatcacctgaggttgggagttcgagaccagtctgatcaacatggagaaaccccaactctactaaaaatactaaattagccaggggtggttgcacatgcctgtaatcccagctactcaggaggctgaggcaggggaatcacttgaacccgggaggcggaggctgcagtgagccaagatcacgccattgaactccagcctgggcaacaaaagcgaaactccgtctcaaaaaagaaaagaaatttgggttgttttcaccttttggctattgtgaatagtgctgctatgaatattcatttgcaagtatttacctgaatacctgctttcaattgttttggctgaataattatttttttgaaacggagttttgctcttgtcccccaggctgcagtgcaaatggtgtcatctcggctcactgcaacctcagcctcccaggttcaagccattctcctgcctcagcctcccgagaagctgggattacaggcacccgccatcatgcccagctaaaaattttttttttttttgtatttttagtaaagacggggtttcaccatgttggccaagctggtcttgaactcctgacctcaggtgatcctcccgccttggcctcccacagtgctgggattacagacatgagccaccacacccggcctaaataattctttaattataaatatgtaataagatttgattttaaagaaataagcataatccaaaggcagacttttacctgaggaacaaataattacacacgtggagaatggcaagcagttttctcgagtacatcccctaacagtaatcctggaaatttttactcttttctctctggtcagacaggaccccaaaaagatgccacttcctttccttgttccctagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtgagttcatggacttactaaaaaaaacaaataaataaaagtcataccctggccttaaaaagcagagtttcttttttaaaaaactagaaattttcttatcatgccattaaagaaaaaaagaaaaagaaaagaattagaaacttctgtatcatgagagaacatgaaccagaaaaaaaaaaaaaaaaaggagaagaagaagaagaagaaactctctgggagtcagaaatgaacctataagaggccagtcttgacatggttataagccataaaattaaaatgaactttagagcccttgttataaaacagatcagcctggccgggcacggtggctcacgcctgtaatcccagcactttgggaggctgaggcaggcggatcacgaggtcaggagatcgagaccatcctggctaacacggtgaaaccccttctctactaaaaatacaaaaaattagctgggcgaggtggcgggcgcctgtagtcccagctactcaggaggctgaggcaggagaatgccgtgaaccccggggggcggagcctgcagtgagccaagatcacgccactgcactccaacctgggcgacagcaagactccatctcaaaaaaaaaaaaaaaaaaaaaaaaacagatcagcctaaatttatatgattgtcttcctagcagctttggcaaaaggactggtatcggaggagtgtagaatgattgctatcaaaattggctgggctgggtgactcacgcctgtaagcccagcactttggaaggctgaggcaggagaatcacttgaggccaagagtttaagaccagcctgagcaacataatgagacccctatctctacaaaaaatgaaaaaaaaaaaaaaatagccgggcttggtggcacatgtctgcagtcctagctgcttgggaggctgaggtggaggatcacacgaacctaggagttcgaggctgctttgtgctgcaattgaactgctgcactgcagcctggaaaacaaagcaacaatctgtttctttttaaaaaattaagctttgctacaagaattaaaaaattgagaaaagacctcagagataagttagtcttaacacgaaaaaaaattttagacattaaacatctactatatactatgttcgtcattgtatgtatattatctcttttaactaccacaaaagccctatgaggtaggcattattatccccatctaactgttaactgataagaaacctgagacccagaaaagttacatgaggctatgaaatgataaagctatgattcaaacgcgggcttcacttactgtatcacagctctcttacagtgtgaaaacacaatatagattgtgttcctgataagtaattgattatttaaccataaatattgagcactctgcatgaaatggatgaattatagtcctttcctcataaagctccagcttctcttcacattcccacagctttaaaaattaaaaacctggctgggcacagtggctcacgccaatcccagcactttgggaggccgagccgggtggatcacgaggtcaggagttcaagaccaacctggccaagatggtgaaacccccatctctactaaaaatacaaaaaaattagccgggcattgtggcgggcgcctgtaatctcagctactcaggaggctgaggcagagaattgcttgaacccaggaggcggaggttgcagtaagttgagattgcaccactgcactccagcctgggcgagacagcaaaattccgtctcaaaaaaaaaaaaattaaaaacccatttcaagccgggcacagtggctcacgcctataattccaacactttgggaggccaaggcgggcagatcacttgaggtcaggagtttgagaccagcctggccaacatggtgaaaccccatctctactaagaatagaaaaattaaccaggcgtggtggcagatgcctgtaatcacagctacctgggaggctgaggtaggagaattgcttgaatgcaggaggcagaggttgcagtgagtcaaaatcatgccgctgcactccagcctgggtgacagagtgagattctgtctcaaaaaaaaaagaaaagaatttcctatgctgctatgctgtcatatttcttttcactctgacttaagtcatctcacatcaaaagctatttcctatggaaaagaaacatcactctttatcattgattataagtctcagaatatggttgcagcacttctccagtgcatctttctctgtaccagtaggttttgtctcccacaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacaggtatggaagtcaaaggaatggtattgacactatggtagaaatcttgcatattaggctagtattatatagcagctccagtaaattcctctcacattctgaatttggaagttgatctttcttttgttaaaaaaaatttttttaagtgaggccaggtgggtggctcacacctgtaacctcagcactttgggaggctgaggagggaggatcacttgggcccaggagttcgagaccagcctggacaacatggtgaaaccccatctctacaaaaatacaaaaattagctgggtgtggtagcgtgtgcctgtagtcccagctactagggaggctgaggtgggaggatcacttgagcccaggaggcagaggttgcagtgagcagagattgcgccactgcaccccagcctgggtgaccaattaagactgtcttaaaaaaaaaaaaaaaaaaaaaagaccagacttaggcaatggtattagttgtcacttaagaaaaaatgcaggatatcttaaatctgtcaagttctaattcactaaaagatccatagggagctaactggagtattattatcaaaaggctttactggaaaaaaaaaaaagccttcctgggaactatacgtatgaaggtaatagactgatccttggcccatacttacttactctttattgtggaattccttctgaacttctgagctgttgaatataaaatgtggtagggtgttctccagaactattttctaactattgtctctttttaaagatttctacctttaatgtctacttgcagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtatgtatacattccctttctcaaacttacaattgatagttgtggggattaaaaagcagttattaaaaaaaaaagcagttattaatcccttggactggtatagtggtttatacccataatctcagccctttgggaggccaagctggagaggtcacttaaggccagaagttcaagaaagcaattaatcccctagaatatttttttccaaattatctaaaatctgagggactctctgagaaagaaaataattttgagtattttattatttgtaatgttactgataatttttagcttaatgcctgtttcactcaatagccagccaattagaagccagccagtaatattgatcaagagtctattggatacatagctctattttatattatgtagatagtgcagggtactgtgtcttctcctccattcccagcttttgaaggagggtaattactatattgaaggacagtaaaggataacaggaaggaaagggcaataaggctttagttctaagaactagttatgtgtatgctattttgtgaggcacatttgaaggcctaagtcctaacatatcatcattgtaataaggttttttcttttacccggataaactatactttgttttgtttttttttttagagacagagtctcactctgtcattcaggctggagggcagtgggcagtgacatgatctctgctcactgcaacctctgactcctgggttcaagcgagtctcctgccttagcctcccaagtagctgggactacaggcacacaacaccacgcctggctaatttttatattttttatacaaggggttggcccctggccaactatactcttgaaaacaaagcatttctgtcctaagtactgagttaaaaataaaatcataagccaggtgcggtggcccatgcctgtaatcccagcactttgggaggctgaggtggcgggatcacgaggtcaagagatcgagaccatcctggccaacatggtgaaaccccatctctactaaaaatacaaaaattagctgtgcatggtggcacacgcctgtagtcccagatactcgggaggctgaggcaggagaatcgcttgaacctgggagttggaggttgcagtgagccgagatcgtgccactgcactccagcctggcaacagagtgagactccatctcaaaaaataaataaataaaataaaatcatagaaaacatttgggaggccgaggcaggcagaccacctgaagtcaggagttcaagaccagcctggccaacatggtgaaatcctgtttctattaaaaatacaaaaattaaggccgggtgtagtgactcacgcctgtaaccccagcactttgggaggctgaagcaggcggatcacaaggtcaggagttcaagaccatcctggccagcatggtgaaaccccgtctctactaaaaatacaaaaattagctgggcatggtggcatgtgcctgtagtcccagctacttgggaggccaaggcaggagaattgcttgaacccaggaggcacaggttgcagtgagccaagatcacaccactgcactccagcctgggtgatggagcgagactctgtctcaaaaataataataatagtaataattaaattatcccggtgtagtggcatatgcctctggtcccaactattgggaggctgaggtgggaagattgcatgagcccaggagatcaaggctgcagtaagctatgatcgcactactgcactccagcctggatgacaggctgtgtctcaaaaaaaagaaaaggaaatcattctttggttaggaaatgagtgtgaattctttgggtttccaaatatcatatcccaaagtggtgtacactgcctggatgtgtacatccaagtaagaactgcttgtagtaatgtatggttttggctttgcagcctcttctggtaactatggatacatatgtttaggtaaagtgatgtaaatgttggacctgactttaacattaatacgtattttggaccttgatacaaaggggctctatacagctgaatcccccaatgctataacagctgatttgcaaacaaccactaccaacatgcaatccaggaccaatgagctaaacctactttaaggttggcaatgagagttacaatcccctgattataaatcccttgtcaatgaagcagagtattttttaccctctctttttttgtttgtttgtttgtttttttgagacagagtttcactcttatcacccaggctggagtgcaatggtgtgatctcggctcacttcaacctccaccttctgggttcaagtggttctactgcctcagcctctcaagtagctggaactagaggcatgcgccaccacgcctggctaatttttgtatttttagtaggatggggtttcaccatgttggtcaggctggtctcgaactcctgacctcaggtgatcctccagcctcggcctctcaaagtgctgggattacagacatgagccaccgtgcccggcctattttttattctttttagctatatttttgacaggattgtcccatagtcttccaatctggaattttgggaggcttcatcatgtgatgaaggaaagagccatatgccaggatcagtaatcctgcaggctaagtacaaactctaacccagtatttggcattcctcggccatctttagacttaagccaaaataaacaaatcctttctcttgccatggtcacttttttgcagtcttcttgctgtcatcaatcagtagctcaaagcaaatttgtccttagtagcttctaaacaaaatttattcagaaagttatccctgtatgtaaaaagagcttctctttttcccaaggagaacagttacattctccaactacgtagctcttcttatgattctttattttgctggcatgatatacgaagaggaacctgacactgagaaaacagttatcttcaaagctggctgtttctcctgggaagagatatctgcatgcttgaaaaatttactgatttggagtatgaataagtccagagtgatttatatcaaaggcttcagccaagtgttttctcttgtcttttcctaggtgaacctgggatatggatgatttctgccaacaatattctacagacagacattgtcactggagtaggagtggccaggagtccggggactgcaatgatttttcatgacatcccaggagtagtgaaaacatatcgagaggtaaacataactgtatcagagtttaagagactagggtgactattgccacatatgaggatatgcatagagaaaatacatcttaggaaaggaaatacactcataaaacagatataaagccagccagcaaactttactggaacacaaagctaaacagtgttcaggattcttaaccagcagaatgactacctgtgttttaagagatcacagtgggtactggttggcactagacactagacaccagggtagaagttgaaagaccatttgggagtctactgcggtaatccaggtgacatatgttggcagatcagggtggtgacagaggaggtgataagaagttgatcagattctaggtatattttataggtagagccaatagagtttcctcacagattatatctagaacataagaaaatccagaatgattcaggtttttggttgaacagctgaaaggacagcattaccgtcaactgaaatggggaagactgtaggtggaacagtcttggagggaaaagcagtcatctttggatatgtaaaattgggtatgtctattaaatgtcaactggatatgttgaggttgctggatataaaagtctgggagtcattggaatagagatatttaaggccattagatcaccaaagaatgaatgtaaaatagaaaaaaggccaggcgcggtggctcacatctgtaattccagcactttgggaagccaaagtgggaggatcacctgaggtcaggagttcgagaacagcctggccaacatggtgaaaccccatcactactaaaaatacaaaaattagccgggcctggtggctcacatctgtagtcccagctactcaggaggctgaagcacgagaatctcttgaacctgggaggtggaggttgcagtgaactgacatcaagccactgtactccagcctgggcaacagagtgagagtcgctctcaaaaaaaagaaaaaaaaagagaaaaaagacctaagtactaagttctgggagcacttcaatcttaagagttctgattgccttttgattagtggcaaatggaaaaagaaagaaacaaaagggaaaaagggagctctgagagaagaaccaataagaaagacttataagaaacaaccaggcttagtgccgtggctcacgcctctaatcccagcaccttgggaggccaaggcaggtggatcacaaggtcagaagttcgagacccagcctgaccaacatggtgaaaccccgtctctactaaaaatacaaaaattagctgggcgtggtggcacacacctgtaatcccagctactcaggaggctgaggtaggagaatcgcttgaacccaggaggcagaggttgcagtgagccaagatcacaccactgcactccagccggggcaacagagtaagactctctcaaaaaaaaaaaaaaaaagaaagaaagaaacaaccagtgaaatgggaggaaaatctagagatatgtgtatcctggaaggcaaatgaagaaagtatttcaaggaaagagggagtgatcaaccatcattactattaatgggttaagctgaaaattgagaaatgactgatggtttttgcagtatggagactggtgctagtgactttgttgagtagcttcagcaaagtgacctgagcccccccctttttttttttttgttggagacagaatcttgctctattgcccaggctggagagcaatggtttaatcttggctcactgcaacatctgcctcctgagttcaagcaattctcatgcctcagcctcctgagtagctgggattacaggcacgtgccactacccccagctaatttttgtatttttagtagagacagggtttcaccatgttggccaggctggtctcgaactactggcctcatgtgatctgctcgcctccgcctcccagattgctgggattataggcatgagctgccactgcgcccaggcttttttgtgcgtgtttttttgtttttttttgagatggagtatcgccctgttgcccaggctgaaatgcagtggtgtgatctcagctcactgcaacctctgcttcctgggctcaagctatcctcccactgcagcctccctagtagctgggactacaggtgcatgccgccatgcccagctaatttttttgttttgttttgttttgttttgtatttttgatagagatggcatttcaccatgttgcccatgctggtctcgaactcctgagcccaagtgataggcctgcctcggcctcccaaagtgctgggattacaggcgtgagccactgtgcccagacagagtgacctgaatgaatgtttgattggagaattggagaaaaggacttggagacagtgaatatagaaagctcttttaaggagttggggttaagagtttgttttgtggatttttttttttatgagagaaatagtggattgggaatgattcagtggaaacagaaaatttgatgtaagtcagaggattgctggagggagtaatattcttgagtaggtgagataggtaaacaataaagggatttttttaatgaaatattttctattcccttcttaaatatatgtaatgtctccttcctctttgcccaaagcacttctttgatcctcttttttcattcctcaaacatggtagctacaactttttgtgtatctactatgggcttggcacttctcatcttttttttttcttttaagagacagtgtctcactgttgcccaggctggaatacaatgatgcaatcatggctcactgcagcctcaaactcctggtttcaagccatcctcctgcctcagcctccaaagtagcaggaccacaagtgtgtgccagcatacctggctaattatttttatttttttgcagacacagggtctcgctatgttgtccaggctggtctcaaactcctagattcaggtcatctttctgcctcagcctcccaaagtgctaggattataggcatgagccactgcacctagccatctattttttttatttttatttatttatttatttatttatttatttatttatttatttatttattgagacagggtcttgctgtgtcacccaggctggagtgcagtggtgtgatctcagatcactcagatccacctcctaggctcaagtgatcctcccacctcagtctcctgagtagctgggaccacaggtgcacaccaccacactcggctaattctgtggggtgtgtgtgtgtgtgtgtgtgtgtgtgttttgagacagagtctcactctgttgcccaagctggaatgtagtggcggaatctcagctcactgcaacttttgcctcctggattcaagcaattttcctacctcagcctcccatgtagctgggattacaggcacctgccaccacacccagctaatttttgtattttagtagtgacagggtttcaccatgttggccaggcttgtctcgaactcctgacctcaagtgagctgcccacctcagcctcccaaagtgctgagattacaggcatgagccactgtgcccagccaattttttgtgtttttggatagatggggtttcaccctgttgcccaggctgatctcgaactcctgggctcaagtgttctacctgcctcagcctcccgaagtgctgggattacaggtgtttgccaccacatctagcccagtcttttttttttttttttttaacatccagtacacctatcacttttaattgtatcacttttaactctgcaaaataaatatgtggggcatggagggagggagagcatcaggaagaataactaatggatgctgggcttaatacctgggtgataggttgatctatgcagcaaaccaccatggcacacattaacctatgtaacaaacctgcacatcctgcacatgtaccctggaacttaaaataaaagttgaagaaaaaaaagtattttcccaactttgttttattttatttatttatttttataacagaatctcactctgttgcccaggctggagtgcagtggcacaatctctggtaactgcaacctccaccttccaggttcaagcaattctcgtgcctcagcctcccaagtagctaggactacaggtgtgtgccaccacacccagctaatttttgtatttttagtagaggcagggttttgccatgttggccaggctggtgtcaaactcctggcctgaaatgatctgcctgcctcagcctcccaaagcgctgggattacagatgtgagtcactgcacccggccccaactttatagatgagtaagttactcaatatgtgtgcacatggtatctggtgccttcttttgaggagctcatagtctagtggtgacataaacaattacatacatggcacaaataattacaataggcaaataaaagtacatgttgtgcttgaagactaatgaataaatcagggcaacttcaatacaaaattaataagggtagagagggaaaatttggataacatccaaaaagaacttgtattataagcagataagaggttcaaggacagaggtagcatgaaaagagtactagaaaaagagactgagaagggattaggaaccagaaaagcaaagagaaacagtgtcatagaaggcaaaggaggaaatggttgtggtgttagatgctacagggaagtccaaaggtcattcctattctaatttgtgtacttcatcgaatcctcatttaatattcactaattagcagatactcattaaagcctattaagtgtcaggcattgtgctggcctccagaaatacaaatatgaaaaagacaaaattcctttctttattaagccattaatgtaactaacttgggttttaaggttcttgaatttaaaaaacctgtggtaatactaaggagaatgtagagtatattgcatttaaatttaaaatattaagggctgggcatggtggctcacacctgtaatcccagcacttttagaggccgaggtcagtggatcccttgaggtcaggagttcgagaccagcctggccaacatggtgaaatcccatctctactaaagatacaaaaatcagccaggcatggtggcacgtgcctgtaatcccaactacttgggaggctgaagcaggagaactgctggaacccaggacgcagaggctgcagtgagccgaaattgcgccagtgcactgtagcctgagtgacagagcaagactccgtctcaaaacaaacaaacaaacaaacaaaaaaacttacaatataaggcagaatagtacaagtattcttgagaaaaaacaatgtactttgaagtttcagaaaagattgagattatgtgcaactagagacaaagagaaaatgtcctgaagaaagttgcagttgttttttttgtgtgttttttttgtttttgtttgtttgttttgttttgtttttttgagatggagtctcactctgtcgcccaggctggagtacaatggcacaatctcagctcactgcagactccgcctcccgagttcaagcaattctcctgcctcagcctccctggtagctgggattacaggcacgctccaacatgcctggctaatttttgtatttttagtagaggtgaggtttcgccatgctggccaggctggtctcaaactcctgacctcaagtgatccacccgcctcagcctcccagagtgctgggattacaggcatgagccaccgcacctggcctcaaaggcattttaatagggagtcatacaaagggaagatatgtctgaaggaataattggacccaagacttccttctagaaaaaatgttattttgggctaggcatggtagtttatgcctgtaatctcagcactttgggaggccaaggtggaaggatggcttgcggccaggagttctagaccacctggggcaacatagtgagaccctgtctttttttttttttggagtctcgctctgagccaccgcgcctggccaagaccccgtctttgttttttttttttttttttgattcagagtttcactcttgttgcccaggctggagtgtaatggcgcaatgtcggctcactgcaacctctgcctcccaggttcaagcgattctcctgcgtcagcctcctgagtagctgggatcacaggcatgcaccaccaagcccggctaattttgtgttttttttagtagaggcggggtttctccatgttggtcaggccagtctggaactcctgaccccaggtgagccgcccgcctcggcctcccagtgctgggattacagacgtgagccaccgcgcgcggctgaccccgtcttttgttggttaggcatggtgacacatacgtgtagtcccagcttctctagaggctgaggcaggaggattgcttgagcctaggaatttgaggcttcagtcagccatgatcatgccactgcactccagcctgggtgacagagcaagaccctgattaaaaaaaaaaaaaagttattttgtcttcaaaggcaaacagattttgttgttctcaaatatgtggtcatgagatggaatctgtacttgtgtgaaacagatacttttggttaaataagttatgaggggtggatctggaaggagtcagattctctaggaacttaggtgcagattttcctttgatttgctgacaggtggtggtcaatgcatcatcaagattaatgctcagttatgacctcaagacttatctcaccaataccctcaattcaactgtattcaagctcttcatcaccactggcagaaatggtgtcaatcttaaaggtcaggaatctcttcatggtttcagtgattgttcctatctttctcgttttccctcaattcatttatccctttggattagtaatccagattttctttttatttcaaaactgactccatcttgacaaataaatcatagagctctatgagacctcagaaattatgactagactaaggttttaaaataggctcatcctagtcactattgtctttctagttttaaaaatacaaattttaggccgggcgcggtggcttacacctataatcccagcactttgggaggccaaggcaggcagatcacctgaggtcgggagttcaagaccagcctgaccaggagttcaagaccagcctgaccaacatggtgaaaccccatctctactaaaaatacaaaaactagctgggtgtggtggcgtgtgcctgtatcccagctacttggaggctgaggcaagataattgcttgaacccgggaagcgggggttagagtgagccgagatcgcaccactggactccagcctaggcggcagagtgagactccatctcaaaaaaaaaaaaaaaaaaaaaaaaaaacttaagataattttagtactctggagtggtggctcatgcctgtaatcccaattatttaggaggctgtggtgggaggatcgcttgaggccaggagtttgagaccagcctgggcaacaaagcaagaccccatctctcagaaaaaaaaaaaaaatagagatggccaggcgcggtggctcacacctgtaatcccagcactttgggaagccgaggcggatggatcatgaggtcaggagttcgagaccagcctggctaagatggtgaaaccctgtctctactaaaaatacaaaaattagccgggtgcagtggcgggtgcctgtaatcccagctactcgggaggctgaggcaggagaattgcttgaacccaggagacagaggttgcagtgagctgagattgtgccactgcactctggcctgggcgacaaagcaagactccatctcaaaaaaaaaaaaaaaaaatctagccaccgtgcctggccaacagactgacgttttattccccagaatctttctaaaatcactacttattttattgagaaacctcatgcatcagtccctttgattttgctgaagatttttcaagaatgccactcattgcagctgacccaatgataacaacagtccacttcttgctgtctatatgattcctcttaaggcaccacttgtgatgaagttctagggatttggggcttgaattatattgtaattgtattacaacattgtatatgaaaaacaaattctcttagacctaaaagctacctcccaactgtactgctttatttttatttatttatttatttatttatttatttgagacggagtttcgctcttgttgccaaggctggagtgcaatggcgcaatctcggctcactgcaacttctgcctcctgagttcaagcaattctcctgcctcagcctcccgagtagctgggattacaggcatgagccaccacccccagctaattttgtatttttagtagagacggggtttctccatgttggtcaggctggtctcgaactcccaacctcaggtgatccgcctgcctcggcctcccaaagtgctgggattacaggtgtgagccaccgcgcctggcctatttttaatagatttctaacttccctgtaatctatcttactcccactgacgccaggcgtggtgggagacacctgtaatcccaactactggggagactgaggcaggaagaattgcctgaaccgggagatggaagttgcagtgagccaaaatcacaccactgcactccagactgggcgacagagcaagacttcatctcaaagatttttcaaaaaaaatctttgaaaaaagacactacctatgtatgacattgataatggaagccccactgtagtcattcacaaattagaatgcgagggtctcacactattctttcaccttgattgaagcagaggtgggcaaaccagccataactgaccctctttcttgcttattttttttatgcttcaaaattgcctccatataatggtctctctttttacaaattcttgttagtgacaaagctatttacctcttttctgcttttcaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaaggtaagttacaccagttgaatctggtttccccattctgtttatctatttgtataattgtcccattcttattggattgcatttatatctgtagtttcatctgatatataactgtggaatctttgtcaggcaacatttttgttcaacccgttcaactcttttttctttttttttttttttttgagactgggtcttgctgtgttgcctaaggctggagtgaaatggtgtgatcatagctcactgtaaccttaaactcctagactcaagcaatccccctgcctcagcctcctgagtagctaggactacaggcacatgccatcatgcctttttttttttttttttttttttttaagagcaacgtgatcttcctatattgcccaggctggtctcaaactcctggcctcaagcaatcctcctgcctcagcctcccaaagtgctggaattacaggtgttaagccactgcccccagccctattcaaataagttttaacacatgcctcctagaatatcctgtgcttttctattataatttactattttcttgctagtccccattcactctgtgaggctctgcattgtgtctcatttatctttcattcccagcatgtagcacagtgtttggatgttttgttgaattgaaagatattccaaataaaagaataggattaacaagtggaaagtggaaataggcatgatgttaggatgactttatgtaaatcagcttatctaaaaatgaaaggattcatatcaaatgtaaggtatagggccaggcgcagtggctcacacctgtaatcccagtactttgggaggccgaggcaggtggatcacctgaggtcagggcttcggagaccagcctggccaacatgatgaaaccccatctctactaaaaatacaaaaattagccaggcgtggtgggaggcacctgtaatcccaactattggagagactgaggcagggagaattgcctgaaccgggggatggaagttgcaatgagccaaaatcacaccactgcactccagactgggcgaaagagcaagacttcatctcaaaaaaaaaaaaatgtaaggtataaataaggtagtgcttcatcatgagagaacctctaatgctagatcaggcagtctgaatggtttgggtcatgagcaaccactgaaggaaggttcattcagcaaactgtttataatacctgacagcaggagaagatgtggagttacaaagaaaagcaaagtaatttttggtttgtttgtttttttgttttgttttgtttttgagacagagcctcactctgtctcccagactggagtgcagtggcacgatttcagctcactacacctctgcctcccggttacaaggtattctcctgcctcagcctcctgagtagctgggattacaggcgcgtgtcaccacgcccagataatttttgtatttttaatagagatggggtttcacaatgttggtcaggctggtctcgaactcctgacctcgtgatccgcctgcctcagcatcccaaagtgttgggattacaggcgttagacaccgtgcccagacatttttgtttctttattttgtttgcttgtttgtttgtttgtgtagggacagggtctccctatgttgctcaggctggtctcaaactcttagcctcaagtgatccacctcggcctcccaaagtgctgggattataggcatgaaccaccatgtccagcctaaagcttttaacttttagtgttaccctaccaggtgatgagttacagggtagacacatatatgtttgtgacttcaatttattgatgaaaaaataaatcaggccgggtgcagtggctcacgctcgtaatcccagcactttgggaggccatggcggacaaatcacttgaggtcaggagtttgagaccagcctggccgacatggtgaaaccccatctctgctaaaaatacaaaaattagccaggcatggtggcaggcacctgtagccccagctactcgggaggctgaggcaggagaatcacttgaatccaggaggcagaggttacagtgagccaaaatcgtgccactgcactccagcctaggcaacagagcaagactccgtctcaaaaataaataaataaggccgggcgcagtggctcatgcctgtagtcccagcactttgggaggccgaggcaggcggatcacgaggtcaggagaccgagaccatcctggctaacatggtgaaaccctgtctccactaaaaaaatacaaaaaattagccaggcgtgttggcaggcgcctgtagtcccagctactcaggaggctgaggcaggagaatggcgtgaacccgggaggtggagcttgcagtgagccgagatcgcgccactgcactccagcctgggcaacagagtgagactctgtttcaataaataaataaatagaaaaaatatataggccaggtgcgatgactcacgcctgtaatcccagcactttgggaagctgaggcgggtggatcacctgaggtcgggagttcacgaccagcctcaccaacatggagaaacctggcctctactaaaaatacaaaattagtcaggcatggtggcacatgcctgtaatcccagctactagggaggctgaggcaggagaatcacttgaacccaggaagtggaggttgcggtgagccaagatggcaccattgcactccaacctgggcaacaagagcgaaaatctgtctcaaaaaaaatatatatataagcccggcgcagtagctaacgcctgtaatccaccattttgggaggccgaggggggcagatcacttgaggtcaggagtttgagaccagcctggctaacatggtgaaactccgtctttactaaaaatacaaaaattagccaggcatggtggcgggcgcctgtaatcccagctatttgggaggctgaggcaggagaatcgattgaaatagaaggaggaggttatagtgagccaagatcatgccattgcactccagcctgggtgaaagagcgaaactccatttaaaaaaaaaaaaaaaatatatatatatatatatatacacacacacacacacacacagacatatgtgtatatgtgtatatatatgtatatgtgtatacatatgtatgtgtgtgtatgtatatgtatatatttatatatatacatatatatatatatatatatatatggcatggtaagaaagcagaaagaggccaggcatggtggctcacgcctgtaatcccagcagtttgggaggccgaggcaggcagatcacccgaggtcaggagttcgagaccagcctggccaacatggtgaaaccccatctctactaaaaaatacaaaaattagccgggcatggtggcacatgcctgtagtcccagctactcgggaggctgaggcaggagaattgcttgaacccaggaggcggaggttgcagtgagccgagatcgtgccacttcactccagcctgggcggtaagagtgagactccatctcagagaaataaataaataaataaaaataaagcagaaagaaaggaggagtatctatatgaaacctagagccaaattaagtaaggttttacagagggaatgacctttagaagtatgactaagagtgaactagatgtgaagagaacaggacattccaggcaatatagggccctagagaagtttgttttagttttggtttagtttgtttttttttccaaaaataagatgaaatcacttgggcccaggaggttgaggctgcagtgagccatgataatgctactacaccctagccttggtgacagagcaagactctgtctaaataaataaatgaataaaataaaaatgaaggcagtttttggccaggtgcggtggctcacgcctgtaatcccaacactttgggaggctgaggcaggtggattacctgaggttgggagttcaagaccagcatgatcaacatggagaaaccccatctctactaaaaatacaaaattagggcggggcgcggtggctcatgcctgtaatcccagcactttgggagactgaggtgggcagattacctgaggtcgggagttcgagaccagccttaccaatgtggagaaacccgtctctactaaaaatacaaaattagccaggtgtgatggcgcatgcctgtaatcccagccactcaggaggctcaggcaggagaatcacttgaacccgggaggcggagattgcagtgagctgagatcacgccattgcactccagcctgggcaacaagagcaaaacgctgtctcaaaaaaaaaaaagaaaaaaaaatacaaaaatacaaaattagccagacgtggtgttgcatacctgtaatcccagctactcgggaggctgaggcaggagaatcacttgaacccgggaggcagaggttgtggtgagctgaaatcacatcattgcactccagcctaggcaacaggagcaaaactccatctcaaaaaacaaacaaacaaacaaacaaacactgggcgcggtggctcacacctgtaatccaagcactttgggaggccaaggcggtggatcacctgaggtcaggagttcaagaccagcctggccaacgtggtgaaaccccgaatctacgaaaaatacaaaaattagccaggcctggtggctcacgctacttgggtagtcccagctacttgggaggctgaggcaggagaattgcttgaacccaggagacggaggttgcagtgagctgagatcacaccactgcactccattttgcctgggcgacagacaagactccatctcaaaaaaataaataaataaataaataatgaaggcagtttttaaggatttagtggcagtatgtagaatggataagaaaaagaaaagaggaggccgggcacggtggctcatgcctgtaatcccagcactttgggaggccgaggagggtggatcacaaggtcaggagttgagaccagcctgaccaacatggtgaaaccctgtctctactaaaaatacaaaaactaactgggcgtggtggcacacacctgtaatcccagctactcaggaggctgaggcaggagaactgcttgaacccaggaggtggaggttgcagtgagccaaaattatgccactacactccagcctgggcgatagagtgagattccatctcaaaaaaaaaaaaaaaaagaaagaaagaaagaaaagaaaagaaaaaaagaaaagaggaatagcctggccacagtggctcatgcctgtaatcccagctactcaggaggccaaggtgggggaatcccttgagcccaagagttcaaggctgcagtgagccgtgatcacaccactgcactacagcctgggcaacagatggagaacctgtctcaaagaaagaaaagaggaataacggcagggcatggtaatcccagcactttgggaggctgaggtgggcagatcatttgaggtcaggagttcaagaccagcctggccaacatggtgaaactctgcctctactaaaaatacaaaaattagtagggcacctgtaatcccagctacgtgggaggctgaggcaggagaatcacttgaaccagggaggcagagcttgaagtgagctgagatcgcaccactgcactccagcctgggcgacagaacgagacttcgtctcaaaagaaaaaaaaagaaggccgggcgcagtggctcacgcctgtaatcctggcattttgagaggctgaggcaggtggatcacgaggtcaggagatcgagaccatcttggctaacatggtgaaaccccgtctctactaaaaatacaaaaaaattagccgggcgtggtggtgggcacctgtagtcccagctactcgggaggctgaggcagaagaatggcgtgaacccaggaggcggagtttgcagtgagccaagatcgcgccactgcactccagcctgggcaacagagtgagactccatctcaaaaaaaaaaacaaaaaacaggcaaggatacctgtgaaggggcaataatgcaagcatgaattgataagggtctagaccagactaatgggtctggaccagactagtaagggtctagcccagactaattatccataattatccaattgcaataatccaagcatgcattgataagggtctagaccagactaatagagaaatactaagaaggggcagatgtcagagacatttcagagaaggagtaagcaagatttggaaatgattggatatagggatgaaggaaaggatgtaaagacaactaaggccaggtgcagtggctcatgcctataatcccaatgttttaggaggctgaagtgggaggatcacttgagcccaggagtttgaaaccagcctgggcaacatagcaagaccttgtctctcaaaaaataaaatagccaggcatggtggcgcgcacctgtagccctagctctgaggcaggaagattgcttgagcccaagaattcaaggtttcagtgagttgtgattgtgccactgcagtccggcctgggcaagagcaagactctgtctctacaaaaataataaatagtccaggcatggtggctcacgcctgtaatcccagcactttgggaggctgaggtgggaggatcacgaggtcaggagatcgagaccatcctggctaacaaggtaaaacctcgtctctactaaaaatacaaaaattagccggatgtggtggcaggcgcctgtagtcccagctacttgggaggctgaggcaggagaatggcgtgaacctgggaggcagagcttgcagtgagctgagattgcgccactgcactctagcctgggcaacagggcgagactctgtctcaaaaatatatataaaataataataatagcaataaataaaaattaaaaattagccaggcatggtggcacatgcctggagtcctagctgcctgggaggctgaggtgggaggattacttgagcccaggagtttaaggctgcagtgaggtagaattgcaccactgcactccagcctgggcaacagtgtgaaattctgtctctttaaaaaaaaaaaaaaaagacagctaaggattaatcatgggtaactggaaaaacagttcctaccattgataaaaataatgacaccaagaggtggtctgatacataagttattaatgatgctcaaagcttgtctgtctttcacaaaccctttcctgagttcaccagcactgactacttcattctatatccccagctcttaattgccctgcttgtgttatatcatttaatattccctgacatgttgaataagaatggtattcttagccagggagcagtttctcacgcctgtaaacccagcactttgggaggccaaggcaggaggatcgcttgagcccaggagtttgagaccagcctgggcaacataatgaagtcccttctctataaaaaatataatttttttttttgagacggagtcttgctctgtccccaagctggaatgcagtggtgtgatctcagctcactgcaacgtccatctcaagcaatttccctgcctcagtctcccaagtagctgggattacaggtacccaccatcacacccggctaatcctcgtatttttagtagagatgggggtttcaccatgttggccaggctggtctcgaactcttgaccttgtgatccacccacctcagctaaaaaatacaaaaattagccaggcacagtggctcatgcctgtaatcccagctactcgggaggctgaggtgggaggatcgccagagcctgggaggtcgggctgcagaatgccatgatcacgccactgtgctctagcctgcacgacacagtgagaccctgtctccaaaaaaaagaaagaatggtattctcagaaaacaagtttagttgtggtttctctaggagtatttttctttttatttggcatcctcctcgtagtggccaatattgtgctgatattgaatactcaaaactaaattcacattttctcttttgctgaatttgcatgtcacaattttcccttcctatcctaattcagttggctcaatagagcctctgaaccttcctgctcagtttttcctcttttttttccaggggtttatgtctgcataatcaaggttcgaccgcagtcagaggagctgctacaggccctcagtgtggctgacacctcagtctatgggtgggctacactggtcagtgaacgtagcaagaatggaatgcaacgaatcctcattcctttcatcccagccttttatattaaccagtcagaattggttcttagccacaaacaagatatcggggagataagagtactgggagtggacagagttcttaggaagctagaggtatgttaagaactgaaccaaaacagaacaagagatcaggaatttgaaaagatagttttcattctcacttcaagggcaaaagaagttactgagtgacctaataaaaattaccataggaaatgacaaaatcaaatgaagaaaacccatctccttcataatgccaggcaggctcccagagtccaaaatctaggtcataagctttgtcaacatacctaaaggagtaaaaaaagtaaatgattggccgagcgcggtggctcatgcctgtaatcccagcactttgggaggccaaagtgggtggatcacaaggtcaacagatcaagaccatcctggccaacatggtgaaacctcttctctactaaaagtacaaaaattagctggacgtggtggcggacacctgtagtcccagctactcgggaggctgaggcaggaaaattgcttgaacccgggaggcagaggttgcagggagctgagatcgcgccactgcactccagcctgggtgacagagcgagactccctctcaacaacaacaaaaaagtaaatgatttgattgtcggctagctagctagaaatccagatcttgacaattattgtactgtatatgtttcagattggaacatactgatacaaagttgatttttcttcttttaaataaaaggttttatcttttctccaaggtcatctccagctccccagttctagtggtcgctggccatagccactctcccctcactcctggcctggccatttactctgtaagagtggtcaacttcacttccttccagcaaatggcatcacctgttttcatcaatatttcctgtgtactcaccagtcaaagtgaggcagtggtagtgagggctatgaaagataagttgggtgcaggtaagcatcagagattcctatttataatctagagaggaaaagaagaaagaatgtattacattagtaccccccatctgcagttttgctttccgcatttcacttaactgtcaaccacggtccaaaaataaatgaaaaactcctgaaataaacagtttaaattgtgcactgttccaaatagcatgaggaaatctcacactgtcctgctctggtccccaaccatgaatcatctctttgtccagcatgttcacaccgtatacactatcagccctttagtcacttagtagcagtctctgctatcaaatcaactggtatcaaggtatcacagtgcagtgcttgtttcaagtaacccttattttacttaataatggctccaaagcacaagagtggtgatgcctgcaattcgggtatgccaaaaagaagctggaaagtgcttcctttaagtgaaaaagtggaagttctcaactcagtaaggaaaacatagtacgtagagggttcaatattatctgtggcatccactgagggtcttggaacatattccccacagatatggggggacagatgttatcacagtttagttaatgggaaacattcagccacttgaccaagattactcaaactagttgaggcatgaatcttccaaacctacccaaaatacaacctttaggtagctttcttaacactacctaaattttatatttaacttatatatttaagaatagttgtcagccaggcatgatggcccatgccttgtaattccagcactttgggaggccgaggtgggcagatcccttgagctcaggagttcaagaccagcctggggaacaaggcaaaactctgtatcaacaaaaaagtacaaaaaaaaaattacctgggcatggtggcatggacctgtggtcccagctactcgggaggctgaggcaggaggattgcttgagaccaggagttcaaggctgcagtgaactgtgattgtgccactgcactccagcctggtgacagagcaagaccctgtctcaaaaaaaaaaaaaggaaaaagaatagttgtcagtttaacacgagtttgccagctttgtaagtatactatttgccctattttaaacctttttttttttttttttttttttgagagagtcttgctctgtcacccaggctggagtgcaatgtcgtgatctcggctcactgcaacctccacctcccaagttcaagcgattctcccgcctcagactcctgagtagctgggattacaggcacacaccaccatgccctgctaatttttgtatttttgtagaaatggggtttcaccatgttggccaggctggtctggaactcctgacctcaggtgatccacccgccttggcctcccaaagtgctgggattacaggcatgagccaccgcacccggccaatcttattgataaatgttttgttgtcttcaaaagtatttaaatctttttgcatcaggcaatgggccaatgttaaccctagaaccaagacttagctttcccaaatcctgattccaggcattacctagtttagaaataatgccacattggataggatgggaatagttacgaaaaggtgttagaaaagctagagaaccatcagtctccttatattgtatttgtcacgcccacttccccacccctcaagggaagctacttaattactgggaactatctaagctaaattatagtgtatctcctaatgggaaataggtttttgctgatgtttacgtgagcatctggtttgtattgatcattatcctaagcacatttatatgcttttggtttaattctcataactctaggaggtaggtatttttccccaagagctgaggaaactgagatgctggtgcagtggctcacacctgtaatcctagcactttgggaggctaagatggaggatcacttgagctcaggagttcaagaccaggctaagcaacacagcaagaccttatctctactaaaaatcaaaagaattagccaggcatggtggcatgcacctgaagtccaggcaggaggttgaggtgggaggactgcctaagcccaggaggttgaagttgcagtgaggcatgatcacaccactgcactccagcctgggtgacaaaacgagaccctgtctcaggaattaaaaaaaaaaaaaaaaaaaaaaggatctctagatactatcacagaatgtattggaacagagtttttaaatctagagaccacggatccccacaaaggtccatagatagaattcaaggtgtccattacccaagtggagaaaaattgcatctttttctttccttttttttttttttttttgagacagaacctcgctctgtcgcccagtctggagtgcagtggcaccatctcagctcactgcaacctccactcccaggttcaagcaattctcctccctcagcctcccaagtagctaggattgcaggtgcccgccaccacgcctggctaatttttgtatttttagtagaggcaaggtttcaccatgttggccaggctggtctcgaactcctgatctcaaatgatccacccaccttggcctcccaaaatgatgggattacaggcgtaagttactgcgcctggccgtgcatctttattttcaattgaccactaacttaaagttagcactttcactgattattaatataggcagcaaaccaccataatatcagcagtattgtgtgcttttgtcaccaacagaattcattgactatactttcagggatcatttctatagttcattactagagaagtttctcagaatgtatagagaaaaaaaagaatccacagatatattcatgttcctactgccagatttaaaaaatatttctcttaaaaattacagtaattggccaggtgcagtggctcaagcctgtaatcccagcactttggatggccgagccgggtggatcacaaggtcaggagtttgagaccagcctggccaacatggtgaaaccccgtctctactaaaaataaaaaaaataaataaaaataaataaaaatagccaggtgtagtgtcatgcacctgtaatcccagctactcgggaggctgaggcaggagaatagcttgaatggggaggcggaggttgcagtgagtcgagatcgcaccactgcactccagcctaggacagagcaagactctgtctcaaaaaaaaaaaaaaaaacaaatacagtaatcaccagcctgggcaacatggcaaaaccccatctctacaaaaaatacaaaataattagccaggtgtgatggcctgcagtcctagctactctgaaagctgaagtgggaggatcgcttgagcctgggaggcagagatggagtgagctgagatctcaccactgcactgcagcctgagtgagaaagaaaggctgtttcaggaaaaaaaaaaaaaaaaacagaaaagaaaagaaaaacagccaaaaggccaggtgcggtagctcacgcttgtaatcccaacactttgggaagctgaggtgggcagatcacctgaggtcaggtgctcaaggcaagcctgcgcaacatagagagacctcatctctaacaaaaattaaaagttaaagaaaaacatttaaattattcaggtgttaaaaaaaaaaaaaaggccagcgcgatggctcatgcctgtaatcccaccactttgggaggccgaagtggttggatcacctgaggtgaggagttcgagaccatcctggccaacatggtgaaaacccatctctactaaaaatacaaaaattatctgggcgtggtggcgggcccctgtaatcccagttacgcaggatgctgaggcagcagaattgcttgaatctgggaggcagaggttgcggtgagccgagatcatgccattgcactgcagcctgggcaacaagagtgaaactccatctcaaaaacaaaaaaaaagtcggacatgatggtgtgcacctgtagtcctagttacttaggaggctgcagtaagccatgactgcaccactgcactccagcctgagaccttgtctcaaaaaaaaaaaaaaaaaaaaaggcaagtctacagttttattgaggataaggttagatacaaatcagagtgctcccaaaaaatgacatcctgagtaggacaaaggtactgtggatttaagtggtcactgatgatcttaaaaaaaagttttggctgggtgcagcggctcatgcctgtaattccagcactttgggaggccaaggcgggtggatcacctgaggtcaggagtttgaggccagcctggccaaaatggtgacactcatccctactaaaaatacgaaaattagccaggcatggtggtgggcacctgtaatgccagctactagggaggctgagacaaaagaattgcttgaacccaggaggcggaggttgcagggagttgagatggtgccactgcactccagcctgggcaacagagactccctctcaaaaaaatgaaaagaaaatgtttcaagatagagattacaattataaatggaatcagcatactatcacaagtttagtgaagggaagcatgttacctggggttaaagtgcacgggaaaggtaaacagcatgtttttgtttgttttgttttgtttgaaatagagtctggctctgtcacccaggctggagtgcagtggagagatctcggttcactgctagctccgcctcccgggttcacgccattcttctgcctcagcctcccaagtagctgggactacaggtgcatgccaccacacccagctaattttttctatttttagtagagacggggtttcaccatgttagccaggatggtcttgatctcctgaccttgtgatccacccgccttggcctcccaaaatgctgggattacaggtgtgagccaccacgccaggccgcattttttttttaagtctcctcatttttattactcaaaagtttcattttttatttagctgactgtgcttgtgccttcgacactttcacaacaattttctgctcctcgataaggagagcacacttgatccagtcacgaacacatttagcacacatggaacccgacatgttgttttggacaatctcgtaagaacttcaggttttacggcacgaatcccttgaagtctgcctgggcacatgccacatgcagattttggtgctttcccatccatcttggtataaaggtaaacaattctattaccaagggtttgggacagcctagttttgttagaggctgtattgtaggaaagcctacgttggtatgtcaaacgctggaccattctgagtgcctgcagacaacgtccctggaagaggaagaagtggtaaccagcattttaaagtagcagaggatttaaagcatcctttgaaatctaagaggaagaaataacaagctcaagaattagagagttgtattactctggagataggaagaagtcaaaaagacgcggttgagccaagtatagttcacatctgaagctctcttctctcttactaagaaggctgggttttgaatacttctggcagatactcttattactatttttagtcataagttttaaaatgcagcatctgctggaggttgcagtgagctgagatcgcaccactgccctccagcctgggggacagagtgagagtaaaactctgtctcaaaaaaaattaaatttaaaaaatgcagcatctgcccatggttgctattaactattatcttgttttgttatggccaatgtatagatcactgtgaagattccgccatcctcaagcggttcactggctcttaccagatcctgctcttgaccctctttgcagtgctggcatcaacagcttccatcttcctaggtagagtccttatattcaataacatagactttgacatgaaaactgcctttttttttttttttttgagatggagtttaagtctgtcgcccacgctggagtgcagtggcgcaatcttggcttacagcaacctctgccgcccgagttcaagcaattctcctgcctcagcctcccgagtagctgggattacaggcgccggccactgctcccgactaatttttgtatttttagtagagacggggtttcaccatcttggccaggctggtcttgaactcctgacctcgtgatccacccgcctcggcctcccaaagtgctgggattacaggcgtgagccaccgcgcccagatgaaactgccttatttcacaaataaggatgaaaattagccacttatcacatataattttaacaaacagtgtaaactaagccttgctagtcctagtaacgtggtggattaaaggtccccctcagccgggcatggtggcttatgcctgtaatcccagcactttgggaggccaaggcgggtgggtcacctaagttcaggagttcgagaccagcctggccaacatggtgaaactccatctctactaaaaataacaaaaattagtcagtgtggtggcacatgcctgtaatcccagctactcgggaggctgaggcagaagtgcttgaacctgggagacacaggttgcagtgagccaagatcgtgccactgcacttcagcctgggtgacagagcaagactccgtttcaaaaaaaaaaggtcctcaacttactaccaagaagcaacaaactggatttggcaaacacacaccactcagaagtggaaaccactactaaatcttgaggtataacagctacttttgctgaaattcatagttagggataattcaagtaacaaaacagactgggtgcaatggctcacacctgtaatcctagcactttgggaggccaaagtgggaggatggcttgagtctaggaatttaagaccagcctgggcaacacagagagactccatctctacaaaaaaactttaaaattagctgggtgtggtggtggcacacatctagtcccagctactagggaagctgaggcaggatttcttgagacagggaattcaaggtggcagtaagccatgattgtgccactgtactccagtgatactgtgtgtctaaaaaaaaatttttttgagatggagtcccattgtcacccaggctggtgtgaagtggtgcaatcttggctcactgcaacctccatcgcccagtttcaagcgattctcctgcctcagcctctcgagtagctggaattacagacacccgccaccacacctgtctaattttttatttttagtggcatgttggccaggctggtcttgaatgcctgacctcaggtggtctgcccacctaggcctcccaaagtgctgggattacaggcgtgagccaccacacacagcctaaaaaaaaaaaaattaacacaacactattgtctactccatttccccacttttttttttttttctgagacagagtctggctctatcgcccaggctggagtgcagtggcacgatctcagctcactacaagctccgcctcccaggttcacaccattctcctgcctcagcctcctgagtagctgggactacaggcacccgccaacacgcccagctaattttttatatttttagtagagacggggtttcactgtgttagccaggatggtctcaatctcctgacctcgtgatccgcccacctcagcctcccaaaatgctgcgattacaggcgtgagccaccgtgcccggccattttccccctttcagccaaaagctgaaagtaactctaaaatgggttaaattgggataaaaacttcctgtaatagtgccattactattacttatttttaagaattatttttagcaatattctcattctagagttgactttgccttttaaggccttcctcagatatgccttgtgacatttcctgtcctttttccagcatacaatgccttcctaaacaagatacaaacagttccagttgtgtatgtaccaactctaggaacaccacagccaggtaaaaaagcctctgtcctcatctttgaaaagctcagatacacacgtttaattcactcaacttttccctcttcttctaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaactggtatgtcagactgtattgtaaagagttaactgtcggccgggcgcggtggctcacgcctgtaatcccagcacttaggcaggcggatcaccaggttaggagtttgagaccagcctgaccaacatggtgaaaccccgtctctactaaaaatacaaaaattagccaggcatggtggtacacacctgtaatcctagctactcaggaggctgaggcaggagaatcacttgaacctgggaggcagaggttgcaatgagtcaagattgtgccactgcactccagcctgggcaacagagcaagattccatctctcttataaaaaaaaaaaaaaacaccaaacacaacacttgagatagtatcacagtttaaaaaaaaaacaaatttatccaatgagcctaggtggttaaaaatgcccccaaagggacttttaaagtacttggccacttacgtgccccaaatgactctaatattctcctcttcctggttgccccagaatacttgagacaggaacttcctaacacttaaacaagacaataaacaggatttatccaaaatgtgtttattgagatggtttcccactcatcttgactcagagtgcttttagtgctgcttcctcctgaaggaacatcctggaggaaaaagattcagagattagctgtcatcagtacaggtattctgcccacctctcccaaaaaagcagatgcatgatgatccacccacagaaagctacatcttttttctcaactcttagctacctgcgcatttgtatcactggttacttcctatcaacttaagcccttttatcacccatttatccccgctttagacagtagtgctttgagattaatacatagcttttggtagtatctagttaaaacaaccaaatccaacacttcttgtctaaaaatttacattatagatgatccctgtcactgttaagaccgaaaaatcctaagaaatgtttccatttctaaaaatcaaactcaaagccccaaatcacattagtaaaccatttaccttctgtaagccttgcttttcctcctgtaggctggcagaggacagtggagcagccaacacacaaaactaccgtttgtgcatggctaaagaccgtggtgattttatagcatcctgaaagaaaagcagataacatttttttcctctattacacccgtctttcctgcacttatgcccaactcatcatccattacattgtttcccaacacaaaaaaacgtaggggttgtatgtgaaatgtgatgagagatcacggtgaaatgaatcactcctcctaagatgcaaaactttgccagtctcatacattcaaattttaagagtatcagggaaaatattttccacaggcgaagaaactgaagctgctgcacagcttcaaggatacgagacagctaacactacaacattttccaactgttgaggtccagtgctttccccactacagcaagccgtctcctcacctgggcatttcacatccatgaagtaggaattggggctctgcaccaggcgtttcttcttgtgtttcctcttctcctcttctggagagggatgaaggagatcctttgcgagctaagagggacagaaatgcagagatttagaaaccaacagcgaaaatgggatggtcgaaaatagcccccactgtcacacaccggggagagctcgcccctcgccgcccctggtgtctgcgcagctgggccgccatcttatctcctctccgctcccgtctatgcgggtggcccgtgggccgctgcggtccctggagttaatgtcctaagaagtgcagagggtaaatgaggaccctctacgatccgaaatcagcgtgaggggagagttcggacagaacagcgagatctccgccgaaacctggaccaaagcactcacaggcatgttctcgtgtgcgtaggtcgtcaccgccggaaaggagcgaaagcggaaatcctgccccttatatagagcacactacaggaaatgacgcaaggatcttgtgccaccatgtttggaacgtcttactttgatccgccgcagtggggagacaagggagctgccattttcggaaggtctttaactgttagttgtgacacatatgcgtcaccatgttgagagggttaccttgctaatttgaggtcagcgtttgatcactatccagggataaatggacacttttaaaattttgtgccataccttgacagttggagcctaataaataggaaaggttgaggaaaacaccagggagaaggagccatatccaggacttccgtcctattttttaaatacctatattcttaactctttttctattggtttaatttaacagtttaggccgggcgcagtggctcatgcctgtaatcccagcacttagggaggccaaggcgggtggatcacctgaggtcagcagttcaagaccagcctggccaacatagtgaaaccccgtctctactaaaaatacgaaaattagccaggcgtggtggcgtgtgcctgtaatcccagctactctggaggctgaggcaggagaatcgcatgaacctgggaggcggaagtacagtgagccgagatccactccagcctgggtgacagaacaagactctgtcttaaataaataaataaacaggggagacatggtttggtcagtgaaaagaaatagggaagactcaaggagataatgagaggtgagagaatggacaaaaagagattgaatagtttagcttgagaagggacaagcatggacacggaaggtgatggggataagtgaaagatgccttctttttttttatttttatttttattttttttttagacacagttttgctcttgttgcccaggctgtagtgtgatggcgccatctcggctcaccacaacctccgcctcccgcgttcaagcgattctcctgcctcagcctcccgagtagctgggattacaggcatgcggcaccatgcccggctaattttgtatttttagtagagacggggtttcaccatgttggccaagctggtattgaactcccgacctcacgtgatccacctgcctcggtctcccaaagtgctgagaatacaggcgtgagacaccgcgtccggcctttaattttttataggcagccagaataggctcgagagagactcccttgaataattttttcttgcccgggcgccgtggctcacgcctgtaatcccagcactttgggaggccgaggcgggtggatcacgaggttaggagatcgagaccatcctggctagcacggtgaaaccccgcctctactaaaaatacaaaaaattagccgggcgcggtggcgggcgcctgtagtcccagctactcgggaggctgagacaggagaatggcgtgaacccgggaggcggagcttgcagtgagcggagatcgcgccgctgcactgcagcctgggcgacagagcgagactccgtctcaaataataataataataataataataattttttctttgccggtcgcggtggctcaggcctgtaatcccagcactttgggaggctgaggcgggcggatcacgtgacgtcgggagttcgagaccagcgtggccaacatggtgaaaccccgtctcgactaaaaaaaaaaaaaaaaaaaaaaaatttagctgggcgtcgtggcaggcgcctgtaatcccagctactcgggaagctgaggctggagaatcgcttgaacccaagaggcggaggttgcagtgaccagagattgagccattgcacttctgcctgggtgacgagcaaaactttgtctcaaaaaataaaataaaagtaaaaacaaaggttgggcgcagtggctcacgcctgtaatcccaggcctttgggaggcagaggtgggtggatcacctgaggtcgggagttcgagagcagcctgaccaacatggagaaagctcgtctctactaaaaatacaaaattagcagggggtagtgcgggtgtctgtaatttcagctactcgcgaggctgaggcaggagaatcgcttgaaccagggaggcggaagctgcggttagcccagatcacaccattgcaccccagcctacgcaacaagagcgaaactccacctcaaaataaacaataaaaattaaaaaaataaaaataaaaataggccgggcgcggtggcttacgcctgtaaacccagcactttgggaggccaaggcgggcagatcacgaggtcaggagatcaaaaccatcctggctaacacggtgaaaccccgtctctccctaaaatacaaaaaattagccgggtggtggcgggcgcctgtagtcccagctactcaggaggctgaggcgggagaatggcgtgaacccaggaggcggagcttgcagtgaaccgagatcgcgccactgcaccccagcctaggtcgacagagcaagactccgtctcaaaaaaaaaaaaaaaatagggccaggcgtggtggctcacgactgtaatcccagcactttgggaggccgaggcgggcggatcagaaggtcaagagatcgagaccatctggccaacatggtgaaaccccatctctactaaaaatacaaaaattagctgggcgtggtgtcgggcacctgtaatcccagaggattacaggtactccagaggctgaggcacaagaatcgcttgaattcgggaggcggaggttgcagtgagccgagattgcgccactgcactccagcctggcgacagagcaagactctgtctcaaaaaaattaattaattaattaaaaaataaataaaaaatttttttgaaacaggatcttactctatcaccgaggctggagagcagtggcatcataatcgtggctcactacagccttggactcttgggctcaagtgttctgcccacttctgtcccccaagtagctgcggctgggactacaggccacaccaccatgtatggctaatttttttttttttttttttttttttttgtcgaagcagtctcactatgttgcccaagctggtcttgaactcctgggcttaagggatcctctcacgttggcctcccaaagtgctgggattacaagtgtgagccaccgcaacaggtcttagataatattttctttctttcgtgtttcgtatttttttccacccccagcacacatatagcaagaataatttttttctaaaggcagagataaacttgtttctcttttactctctttctttctttcttttttttttttttttgagacggagtctggctctgtcgcccaagctggagtgcagtggcgcaatctcggctcactgcaagctctgcctcccgggttcacgccattctcctgcctcagcctcccaagtggctaggactacagtcgcctgccaccacgcccggctaattttgtgtgtgtgtgtgtatttttagtagagatggggtttcaccatgttagccaggatggtctcgatctcctgacctcgtgatccgcccgcctcggcctcccaaagtgctgggattacaggcgtgagccaccgcgcccggcaaacttgtttctttatacccgtgctgttcatatttcagcttcctggttaccaaggctacacattcatggcctattgagtgagatttcaggagtactgcaccttaagtgggccatattaaaagattcacgtaaagaatgacatttttagttcaaatctctgttttcctaagctatttggtcagagaaatcacacatgggtccccataagagagatcgttccaactgaagccccaggatgtgtctaggtaggctgtgtgtgttggggtggtggggccgattctgtataactaatttacgttttcaccctgttccaccagggggcagactgactcaacaaataacctacttctgcgcatcccgcttttttcaaagtgaattgggacccatagaactaagggcttggacaactaacagtaaaattctaggactgccttttactcagccccagaaaccgatgataactcatcttctagcttcgttgaatagcatctccaaaactcagccccatttttttttttcaatttctagtgctctccctaccttcacccttattcccaaaactcttggttctcttcccctaatccctctaaaatttctcttctaaaatttctggtcgtcgtggttaaacctctacttcccttcaccccagcctctctggcctcagaatggaagagtaaggtcctaagaggggagctacaattaccgaaaggctgtggaaaatagcgagagagacaggccggcctaagctaggaagggaaaaccgagagaacagaggccgggctggcagccttggcctgctcaaaagggtgggcgggcagggggtggagcccggaggggtgccgcctctcctctttcccggagcctgggcggagagggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggtgagcccgctggccatgtcccagaccccgactctcctgtgacctccttctccggctcccggattactagtgaccccacttttcagtccccttagagtaaggctcctaaattctagtccctcaacccctggctctgacccttcccccgtgcatgtctctgtatagtaaccaaacctctcacctctctgaggccttcaggtaactcttcaactgctgccagctcctcattttcttggtaccatcgccttagtctccccaaatccacaagaactcttctctatttttctctgttcccctcttcccctacccccaccacctagaactctctcgatcctatctccatgtttcctgtatccctgtccgccacatctttttctcccgatccgatgctagcctctttctgtcttgctgagcttcaaactctcccactgtgtccccacctcaccatctacttcccaggttccctgccccagtctccctgcacctcagctgaacaagggtttgggaagggtggaacaaggtggctgggtgtgctggagggtggcccaaggactgtgatcatgaatatgcagccagcttggtgaggaacgtggaaatgaggggacttttggggtctctgagtcagcctggtgactcatcctcctcccaggggcccccagcaggcttgggggaggtgcccaagtttctactaagaagaacattgtctcccctcctcccttctcttctttcttcatctcctctggcttgggaaatagacaggaagagtctcacgacaattctggttacaaaggaaaaggaaaaatgcccctctttcctaattgtctcaaaagtaatcctgtttagcctcagactttcctagtgccaagtttggcccactagttaattcacatagactggcttcagctacttttttccttactctctactaggagggtaggtgggataccaagagtagagggctctaagaaaacagagaagaggaatgtgaaagtaatatctggggggagacagagactgaattcagagagttgtcagctggtataactgaatggacccaagaggcagcctaaggattttaagcctccatgcagaattttcgtcaccttttccctcccaaaatccataaaatgtacgtaaaaatagtattcttgctatacaaatacagctttgggaaaattctcctagcttggcatttccaacaagattgttccccaagtgcctcccctgcagaatttctggtgccagcactgctccgttcctgtcccttccatcacacagttttacatgtgtgcatgcatgtctcaacttcagtgcataccttccacccctaggaattgatttcaagatccgcactgtggatatagaggggaagaagatcaaactacaagtctggtaagtcagtcctctgggatgcctcgccagacttccccatttacctcctacacgtttttccttctattttgtttcatttctcttcctttccccattgctccttctagaagtgctagaaggagcacttctggcatttctccggatgcactcagctgtccttccatctctcttcctgctctcccaactagttccaactcttttgtaactcttgcctcctctggctgcagagcatcctcttaatttgacaacaaacaactgttcagtcataacatggaaacaggctgtgagcagttaaatggcaaaggcagaattaagacttgactctaagtctagtgttttctccaaaatatggtgagcccagagagccaaatatagaccctgaaggtgtttaagtggtatgaagcttagtggaggcattatgctatgacatataagagcagactggtgcgcaaatctggttcttttagttatctcctgcctgaccttcattaattattcagcctatccaaatctgtttcctcttttttttttttttttttttttgagacagagttttgctcttgtcacccaggctggagtgcaatggcacaatctaggctcactttaacctccgcctcctgggttcaagtgattctccgacctcagcctcccaagtagctgggattacaggcgcccgccactaggccgggctaatttttgtatttttagtagagacgaggtttcaccatgttggccaggctggtcttgaactcctgacctcaggtgatccacccgcctcagcctcccaaagtgttgggattatagacgcaagccacggcacctggcgtgtttcctcatttttaaaatagagacaataatacatgtcttacaaggaaagagtaaggattagataaaatgatacatacacagtgcttgacacatagcaaacattcaatgaataagcaaagacatcttgtttcttgggccactaccatctctggaaatcagctcaactgtctttaatcccgttcccctttactgtttccttattctgttgccccaccatgttacaaaagctaaattcttgtgagagaggaagaattattccgttggagaattcttccctctattccatcccatgaaaacttctccttctttagggacacggctggccaagagcggttcaagacaataactactgcctactaccgtggagccatggtatgaagtgtgggtctgaacaaaggatgaaggatgaggctacagaatatattatgaatacaaagggtcaggggttggggcaggtaaaaatgggaggggtgcagtgtgggttgcagagggcccaacatggcctagtgtttagacccatggatgcggggtcacttacagggcagtgggaagcctcaatgggaacatggtccaaggtgaattttgtcatctcccagggcattatcctagtatacgacatcacggatgagaaatctttcgagaatattcagaactggatgaaaagcatcaaggaggtgaggaccctccaaaagagatggggaaactggttagaacctggagaatgaaggggtccatcaggataggcaagacctaacttttttttttttgagatgaagttttgctcttgttgcccgggctggagtgcaatggcaggatctcggctcactgcaacctctgcctcccaggttcaaacgattttcctgcctcagcctcccaagtagctgggattacaggcatgcaccaccatgctcggctaattttgcatttttagtagagacgggttttctccatgttggtcaggctgatcttgaactcctgcatcaggtgatccacccgccttggcctcccaaagtgctgggattacaggcgtgagccaccgctcccagccggcaggacctaacttttacttgtcttttgcccccagaatgcctcggctggggtggagcgcctcttgctggggaacaaatgtgacatggaggccaagaggaaggtgcagaaggagcaggccgataaggtgagggccaggctgagcaatgttctagaactgggctgggagggccaagataggttgcattgcagaggacttggctgctgtccttaattcaattctcttcccacttcaccccttatagttggctcgagagcatggaatccgatttttcgaaactagtgctaaatccagtatgaatgtggatgaggtgagatccacacccccatccccgaccaagagaggaagtattagaaggtagattctcctccctccaaactgactctgttccccactttaggcttttagttccctggcccgggacatcttgctcaagtcaggaggccggagatcagtaagttggttttgctggactaggtacaactctggggtgtgtgtgtgtgtatgtatgtgtgtgtgtgtgtgtgtgtgtgtgtgtgtgttggtgttgataaaaacggggagcaatgctaagatttctcatgagggtggatttactttaaacagtttataccctcctaccctaaccatccattcacaccatgacacctgtgcccttctccctctagggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaatgttcctgttttgggtaacttggattattgtcagaattgttctccactcaaatccaattattgtgtcttcaaagtgattgatttacccaaatcaggctcggtttctgtggaaccaggactaatcctactgctgtctcttccctagctgttctgttggtaaggaaaatagcaaagagcaggaggtagagtgatctgaaggtctggatatcctctttccgccatggggtccggatgcccttgtgggcagagccttgtcctgagcacaggaaattcccagcgagaagaactctaacagtcctagcctcagggaaataactgcacctagtgatttatccagtgatttgtgcaagcttctttgattctgccagcaatccatttagttatttgataggcattaatatctgcttttattagtgaggaaaatgagaagttcatttattcatatatgtatattgagcatctactaagtgccaggcacaatggtcagttattttatttatttattcatttatttttagggacagagtcttgctctgtctccgaggctggagtgcaatagtgcgatctcagctcactgcaacctctgcctcctgcctcagcctctcaagtagctgggattacaggcgtgagccaccatgcctggccaatagtcagttaatatagccctttggtggtacttacaagcagagggacaaggactttttttcttttttaagaccgagtgtggctctgtcgcccagactggagtgcagtggcacgatcccagctcactgcaacctctgcctcccgggttcaagcgattctcctgcctcagcctcccgagtagctgggattacaggcacgtgccaccacacctggctaacttttgtgtttttagtggagacagggttttgtcatgttggccaggctggtcttgaacgcctgggctcgagtgatcagtctgcctcagtctcccaaagtgctggggttacaggcgtgagccactgcgcccagcctgggacaagcaaactttaacaaaaacagctctttggctgggcgtggtggatcacaacaggagttcaagaccagcctggccagcatagtgaaaccccgtctctactaaaaatacaaaaaaaaaaaaaaattagacaggagtggtggagggcgcctgtagtcccagctacttgggaggctgaggcaggagactcacttgaacctgggaggcagaggttgcagtgagttgagatcacaccactgcactccagcctgggtgacacagccagactctgtctcaaaaaaacaaaaacgaaaacaaaaacatctctttgctgaataacaaagatggcaaaactactggaaatgcaaaagaaaattcaggcttgggccgagcacgttgtttcatgcctgtagtcccagcactttgggaggccgaggtgggtggatcacttcaggttgggagtttgagaccagcctggccaacatggcgaaaccccatctctactaaaaatacaaaaaaaattagctgggcatggtggtgggtgcctgtaataccagctacttgggaggctgagggaggagaatcgcttgaacctaggaggcagaggttactgtgagcagagttcgcaccattacactccagcctggagacagagcgaaactccatctcaaaaaaaaaaaaaaaattcaggcttgatgcacagcatccttaagtatatatatattatattatattatatattacaatgtataattatatatattatatattaaatatataggaaatatataatatatataacatgtatatgtttataaacatataacatattatatataatatataattatatattatacatatatattaaatatatattataattatatatttaatatataatatattatgtttaatatataattatatataattatattatgtttaatatataatatataatacatattttaatacataatatatatatatccccctttcaccatacataatattttttacacagcaaaatgtaataacttgataaatgtaagtatccaagcattgatgaggtaatgataaaccttatttgtggcttatgcttaagttcttttttttttcttttgagatgaattcttgctcttgttgcccaggctggagtacaatggtgtgatctcggctcaccgcaacctctacctcccgggttcaagtgattctcctgcctcagcctcacgagtacctgggattacaggcatatggcaccatgcccagctaattctgtatttttagtggagacggggtttctccatgttggtcaggctggtcttgaactcccgacctcaggtgatccgcccacctcggcctcccaaattgctgggattacaggcgtgagccactgcgcccagctgtgtttgagttctgtagtaaactgtccggtaggtttaatttgctcaagcgatgaggaaaagacttgcactttgtgcctcctgggaaagagactaacgtcttcaacataccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctggtaaggaggaggtaaggggagggaaaaggaggtcactggaggacaggatcgttcccggcctcggggctgggggagatcttatccatggacagcgcaggagggggtgccctattttctgggttttgacttttgtcccttcccccaactccgctacagccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctgtgagtatctatttctctaccctttttttttttaaacatctaagcaaacacttaagcaacatcttaacatccaagtcttattaagctgcctttgcatcatctttttttctttcttcttgcagtctcagtgtatgtccaaatctgtacttgtctttcccctgaaaatgtgcccctttctttccaagctaatggcagtattcaactgataactatggtttttttgtttgtttttgagacggagtctcactctgttgcccaggctggagtgcagtggcgagatctcggctcaccacaacctccgcctcccgggttcaagcgattctcctgcctcagcctcctgagtagctgtgactaaaggcgcgttgcaccatgcctggctaatttttgtatttttagtagactcgggtttcactgtgttggccaggctagtctctaactccttacctcgtgatctgcccgcctcggcctcccaaagtgctgggattataggcgtgagccgccacacccggcctcaaataactatgttttattcacttttagtatagtaggctctggaatggaatgtatctttgccactcctagactgttgcccctgaagtgttctaacatacattcgtaatcatgcaaccaccacctccaccatccgcatcagaactctttcattagctctctgttgcctaccactccaaaccatagcagttgggcacctgcaccttctgaatggcagcctttttgtttatcctgttgccccttcctaacatgtactttgctccttttctcctggcagaaaactacccctgagtgtggtcccacaggatatgtagagaaaatcacatgcagctcatctaagagaaatgagttcaaaaggtgagtgctgtttctcttctctgagatcacctcctttgctcctatgactttagatggatggtcccaccttttcccctggtctgggggtagcatggaatatctgaaagaagagggggccgggctcacacctataatcccagtacttagggaggctgaggctaacagatcacctgaggtcaggagttcgagatcagcctggccaacgtggtgaaaccccatctctactaaaaatacaaaaattagctggtgtggtgggtgcccataatcccagctacttgggaggctgaggcagggagaatcacttgaacccaggaggcagaggttagagtgagccaagatcatgccactgcactccagcctgggcaatggagcgagactgtgtgtcaaaaaaaaaaaaaaaaaaaagaggctgggaggggtggctcacgcctgtaatcccagcactttgggaggccgaggcgggtggatcacgaggttaggagttcaagaccagcctggccaagatggtgaaacctcatctctcttaaagatacaaaaattagctgggcatgatggcgggcacctgtaatcccagctacttgggaggctgaagcagaaaactgcttaaacccgggaggtggaggttgcagtgagccaaggtcacgccactgcactccagtctgggtgacagagcgagacaccatctcaaaaataataagaaagaagacgggatttggagccaaattacttgaacccaagtcccagctctactcctcagcactatgttattggccatattttctcatcagtaaaattggttaatactagctctgcttatccagagaataaattaaatgatctatttgagagggatttatgtactatacacacaatagaagcctggctctgatttcctcttgagtgtatcctggctaggctgaagtagaagggaaattagagggagaagctgtctggccttccttgggaataactattccttcctgccctcagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggatatttctggaagtcactgtgaggtgaaggcaagagggcagtagtagagtgctcccctgggtgggagaccctagacaggacaggacctccctcttgcttcttgacgaccttggagaacagagtccccctcccttgctcagccaggggttgctccctgcccttgcctctcacctccgtgaggctggtaatcctcagacccagcttctggtcgactctggaatggactgaagctgggcaggatgatgagagccagggaaaaaagaagaatctgggaggaagcaagaggaacagatgaagggagcagggggtagagtgaacggaggccagctggggttatcggatgtgggaagtagatctggccgggtagtcggggtataaggatagaagtgtggggggagatgggagtagatagactaatggtaccaaaacacaagtgctggtctgggcagctttgttggaagtttgagcaattagcgtctgcagctggcggagctgagctaccaaggagctgggaaaggaggaatgaagagttagtatcatctgggtaccaggggccaagaatggcacccctgtgtgctgtacctgccttcaaaacacacatacacacacaatgctttcactcacatgttgtgcctctccagctcctggacttttttctgtaattcttggttctgtgcagaacaggctgccaccctagaatgtagggaggtaggacaaggctcagcaacctgagtcccttaccttgcctcccatggtgaggaaggggcccagacatggcccacaagaagccagaaataacccaggcgtacctgctctccagcccatcaatgtactccttcttccgccgccgactgtcctgagctgactgcttgttacggattttcctcctgaccttcttgaggaccctctcctctgccttggaggcccaggatgtgtgagtcctgggtccttcacctgcccccaactccccaatgcttctcctgggatattggcccctcagaggtcatggtgaggcccctgggttgggatacccttaggggaagcatgttaccttggtgaggggcaggtgagagggcagggaaaccccttcctgccccagcagacgcttctcctcatcggtcaggaacagggtttgacagggcagctgggggtaggggcaggagaagatgcaataggagtgaggagggggtcatcccatttgcagcacccaggctactccccccacatgccttctggagagtgtttcctcactgggagacaactttaatctagaggtgaggtgaggggcagagactttaattcagacaggctctagatcaagccaaagggacatcctgaggccaagaagggagagaggagggtattgtcatatccttcacccagacactgaggaccttggcactctgagcaagctagagaaggcttattctggtccatgtctccccatacccaagagaacctgaaagaactcactacagtgaagtttgcataatttccttacagcaagcacatgattcactttcagtcattaacttccatttagcagagtgtgttatccagttgcccgtcaacctcagggagctccctggggcagtggcccattctcccttagggtctgagctctgcttctcagactcaggttctgtcccctctcatacaaggagcttcccaaaggcagccatacgtctcacagcaaatcacaggagaggatgtacggagagtggatggcccttctcactagtatttctttttgaaagatgtatgtggccgggcacagtggctcacacctgtaatcccagcactttaggaggccaaggtgggcagatcacctgaggtcagaagttcaagaccagcctggccaacatggcaaaacccaatgtctattgaaaatacaaaaattagcagggcgtggtggtgggtgcttgtaatcccagctacttgggaggctgaggcaggagaatcgcttgaacccgggaggtggaggttgcagtgagccgagattgcaccactgcactccagcctgggcaacaagagcgaaactccatctcaaagaaaaaaaagatgtatgcttcattttgtgacttacagagaatttactttggtttttgcctgctcatggtttttggcttttggcaaaaccatttcctgtgtggcttttcctgatgtgcctttcttgttcctgtgactgtttggtggaactattagaggagtgtctcttccagtccacctaatcaaaatcactgaaaatgaggcctagagggtttcatttaaaacaaacaacaaaaaaaaaaaaaaaaaaagaaaaagaaaaagaaaacagagtggccaaggtggctcacgcctgtaatttcagcactttgggaggtcaagacaggaggattgcttgaggctaggagttcgagaccaacctgggcaacatagtgagactgtctctacaataaagaaataacaaagcatttacaaacaccatggtgcttctaatgtatacccaaacttaggggcatcagactttttttttttgagacggagtcttgccctgtcgcccaggctggagttcaatggcgcaatctccacttactgcaacctctgcttcccgggttcaagcgattctcctgcctcagcctctcgagtagctgggattaaaggcacccgccaccatgcccagctaatttttgcatttttagtagagatggggtttcaccatgttggccaggctggtctcgaactcctgacctcgtgatccgcccaccttggcctcccaaagtgctgggattacaggcatgagcaccgcgcccggccggcatcagacttttaaaggttcctcagctcaagattctaagatgttggccgggtgcggtggctcatgcctgtaatcccagcactttgggaggctgaggcgggcggatcacaaggtcaagagatcaagaccatcctggccaacatggtgaaaccccatctctactaaaaatacaaaaattagccaggcttggaggcgcacacttgttgtcccagctactcaggaggctgaggaaggagaatcgcttgaacctggaaggcagaggttgcagtgagctgagatgatgccactgcactccagtctggtgacagagcgagactctgtctaaaaaaaaaaaaaaaaaaaaaaaaagattctaagatgcttagcttggcttctggtcccagcttcaactgcagatttgaagagaggctaggacctggtccctgccttttgggtacaaggagtaattttcagaggaaagggaggaacagtgatctgagcatagtcccctctttacccagccttggacgctgcccagacggccttgagaaggcatctaatgtgatacctctgctacactgtagcactagccagtgggtgcctcctgggcaactgttccagtggaaacattgctgctattgcttttctttcttcctgtacctataaccagttgggattcccaggtggcctgtcccatttctgtgtcctgacccaaggctgagataatggctctggctaagaatacaatgcatgcaaagtctgggctttctcctgagccctgtccccagattccctcaccccaccttaactgagtttttgctaccttacccccaagggttctttctcccttgtccttccctgcttttaaaattgttcatgttgggccaggcgtggtggctcacacctgtaatcccagcactttgggaggcagaggcaggcggatcacaaggtcaggagttcaagaccagcctggccaatatggtggaaacccgtctctactaaaaatacaaaaattagccaggcatggtggcaggcacctgtagtcccagctacttgggaggctgaggcaggagaatcgcttgaacccgggaggcagaggttgcagtgagctgagatggtgccaccacactccagcctgggtgacagagtgagactccgtctcaaaaaaaaaaaaaaaaaaaattgttcatgttagtcgggcacagtggctcatgcctgtaatcccaccaccctgggaggctgaggtaggcagatcacttgaactcaggagattaagaccagcctgagcctgggcaacatggcaaaaccccaaaaccccatctctacaaaaattagccagacgtggtggcacacacctgtagtcccagctactcaggaggctgaggcaggaggattgcttgagcccaagatgttgaggatgcagtgagccgtgattgcaccactgcactccagcctggatgacagagtaagaccctggctcaaaaaataaaaaatagttcaactgttcatgtctccttggtcttcaggcccaatgccacaaaaaccggggcaaaggcagttcatcatcagtttccattccctcatccctttgctctgtctgtgtgattatatatgtatcaaggagtagtggttctggctgacaccaagactcaccagggttgtacagggcactggggctacggtgcctgctctgggcaggatgtgggcatgagcatcaaagggcagctcactgaccatgcaggaatcaggcaccataaatgctgggctccactgatctggagtagaaaacaggtagctgggagaaaggagacttaggaacaccctgacagccgcagggcctgggtagtggcacaggttgggtaaacccccttaaccccatggttagggccagtcccgaagggccatttcccccttcccacaaagaacactgacctagctggatggagataaggcctacatttggcccagtttccccctgcatcctctccagggcccctgcctcatagacaacctcatagagcataggagaactggttgccctgggggcagggggactgtctggatggcaggggtcctcagagatgccactgtcactgccaggagatgcttctgagcagtacacctcattgggatcaatgaaaagcttcaagaaatcttcaggctcactctcttgaaggccctacagtaggaaaaggttatatatatgtgcagggaagaattttggaagtcctccctgacttatgcttcattttcagtcctttcacttcttgggcatggagacagttattatacaacttacgtctattttgggggtggtctgttttcagacctgtctccaagtgggagctgaagcctcttatcacagagttgtgtctcaaccccacccccactcccactcgtcacactcacacagccacggtccccaccggacttccagccttgcagtccctgttcctgtagcctagttaccggaacctctggaggggggcagtggagtcccagctccaggacggatcctgtcgagaagatatcctctgggggctccagccacgcgtccagcaggtcagggattccgagatccatgcttctgcaggaaggcgtgtgggacggagggttgcagaaacggaatgatggctgcttactaccccctacagtttctgggctcctctgctcccttttccattatccccgcccccccactccttcctcactagcaagccccctcacctgtcccctcgatatttcaccttcagccctatccctcaggtttagacaaagaggccccccccaagcattacctgttctgaagagcccagccctgtcaagccagcatagcccgttgacctccccaaacactacaccttttctttcttccaggatctcgtatcctggacctgccagccaaaccccgcccccagccttacactacaaaagtggatgccaccttgccaggagccacggtagggccgctgtatctgggagtaggggactaagagtctgagggtccacaaacggaatttaagaagtaggtagccgcgccctttctgctgcagttttctcttagctatagtaaatcttcctgagggtttggtgtctcctagctgaagaacagaaaaggctgtgactggagcacaggactcctgaatgcctgttctgtagccctcgcttttgcaagagggagatcatggcagggttgtaaacaaaggcggaaagagtcaagagacctgcgaatttactagggcatcccctcgcccaccgcgtggcgctcttcccaaagctgagtcctgattggaagctgaagacttaggtttcggaggggcaggacatcgagccaatggcacactaccctctcaaggccgcctcttccgtaactggtcggagacagtttggctgttcaggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtttgtcttcgcgcgccacgtgactcggaagctccggtttcacccaggcggggagtcaacagcccgctgaccccagtggagcggtgatcctcgctcggcaggcggcaggagcgcgatggcgggtttccccgtccgcaagccgagcagtgtggcgttaatggagaacagcagctgtgcgcacacgctcgctgcacgctgctcattcacggagggacacggggcaggaaaactgcaacaagttaaaaagccttttgcgtttgttgtcttattgtttgcatacagttaccgggaacattatgtcccacacttgtataatttacaaaacgttttcataaaaattgttctcttccttaatccataacagttctgaggcacacacggcgggtaatattttgcaaattttacctatgaggaggcagatccatgactagaaagtagtaataccaaaactcagggttgattgattatttttatttttttgccttggtctaatgtctgatggtccaggaattcacttcaagtaaaacaatggaggtaaactgatacaggtatggttttcagtagtatttcagaaaagggtagctgggtgagtaaaacagtagtttggagtgtgaatcccagaactcaaactgctactaattatccttatgaagatttgaacgggctaagggtaaaaacgggaacagggtctagtcaggcatttccatgttactcatataattcttacagcagatggagctgacaagtttgtttgtttgtttttcttttgctctgtggcccaggctggagtgcagaggctcgatctcggctcactgcaagctccgcctcccgggttcacgccattctcctgcctcagcctccctagtagctgggactacaggcgcccagctaatttttttgtatttttagtagagacagggtttcaccgtgttagccagggtggtctcgatctgacctcgtgatccgtccacctcggcctcccaatgtgctgggattacaggcgtgagccaccacgcccgtccgagctgacaagtttaagtaactttctcaaggttaccctgtaagtagctgaaccaagatttggatgcttcagcccatgttcttcacactatcaacccaccttgtggggctttctcagatttcttatctgtctttcccgctcatatctctccatcctgctcaagtagtgaagagacaaagcagccttcctagattgatgcagagctccaaggaaagcaaagctgttcttgttgagatcattctgagagcgagaaaggtggttaaatacatttcaaagggcttcctgcgggctgtatgtgcagagatgatttgagtggggaatgtagttagcttccgttgatgttagaactggaaggaccctctgcagtcatctgcttgtttaacttcctccttgcccctgatttatcaaactctggtgaggaaaactgacttgcctaaaatcatacatcaaggtaaggtaaaattgaggagatctattgggccgggtgtggtggctcacacctgcagtcccagcactttgggaggctgaagcgggtggatcacctgaggtcaggagttcaagaccagcctggtcaacatggtgaaatcccgtctctactaaaaatacaaaaattagccgggcgtggtggcgggcgcctgtaatcccagctactcgggaggccgaggcgggagaattgcttgaaacctgggaggcagaagttgtagtgagccaagagcatgccactgcattccagcctgggcaacacagcaagactctgtcaagaaagaaaggaggaaagaagaaaggaaggaaggaaggaaaaagaaaagaaataaagttgccaagagattttaaatgttctcatcacaaataaatatgtgaagtaatgcatatgttaattagcttgatttacccattctgcaatgtacatatatttcttttcttttttctttttttttgagacggagtctcgctgtgtcgtccaggctggagtgcagaggtgtgatcttggctcactgcaacctccgcctccccggttcaagcgattctcctgcctcagcctcctgagtagctgggatcataggcatgcgccaccacgcctggctaatttttgtatttttagtagagacagggtttcaccatgttgagcaggctggtctccaactcctgacctcgtcatctgcccgcctcggcttcccaaagtgctgggattacaggcgtgagccaccgcgcccggcccaatgtacatatatttcaaaacatcatgttgtacaccataaatatatacaattattaatcatatatgacatatgtatgtgtataaataaacaaatatatatatttgacaactataaaggtagaacttggaccagaatccaggtttcctgacccccccagtcataattccttgttaatgttaccaattacgaataatttttttttttgagacgaagtttcgctgttgttgcccaggctggagcgcaatggcgcgatctcggctcactgcaatttccggctcccgggttcaagcgattctcctgcctcggcctcccgagtagctgggattacaggcccccgccaccacgcccggctaatttttgtatatttagtagagacggggtttcaccatgttgaccaggctggtcttgaacttctgtcctcaggtgattcatcctcggccttccaaagtgcttggattacaggcgtgaaccaccgcgcccggccccttaagaagtcttcacattcctcttttacttaaggaattactgggcttcgtttctggagccttgtgagaagcattacactgtccccccttttttttttcttttttaaaattaattttcctgtaggaagcaagatcccatctgtcccttctttaggcaatgaagcttttttcacctttgcataaaagaacagctgagccccctttttaaattttcttttgtcttaccgtcccttgaggctagaagaggattctcaaggcacagagttgtgggccacaagaatccaggttgaggaaacggtgaaagtcctgagctgaaacaactaccttggggcattcaaggaacagcaaacagcaaaccgaccggcgagggtggcgggagctgggctggaaatcaggtgggagaaccggccagacgcccgcaggcgcggtacgcagatatcctggaatgcgctgggggctcttccctgggcgcggcttcagcaccccgcattccggtcccaccacgtccccacccacctggagaaggcggaggctgcactgagtgccataagtagtcgagaagggatgattttcaagacataccctctctttgctttcccccctttccaattctgccttgtctttttccttgttgtgggtgctggtgagggaaagcagtcaaggaagttggtcccaagaggggaatgctttcccttgggcgccaagaggcactgacgaggtgtcagagccttctgagggacagatgagactttggcccaaggccaggaagatgttttcagatgtgggccggaagacttgacaatgcggggtctccctcttttaaaaatatccatataatcaaagcctttgttgactggcccgctccggcccctcagtcctccacagatgcgccccagggccccagccccgaggtccttttcctaatatccgctcttgctctcgctcactctcctcaggtcgcctgctccgcccgctcccgctcccgatctctgattgctcctaactgacgtcactcccggtctgtccccgcccactcggtgctgccattggcagtcggtcgtgggtacgcggctcctgtgggggaggggggagctatgggagggggcgggaattcccgactctaggccggaagcgcgcggagaccatgtagtgagaccctcgcgaggtgagtgcgggctgtctggcagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtcctatttggaggcggctcctagtttcctagttttctgggggcaccaggtgaaagggtgatgagatatccatacagcctttctcatgcctcggtttcccccgtgcagtctccctgaataagtcacttgggaaagaaagtgtgagaagagaggaatgttcctggtacaggagtagatgagtcaccctgggtaggggaaggtcacaaagtggctggggccagggagctgcactctgctgaccaagcttccccattccttgccccatcttcctttgcatgatttttcccaaccactctggtctgtcttcctaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcaggtaagcctctccttttccccacactgctatgaatgcttggcttagggagggctctggggctggcggggagtgaccaaaggaggagggaaaggcaagggtagccattgtttgggttggggtggtcggccctggagggggtttgtttgcttattcccctctgtgcttcacccctacccagcttcccgccagaaagccctgagcctagtaagctgtttcgcggggggcgtctttttggccacttgtctcctggacctgctgcctgactacctggctgccatagatgaggccctggcagccttgcacgtgacggtgagcactggcctgggcatgtgacttgcgggaggggaatcacacacctctgggagtgttggtttgtggagattgattcatgtgccactccatgactgtgtggaagacttttggcatgtggtatgaattgtgatttttggttatggggcataattctttctatgtgttccctcccccttccccattccctgtgtgacccctacattcccgttgagacagtaagacactttttctcaggtgtgtgacttgctctatgggttctcagttctagctaccagcaagtgctccaagaatcatcttcactctctcaccactttcctaaagggctggagatagaggtctctgtaggcctgagaaggataggaagcgattccctgggtcttggtgttgctaacctttttaggctttggcccaaggaagtgggctgtgaggaatgatcaagtccacggcataggacttggtttattataggaaaaactgaggccgttggatagtggggcaggaaagtcatcctgggctctttccttttttcctctaaaactgaggaagtaacactggatgtatccctttgtgtgtctgtgactgagtgacctgtgtttccgtgtgactgcgtataagcctgaatgtcctgtgatatgtggctctatgtatgagtatttggggagatgggcaatgtgtgaccttttcatgtatgtctacatcagtgactctcaactaggagtgtggctttgcccctcaggaaacatttggtaatgtctggggatatttttagttgtcacaatggggagggggatggagggaacattgtgcctgctattggcatctggtaagtagagatcagaaatgctgttaaacaatctacagtgcacaagacagctcccatgacaaagaattatctggcccaaaatgtttttgtttgtttgtttttgttttgttttgtttttgagaaagagtcttgctctgttgcccaggctggagtgcagtggcacaatctcgactcactgcaatctctggctcctgggttcaagtgattctcctggctcagactcctgagtagctgggattacaggcatccaccaccacaccctgccaatttttgtatttttagtagagacagggtttcaccatgttggccaggctggtctcaaactcctgacctcaagtgatcttcccactttggtcttccaaagtgctgggattataggcatgagccactgcccctggccccaaaatgttaatagttccaaagctgagaaactttggtctacacgtaacactgtgagtgacaccataatctgtgtgtacgtatcattctgtgtcagtgttaccaattcactctatctttgtgtgactgagagtagccctgtgtctgtgtcagaccctaggtctgtgtaactgggctttcaccagattttgcatctcactcttccttccctgaacattttgctgctgcttctgcccacagctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtaca

SEQ ID NO: 35590 - DNA, 8966 bp, Homo sapiens
ggcaagacgcctcttcagttgtctgctactcagaggaaggggcggttggtgcggcctccattgttcgtgttttaaggcgccatgaggtaagtgggtcgaagcggtcgaaaggtttcaggtattcgacggaaaactttgtgaacgtgggccgaaagaagtcggagtatcagaaagggccatgtatccgggggctggccaaaaacctgagaactcctggtctaggatagtgggagagatggaggccggtagaggcggggaaacttgggcccgggatggggttcgggcccaggagtggggaggggggttcgacacctttgtctctgaagggttgcgatgagggggtgtcctcaagcccctggaggagctccccacctttcccccgcccccgtcatccgggctgagaatgctggagcgagccgcattcatcctcagtgcgaaggccttgacattaggacacgcccgataaatgtgtaccttagtgaagaaatgagcaatctttagcctccgaagtattaggattcgtgtggcccaggattatgggttattaagtgtagggctcactgagccccatcattacttgatgggggttggattaacttagaggaggttatgggggtgtaactgggcaccatttggaatggggacaagtgtaagtgtgagtggggtctcttgcctaccgttgggaggttccgagggatgaaagtagccaacctaagatgatatggccggtgggtattccttcaatgaggtcaaaataaaatctgcatttctaggggtgacagaggccgtggtcgtggtgggcgctttggttccagaggaggcccaggaggagggtgagtaccagcttttagcatctctgcacttggttgttagtttctgcttgtcatctaaataggagttttagagtagactaatgtcacttggttttgcgagagccaactgtggtcttttcctgcactcctgttaaatgaatttggccccactatgctaagaatgattctttccctccccggagactttgtcactcattctgaggactgacatgttttcaaaattgttggcgtgttatttacatctcgcttgattcctacctagggaataatttggctgtttttcatgttttaggttcaggccctttgtaccacatatcccatttgacttctatttggtgagtaccttgggttaatgatacacattttctggtcactgttgaaatggagcccagtatctcccagttaatgaagttagatggtggttgaagagggcagacacagtgcctcacgcctgtaatctcagcactttgggaggccgaggcagatggattacctgaaggtcaggagtttgagactagcctggccaatatggtgaaaccccgtctctactaaaaataaaaaagttggctgggcatgtgtctaatcccagctacttgggaggctgaagcaggagaattgcttgaacccgggacgcggaggttgcagtgaaccaagatggcaccactacaaaaaaaaaaagatggttgaaatagggagggaaagtgatttgtgaaaagatttggggttttgagtcaactgtgtgttgctttacatacagaaacagtgtaagcatggtggggagaataattccttggctactgttggcattaaacatgattataatctttgttctgaacaagtaattgtatttatggtatatctgttactataaagatagtgatagcttaaattatggctattccagcttttatccttgtttgaactttttattttttttgagacagtctcactctgtcacccaggctggagtgcagtggtgcaatcttggctcactgcactgaacctgggaggcagaggaatcaggacctctgcctccagggttcaaacgattctcctgcctcagcctcctgagtagttgggattacaggcacctgccaccatgcccagctaatttttgtatgtctgtttagtagagacggggtttcaccatgttgcccaggctgatcttgaactcctgacctcaagtgatctgcccacctcagcctcccacggtgctgggattacaggtgtgcgtgacccactgtgcctggcctttgaataaatttttttttttgaggcagggtctcactctgttgcccaggctggagttgcaatggcgcgatcttggctcactgcaacctcgcttcctgtgttcaagggattctctcacctcagcctcccaagtagctgggattacaggtgtgagccaccacgcccagctatcacctcagcctcccaagtagctgggattacaggtgtgagccaccacgcccagctaattgaacaaattaagcagtaaaaacaagtgtagaattttctgtttttaacctttttctgtcgtagtaatagaaaaaacaatctctcctgtatattatcttcggcaaatagaatgtagttgtttacttctggtttagtgtgaaatggcctttccccgggtcaagccagcacctgatgaaacttccttcagtgaggccttgctgaagaggaatcaggacctggctcccaattctgctgaacaggtatgttcttttggctgtcttccagaaatgtctctaaagcagttaaaagtattggtaaagagtaactgttggtaaggttaagaatggtgttaacagagcctgaaatccacaaagggtttaattgttctccttatttctcattgtgggtggagatagccaggtggatatataaacaaattacatatgcattcttatttttactggggacaaagagttgttctcttcccatatattcaaggccagaatgaagtgtttttaaagccctatgtcagtattgagtcagcttgtatggaagggattaggagaaaatattcaaattctgagaaattgcttataatttttcattttcaagtattgtttcatactgtttttcaggcatctatcctttctctggtgacaaaaataaacaatgtgattgataatctgattgtggctccagggacatttgaagtggtgagtttttgatgatttagttttaggaaagggcagctttggtagtgtggaaattgccttggctcttgacttttaattttcagttgtctattatccaaagccaagcctaaaatgagaaagtacagtggaatttctttgtagtactgatcttggggacaagacttgtatcattgttatgctagctgtgatgtatcaggctttcatgtggtggttttgggggtgatttcacctctgctacttcttaatttgggtaacaggtagctgtgttgtaacagttctgggaggacctaggcacctttttttcttctaaattgtttttccccgaaatcctttttccaacagcaaattgaagaagttcgacaggtgggatcctataaaaaggggacaatgactacaggacacaatgtggctgacctggtggtgatactcaagattctgccaacgtgtgagtgtgcctgtttctggtcatgggaacagaacatagcacttggattaggggtttaggtatctttttttgttttgagacaaattctccctccgttggccaggctggagtgcagtggtaccattgtagctcactgcagccttgacctccactacagcaagtgatcttcccgccttagcctcccgagtagctgggactacagatgtgtgctaccacacccagctaatttttgtattttttgtagatacagggtttcaccgtgttgctcgggctggtctcaaactcctgagctcaagcaatctgcccacctcagcctcccaaagtgctgggattacaggcgtgagccactgtgcccagcccttacggatcttgaaagctcaaatttcttgtgagaaaggatgtttgtaagacaaatgtttctagtttttgtttttgagacggatctcactctgttgccctggctggagtgtaatggcgtgatctcggttcactgcaacctccacctcctgggttctagctgttttcctgccttggcctcccaagtagctgggattacaggcaagtgccaccatgccaggctaatttttctatttttagtagagacggggtttcaccatgttagctagtctggtctcaaactcctgacctcaggtgatccgcccgccttggcctcccaaagtgttgggattacaggcgtgagccactgcaccctgcctgacaaatgttttttaatgagtgataagggacaaacgctggagtgtgtgtgtctgaaagaatgtatagcaggttactgtacggccatgtttctcaactggaggtaattttgccacccaggggatatctggcagtatctggcggtacttttgattgttaaaacaagggggtgctactggcatcaaaaaagggtagaagccaggtgtggtggctgtattcccagcactttgggaggctgaggcaagaggatcacttgaccccaggagtttgaccagcctgtataacatagagagatcctgtacctacaaaaagaaaaaaattagctgggcatggtggtgcatgctttggtcccagctactcagaagcctgaggtggggccgggtgcagtggctcacgcctgtaatcccaacacttagggaggccaaggcctggagttcaagaccagcctggccaacgtggcaaaacccagtctctaccaaaaatataaaaattagccaggcgtggtggtgggcgtctgtaatccccactacttgggaggctgaggcaggagagttgcttgaacctgggaggcagaggttggagttagcagagatcgtgccagtgcacttcagcttgggtgacagagtgaggccctgtctcaaaaataagaaaaaaagaaaaaaaaagcagcagcctgaggtgagaggattgcttgagcccgggaggctgaggctgcagtgagctgtgattgtgccactgcactgcagcctgggtgacaagagtgagaccctttctcaaaaaaagaaaaaggatagaggccgtggatgctgttaaacatcctacatccccatcaccccaaagatttgtctagcccaaaatgttattaactgccactgacctgaaaaaccctgctgtagaaagaggatatgagtacaggaggggtcctgttccctgagtcttccaatttttctgcccaggccttggctttctcttataaaagtatatattctattacttacccttgcttcagccttggatatgggacagaaatgagagtgcaaagtagcttagagatacatagaaagtctaggcaaataaattattataacattatgtcattttctgtcaattagtggaagctgttgctgccctggggaacaaagtcgtggaaagcctaagagcacaggatccttctgaaggtttgcatttgttgctgattctgtatttagtagccataggaaccaggtcttgtaattgtaagtacactttcaacaaaatcagatcagaccagatggaagagtaaatgcagagttttatgttgtgggagtttttggcaggggcttcaggtgttcaaggtgttcaagggagatctgtttgatctcccttctaaagctctgtattctaaattctcattctggactttgtgctgttttaaaaaatccacctgttcccccccaccctggatttaactttgatcatctaatggaaatgtgagttatagtttttgtttattctgttttttcagttttaaccatgctgaccaacgaaactggctttgaaatcagttcttctgatgctacagtgaagattctcattacaacagtgccacccaatcttcgaaaactggatccagaactccattgttagttcttttttttccattgctggaaaatttaggggatattcaaaacatggtattgttgctgtttagtttacttagcttgttgctattccacatgcagcttcctgggaattgaagaacttaggtttattctgaactttgctctctccctctgtaatttggaaatagtttatcagcttgctagtggaattttcagatggggtgaccaagaaagcatttggaggacttaaaaaggactgagaaaatatttatggagggggataggcttttgaagaaaacagatcttgcatgtttctagtgatttttagacaagtgatttgctgatatgagaaacacagggtggcttaaagaattgcagagttggtcgggtgcggtggctcacgcctgtaatcccagcactttgggaggctgaggcaggcagatcacctgaggtcaggagttggagaccatcctggccaacatgatgaaaccccgtctctactaaaataaaaaattagtggggcatgatggcggttacctgtaatcccagctactcaggaggctgaggcaggagaattgctcgaacccgggaggcggaggttgcagtgagctgagatcacgccactgtacgcaatccagcctggacaacagagcgagactccgtctatcctgccctccttccaagtttttaagactgtagcagtggtaatgagtagcttgtttaatgaaaatgtttcatcctggcatatcatgcttgtctttttagtggatatcaaagtattgcagagtgccttagcagccatccgacatgcccgctggttcgaggaaaatgcttctcagtccacgtgagtccctctctaaccatttggattaagataaactttttaactgcagtgaatagcaggatacccccatacttcctctgacagaactattttgcctgtgacctcgtgtctggatttttatttttaccttaaggaagcaaattaagatttagagaaagcagagaatgtatagttctggaaatagcatagtcagcttcaattctaccttaggcatggaaatacatgatcgtattgattttaatgtttgggtcactattactttcagagttaaagttctcatcagactactgaaggacttgaggattcgttttcctggctttgagcccctcacaccctggatccttgacctactagtaagtaaagatgggcaattggagttcctcatcatccttatttactagtagtagtagtagtagtagtagtagtagtagtagtagtaactctgaaattcaccagagtctgaaatttggtgaagcttaaaagaaattttattggtagacaagtaatccaataaaaattcaacatttacatgactcagagacatttgtttaaaaaaaaagaaaaaattcaaagtttttttttttttttgtatattcaatgaaatgagtagttactgagttatagtgtcccgttttcttctcatgactgctaccatttaatcatggtagtagagagaaatgagtgagcagccatttcagaattgcttctgaacatgaaaattttggctagacttagaccttaatgaccagttttcctcgtgatcatttaaggttttagtttgatgcctgtaatcccagcactttgggaggctgaggccagaggatcacttgaagccaggagtttgagaccagcctgggcaaaatagcgagactctgtctctacaagagaaaaaaaaaaaaattagccagttgtagtggcttgaacttatagtcctagcttctcaggaggctgagtcaggagggttgcttgagcccaggagttcgcggttacagtgaactatgattgcgccactgcactccagcctggatgacaaagtgaggccctgtctctaaaaaataaagttctagttatcagaagtgccattttgatggcacacctactggatttattatttttcagggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgaccctagaacagcaggtattgggacagatatgaactgagttgttttgccccactcttttgaatactgctgctcagcaggcaaagcggaatatggtctttacgggtcaggaatttggggattctgaaagactttggtcctgagatttaaaaagctgtcttaatctctgttttcagaagggtattactcaaataaggtcctttgattttccttgcttactctcactttgctttccttcaggacatggtctgctatacagctcagactctcgtccgaatcctctcacatggtggctttaggaagatccttggccaggagggtgatgccagctgtgagtgaccactgtgggtcaggggttttgtattgtaatctggtacagagaagctgtacactacttaaatgtctttaatatttccacagtgtaagtaatgacttttatgctgggctactcgtctaaatcacctttttctctttcctagatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagta

SEQ ID NO: 35591 - DNA, 1373 bp, Homo sapiens
gttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcgggtgagggccgggacgggtgagggcgagggaagcgtcttgggctgggtccagcggcgggtgagggcagagggtatagacagacctagctggggccctgcgcctcccacctctgtgtctcattttgctggttctcctccagctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacggtgggcttccgcccgaacaaggccacctagcctgctgtcaaaactttcagccacatcgtgcttttcagcgttctcttccatttgctcccctagtcgctcttctgtgtttgccctctgctcacccaaactgtgagcttcctgataatcaggcctatccatttccctcaccctcctcccgctctgctgacagttctcttaattgatttctcagatcccagatgcagtgactggttactacctgaaccgtgctggctttgaggcctcagacccacgcatgtgagtaaacccagggcaggttagttttgggtgcttgtgcagtatgttgtccatctccttctcatctaagttttttctctctagaattcggctcatctccttagctgcccagaaattcatctcagatattgccaatgatgccctacagcactgcaaaatgaagggcacggcctccggcagctcccggagcaagagcaaggtgtgaggggaggcttaatgaatcagtaattaccttccacaacagtggaggcttatcctgccacccctttggggaaactgaatcgtaggggaggtgtaagacttactcagggtcacccatctgggattgaagtccgggattcctgtgctcagttggtgctcttccctcttccctcaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggc

SEQ ID NO: 35592 - DNA, 52946 bp, Homo sapiens
gtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgaggtgagcggaagggttccctccaggcgccgcggggccccaggcccgccagcccggtactcttccggccggcaggccgccgcaccgccgcggccgcgccccaccggctgctcgtggccgagccgcccctggcccctgacccttgacctgactcccagcccgggccccgcgccccaagcggcgaccccgcccgcgcagtccccggaagcgcgcccggtagtctcctgtgccccttcccccgcccggccgggcctggtggagcccaggctgcccgcctgcccgccctcggtccccggagcttcctctcccagcggcgccgggcagggcgggggctttgggccgggccccgcgaccgcgcagtgtagccggccgctgaaagcgcgcgtggctgtcggagttgaaatgggaaagaaactctttacaactccattttgctttttacgtttaacgagaaacgacaatcactgtttcatattgattaaagtccagttacactttgggtaggttttcttttaatgcagacttgttggagactgtgtaagtaagtaaaagattgtattgaacgcttaggggtatgatctacggccataccacctggaacgcgcccgaactcgtctgaaagctttggggtctgttttgagtggaaaaggggtattttccatttggaaaaaaaaaacaacacacaaaactgtaaatgatttaagcgatgttgcatgaaaatagatgcaatgttgcttagtcgaagtcgctgtattgattaggaatgatctaaatatctgtaccttagttactgattggatctacagttacgggtcgtcttcattgaatagcgctattcgcatccaagttgatttgttcacaaaccttgtttagtagtttacggtggaaaattggaatcctttttacctcaaagttggttccacttgtgttttttaatagttctgattttaaatttttacctctgttgttgacttgtttggttctgtcttgaagaaagtcttaaacgtttcttgcaggtgtgtaagtagatatttcactctgcctttctgaaggagaaaaattgaaaaaccaaaaaacttccataatttaaaatgttgtatgtggagagaatttttcaaccacttagtatcacccagatgtgtaatgtgtaccatgcggatgattgtcaccttagatgtggctagattggcggagatactgttttgagcatttggcacaagtgacattggactgaaaaactagtttttaattgtaaagaatgacttattgaaggatctctggataacttgtcttaattggttccatctacttttgtggagcactgatggctcttggggacattaaatatataaggtgcaccttggtttgagttaaagtctagtgctagatttatcctctctgttctcataaaaatctgtgttggagggaagaagagagtaggaatactgtgtagttcttgagttttagatctaagaggaatctttcaggactggttgtccaaccccatttgcagatgagcaaactgagtcccagagacttaagtaaatttcccaaggttacctatctagtcaggagcagaccagaactgtctgctctgttaaggtattctccatttactcccaagcagttggcctccagagtcagctaaaattcaggacttctagcttattccattgtttcttcttttaaaccttgttgatggtgaatagtttgggagaaactgttcatttgccaaaaaatttcggttcattagcttacacagcactctccccttgttaactggatggtcctgccttcaattgagggagatagatgaatgtacgagggtccctggttggcctaatcatggctttgtttggatttttttttaagggaccaacttctagagcaaggcctacactttactgcttcaaaaccaagatatttaggtcaggctaagatatttttagttaactgtgggcacttttgactgttgatttggggtactgcgtgtatcaagtaaacaattccctgtgcacatgcatgtggtggtggtggagtattttcgtagtcctgatttctttccatttgtcagttaactgctttttaaaagtttattctggtcatatgggggtgtaagttattaggagagtaaaaacaggtagctcttcaggtgtttcttgtccatggggtggagtccatgcagtgactggagaaggtgctagtttgcgtctttttaattgtcttagagagctgagagatatatgttaactctgagaagaaagactgatcagcttctaagagagctaatttgaagctgctggccttctgtagacagcaccttgggtttaattgcattgtggttactagtgattatgataaatagtacatagtcactggattttaaaattggccatatagttgtagttttatatttatttttatttttgaaatggagtctcactctgttgcccaggctggagtgcagtggcgcgatctcagctcactgcaccgtctgcctcctgggttcaagtgattctcctgcctcggcccctggagtagctgggactacaggcacccaccaccattcctggctaacttttgtatttttagtagagatggggtttcaccgtgttggccaggctggtcttgaactcctgacctcaggtgatccgcctgccttggcctcccaaagtgctgggattacaagggtgagccaccacgcccacccatatttgtagttttaaaaggatcctggcagggcgcggtggttcatgcctgtaatcccagcactttgggaggccgaggcgggcggatcacgaggtctggagaccatcctggctaacacggtgaaaccccgtctctactaaaaatacaaaaaaaattagctgggtgtggtggcgggcgcctgtagtcccagctgctctggaggctgaggcaggggaatggcgtgaacccgagaggcggagcttgccgtgagctgagatcgcgccactgtgctccagccagggcaacagagcgagactccgtctcaaaaaaaaaaaaaaaggatcttaagtattttgtctgactctgccatttagtttattcctttgtttacctgcccaatggaactgtttgcttgtaactacacattaatataactaaattttgaacttaatgttacatgccttgctatacatggggctctttggggacatgctcatttgtgggattaaaatttccaagacggtttgaagtttgtaattactataaaatccctcatctttaatctgtggagctgtagtattaagtgaaggccttggtatgttcataattacgatagtcatgtgactgaaaatcaggcactgaagctgctcgttctgggtgttggtctcagtttattgatgcttcatccaaatacatttttatagctaataataaagaaaaacatcaaatactcttgctaaattgcaatcagtatgcagtttatgccaaacttagcttgattttattttttgaagaggatgagtatgtatatttaagcatatgtgtgtgtgtgtatatgtatatatacttgtgtatacgtatatacgtgtatacgtatatatatgtgtacatatacgtgtatacgtatatatatgtgtacatatacgtgtgtgtatgtgtgtgtgtatatatatatatttttttttttttctcttttgagactgagtctcactctgtcgtccgggccagagtgcagtagcgccatctcggctcactgcaaccgccgcctcctagttcaagtgattcttgtgcctcggcctctggagtagttgggagtaccagcatgcgccactgtgctcagctaatttttgtatttttagtagagacggggtttcaccatgttggtcaggctgttctcgaactcctggccttgtgatctgccccccttggcctctgaaagtgttgagattgcaggtgagagccactatgtctggccatatttaagcatatttatgatagtatcttaaatttaagtgaagggaaagaggaaaacatacacagccaatgaagtaagtttgaagtggagtgaaaggaaaagttggaggtaaaaagaggttagagaggtgggcaggggccaaatcatatagggcctttaggacatgggaaattctttggatttgttctgagattagaagtcatttagatattctttagaaagggaatgacatgatctgatattaaaaaaaaaactagaatcactgtgagtaggagtagatctaattccattctgactaaatagtaaactaatatgataatttggacaaatataaaaaggaattcctggctgggagcagtggctgatgcctgtaatcccagcactttggaagtgctgggcaggtggatcacttgaggtcaggagtttgagaccagcctggccacatggtgaaaccctgtctctactaaaaatacaaaacattagctgggcgtggcagcaggcgcctataatcccggctattcaggaggctgagataggagaatcactttaacctgggaggcggaggttgctgtgagcagagatcgagccattgcactccagcctgggagacggtgcaagactcaaaaaaaaaaaaaaaaaaaaaaaaacggaaaggatttcataatattaatttccttgacttagtgacttctgcctattttatttgaagtcattggttcttctcttctcttctcttgagacagggtctcactgtcacccaggctggagtgcagtgagtgatctttgttcacttcaacctttgtttcccaggttcaagcgattctcgtgcctcagtctctagagtagctgggactacaggtgtgtgtgtgtgaccatgcccgactaatttttgtatttttagtaaagacgggatctcaccatgttggccaggatggccttgatctcttgacctcgtgaccccgtgacccacccaccttggcctcccaaggtgttgggattacaagcatgagccactaaggatttgtttttaaaatttttttgctttatttttttcttctctttttttgtactagagatggtgtcttgctatgttgcccagacagatcttgtactcctgggctcaagttgtcctcctgcctcagcctcccaaagtgctgggattaaagatgtgagtcaagcgattctcgtgcctcaacctacccactagctcgattacaggtgccatccaccacctgcccaccacccttggctaatttttgtattttgtattttagtagagacaagaattttaccatgtcggccaggctggtctcaaattcctgacctcaggcaatccacccgcctcagcttcctgctgggattacgggcgtgagctaccctggccaagatttttaatttctgaagcttatagctgctctaaagcacaaggattcagtcccatgatttaaaaaagttgcttgttttgacttcaagtatatggttgagcattctaacttttgttatgtatacatttttattttactgtattcttctagccattgtatcctagtctgtatgttgcagatgagttgtgattctctggtgtctcttccatggacctagagatcatatgctctactactgggatttttttttgtaactttgtttgggatataggctttgagaggttaaggaagtaaatttaagatggatatttaatgttgtaacactttgttaatgcttttttctacaagataattttattatgtgatatggcagctttgttggaaatacctgtttttttgtgtgtgtggaaaatttcttttctggatgaaatctcttgtttaacttttccagttattcataatgaagctctgtttatcttttgaagatcttaagttcagaaacagaaggcaggctgcgtatggtggctcatgccagttatcccagcactttgggaggccgaggtgggtgggtcacctgaggtcaggagttcgaaaccagtctgaccaacatggtgaaaccccatctctactaaaaatacaaaaatcagccgagtgtattagtgagtgcctgtaatcccagctactcggaaggctgaagcaggagaatccctcgaacttgagaggcgcaggttgcagtgagccaagattgctgcactccagcccgggcaacagagcgaaactccgtctcaaacatacacacaaaaaaaagaaggaaagaaaaggcagtagagtatcttatttaagagcatggattctggagagaaactgacagttaaatactagctctgacacttgatggcttgagacccttggcagtagtatgtctcctttgtaattcagtttttttcttctgtagaaagggaatggtaaggaagcgccatgagatttcagtgagagagaagcacttacctcaagtgccagacatgtagcccttcaactaacttattttatttatttattttttgagatggagttttgctcttgttgcccaggctggagtgcaatggcgtgatcccagctcactgcaacctccacctcctggattcaagtgattctcctgcctcagcctccccattagttggggtttacaggcatgtcaccatgcccagctaatttttttttttttttttttttttttgagacacagtctcgctctgtcacccaggctggagtgcagtggcgcgatctcggctcactgcaacctccgccctccgagttcaagcagttctccttcctcagcctcctgagtagctgagactacaggtgcccgccaccacgcccggctaggtgttttttttttttgtatttttagtagagacagggttttaccgtgttagccaggatggtcccgatctcctgacctcaggtgatctgcctgcctccgcctcccaaagtgttgggattataggtgtgagccaccgcgcctggcctactttttttattatttttttttttggagacaagagtctcgctctgtcgcccaggctggagtgcagtggcgtgatctcggctcactgcaaactctgcctcccgggttcatgcggttctcctgccttagcctcccaggtaaactgggactacaggtgcatgctgccacgcctggctaatttttttttttttttgtattttagtagagacggggtttaaccatgttgcccaggctggtctccatctcctgagctcaggcaatctgcctgccttggcctcccaaagtgctaggattacagccgtgagccaccgtgcctggccttctggcctttttttttttttttttttttttttttgagacggagtcttgctctgttgtctaagctggagtgtagtggcacaatctcggctcactgcaatctctgcctaccagggtgcaagcgattctcctgcctcagcctcccaagtagctgggactacaggtgcgtgccaccatgcccggctaattttgtgtgtgtgtgtgtgtgtgtgtgttttactagagacggggttttactttgttggccaggctggtcttgaactcctgaccttgtgatccacctgccttggcttcccaaagtactgggattacgggtgtgagccactgcgcctggcttttttttggagagataaggtcttgttttgtcatctaggctggagtgcagtggcacagtcatagctcatggtggcctccaacttttggtgtcaaggtatccttacgcctcgtcctccctagtagctgggactacaggtgtatgtgccactgcgcccagctaatatttttacattttgtagagatggagtcttgctgtcttgcccaggttgggtctcagactcctgggctcaaacagtcctcccacctcagactcccaaagtgctgcaagtacgggcatgagccactgagtccagctatcttcaactttcactattcaggttacagtttgtagtaccttttttcgggggtggtgggagggtagtgggagtagcaccctaagatttcttggaataaaacagggcttactacttggttcctggtacttaagaacagtggttcctagactccactgttcccaaacttggaatccagttccccaaattggaatcacctgaggtttaattaccttcatggaggtttaatttgcatacaataaaatgcacatactttaaatgatagtttgataatttttttgttcttattttttttagacatagggccttgttctgtcacccagctgaagtgcagtgtcggaatcatggcttactacatcctcgacctcctaggcccaagaattctctgctttagcctcccgagtagctgggactgcaggtgtgcaccaccacgcctggctacatttttattttgtaatttttttttttgtagagagaggggtctcactatgtgctcagactggtcttgaactcctggccttaagtgattctctcgtctcaacctcacaaagccctgggattataggcatgagccaccacaaaccgccagtttgataaattttgatgaatgtgtatacccaagtaattgccactcagtcgagttaaagagcatttcctcaaggctttaaatttttatttttatttttgagacggagtcttattctgtcatctaggagtgcagtgccgcaatcttggctcactgcagcctctgcctcccgggttcaagtgattcccctgcctcagcctcctgagtagctgggactacaggtgcgtgccaccacacccagctaactttttgtatttttagtagagatggggtttcactctgttagccaggatggtctcgatctgatcttgtgatccgcctgcctctgcttcccaaagtgttgggattacaggcgtgagccaccgcgctcggcgggtttctttttttttttttttatgagatggaatctcgctctgttgcccaggctgcagtgcagtggcacgatctcaactcactgcaacctccgcctctcgggttcaagcgattcttctgcttcagcctcccgagtagctggaactacaggcacccgccaccacgcccggctaattttttgtgtttttagtggatacggggtttcgccatgttggccaggctggtctcaaaggcctgaccttgtgatcctcctgcctcggtctcccaaagtgctggaattacaggtgtgagccactgctcctggcctaaagttttttagactagtttttttgttcattcgttttatttgcttggcttcctagaatatgacaagttttggtttgtttttgagacagagtcttgatctgtttcccaggctggagtgcagtggtgctatcgtggctcactgcagcctctaactcttgtgcccaagtaatactcctgcctcagcctcatgagcatctgggactacaggcaagcaccaccatacctagttaattaatttaatttttatagagatgacgttttgccatgttgtccaggctggtctctaactcctgagctctggcctcgcaaagtggtgggattataggtgtgaaccactgcacccggcctagttttttattttaagaaatatatatacttggtaaaagtaaactcctgcaataaggtttacaataagcatatataaattcttagccagctcactgggaggtacctaatggttcatttttctttgtcagttttactagatacgcattgtcttagaggcaatgtaagtttggaattaggccaaacaaagtcaaatcctgattctgtgcatccattgaaggttaaccttataatatttacattttgagataaatgatttcatgctcttatttaggaaacttgacggtatgttacctcagggattgttccttgcctgtctttccccaaagaacttgagtttgaagtgattttcacttggcagtaaattgaaggttttcttcattgcttaccaccatgtgccttattcctgctgctcttgatctccaagtgcccttactgctacagaaaggaaagctcttgaactaagagcttggcagccacttgatcaggatggccaaataatggcagtacaggttgagcatctgaaatgcttcaagatgggcgctggcatgacattcaaaggaaatgcctagtggtgcctttcagactttcaatttttggatttgggatactgaaccagtaagtataatgcagatattccaaaatctgaagaaattctgaaatctgaaacacttctgggcccaagcattttggataagcagtactcaacctataccaggctcaagttcattatggacagatggatggatggtagtttggccctttcatcaggaatttcccatgcagtcagtaaacaaaataaacagctctatgttttcaacttcatttccccaattttttttttttttttttgagacagagtttcattcttgtcgcccaggctggagtgcagtggcccgatctccactcactgcaacctttgcctcccagaggtttcgccatgttgcccaggctggtgtcaaactcttgggctcaagtgatccatccgccatggcctcccaaagtgctgggattataggcataagctaccttgcctgtccgttttcatatttttttgagagatgaggtctcactgtattgcccagactggtctccacctcttggcttcaagcagtcctcctgcctcccaaagtgctgggattgcagttgtgagccaccacacctggtcaggagttttacatactatgcgttgttacttgtaggtcttgtttggaaagaagtaacttcctaaggtcaattcagaaaagaagggtagtaacttagaggaagtaaatttgaaggccctagtgtctaatattagtaatttgggcttttgaaagtttcctttctaaaaggtaggaaattaactcttttttttttttttttttttgagacggagtctctgtcgcccaggctggagtgcagtggtgcaatctcagctcactgcaagttctgcctcccgggttcacgccattctcctgcctcagcctcccgaatagctgggactacaggcgcccgccactatgcccggctaatttttttgtatttttagtagagacgggatttcaccgtgttagccaggatggtcttgatctcctgacctcgtgatccgcccgcctcggcctcccaaagtgctggaattacaggcgtgagccaccgtgcccggctggaaattaacccttttatataccatccccccacctcacctttttggctacaatcttgctctgtcacccaggctggagtgcagtggcatgatcatagctcactgcagccttgaactcctgggctcaagggatccagctacctcagcctcctgagtagctaggattacagacgcatggcaccaagtcctgatacagtcttctctgtaccagaacaaagtattcagtgattcaagctcacataggcatgaaacagcactgaaagacgaagtgctgtaggagttcagggataaagaagaatttagagtagccaggaagccactgaggcctctggtggtgagggtgtaactcttggcctttaaaatgaggtttaggggaaatgttatgagtagtgggaatcaacccttggcctgaacacagataatcttgttttatctccttatagaaacaggaggtggtggggggtggccagttttggttagactagggaagatgttgggggagaggggggcagtatgcttctgtagtttcgttttttttgtttttttttttttttgagatggagtctcgctctgtcacccaggctggagtgcagtggcgcggtctcggctcactgcaagctccgcctcccgggttcaagcgattctcctgcctcagcctcccgagtagctgggattacaagcacgtgccaccatgcccagctaatttttttgtatttttagtagagacgggtttcaccttgttggtcaggctggtctcgaactcctgattcgcccacctcggcctcccaacgtgctgggattacaggcgtgagccaccgtgcccagccgtttctgtagtttcttgagttcagattccaagatggatttttgcatatgtattgctttatttcttacccccttgatgtaatctactatataaatcttttaaagtccctacatttaaaaatttatcttgttcgaaaacataatagttttatttggtaaattcaaacagtgcaaaaggatatatggcccctagaggtacctgttgtgtttcttgtagaccagtgcatgtaatcccagcacttggggcagctgaggggagcccaggagttctaggccgcagtgagtcatgatcactccactgcactccagcactgcagcctgagtgacaaagcaagaccctttctgggggaaaaaaaaaaaaaagctcctgtgtactattctagagacagtctatacatataccagtgtctattggtgaatattgtacacctctgtcaagccctgttttgtatatctatgtatcccgccattacactatggtatgatagcatatgacatatttggcacatcacttttttcatttaataatcttgtctcagagatcatttgttaacacactttttttttttttgagacagagtctcgctctgtcgcccaggctgcagtgcagtggtgcgatctcggctcactgcaagctccgcctcccaggttcacgtcattctcttgcctcagcctcccgagtagctgggactacaggtgcccgccgccacgcccagctaagtttttgtagtttttagtagagacggggtttcactgtgtcagccagggtggtcttgatctcctgacctcgtgatctgcctgcctcggcctcccagagtgctgggattacaggcatgagccaccgtgcccagcctttttttttttttttttttttttttttttttttgagacggagtcttgctctgtcacgcaggctggagtgcagtggcacagtctcagctaactgcaacctctgcctcccgaggcagcaattctcctgtctcagtctcccaaataactgggattacaggcgtgagccaccagtattaaagccctgtaataatactgtaatactcagacagcaaaattcttttttttttttttttttttttttttttttttgagacggagtctcgctgtgtcgctcaggctggagtgcagtggcataatctcggctcactgcaagctctgcctcccgggttcacgccgttctcctgcctcagcctccagagtagctaggactacaggtgcccgccaccacgaccagctaattttttgtatttctttttttttttcttttagtagagacggggtttcatggtgttttagccaggatggtctcgatctcctgacctcgtgatccacccgccttggcctcccaaagtgctgggattacaggcgtgagccaccgcgccctgccagcaaaattctttaagcccccactggggcttaacatctattgatgctactgcctaccctttcactgctccttacctttagtttatcactgtaattacccccttttatgtattctccatttcttgttctgtctctcattttatgttacctggcaaaatctcagccctggtttagatcttactttttttttttgacaaagtcttgctctgttacccagggtggagtgcagtggtgcgatctcaaggctcacagcaacctccgccttctgggttcaagcaattctcgtgtctcagcctcctgagtagatgggaccacaggagcgcgccaccacacttggctactttagtagagatggggtttcaccgtgttggccggggtggtctcaaactcctgacctcaagtgatctgcccacctcagcctcccaaagtgctgggactataggtgtgagccaccacgcctagcctaaatcctactctttacctattctgtgcttttgactgaatgtagcgaaagaaaaaattcactgacttgtctctctttgaactcatggacccttgacctcaaaggtggctgcttttagcactgcctagcagtcccgctaagattccttagtccgtttattctcctgcttttaggataatatagcaccatgtcctttggctcaaatctcctgttccctttccttgcctctatcagctgttatgatcttgcttcttacttatttttctattcctgtggatcagtcccttgggagtccattgttctatctaaggtcagcccttccacttgcaagcgaaatctcgttcccctctaatctcgtaatgttgctctagcagttctctgctctcctgcatcatcattttctgcatacagtctgttggtcagatcttaataccccacctagctgcagtgaatgctgggaaatgtagtctttataactggcagccatgtgactatgaaggggaaagctattgaggcagataagcaggcagtctctgccatactttcaacgcttattttttttaaaaaaacaaaaaccaactcttttggtaacaattttactgagatataattcatatatcacaccattcatttgaaatgaacagtttggtgggttttagtatattcacagagttttacgtgtatcactacagtcaattttagaacattattatcacctcaaaaagaaaccctatgttcttcaactgtcatcttcaatctccctatcaccacgcccagccttaggtaaccactaatctactttgtgtctctatagatttgcctattctggatatttcgtgtaatggaatcatatattgtcttttgtgactggcttctttcatttatgcaatgttttaaaggttcatccatgttgtaacatttattttctgactttttttttttttttttttgagacaggattttgctctgtcacccaggctggagtgcagtgtctcgatcactactcactgccactttgccctcctgggcccaagcgatcctgccacctcagcctgcagagtaggtgggaccacaggtatatgctaccacgcctgggtaatatttttattttttgtagagacaagctctcaccatgttgaccaggccagtcttgaactcctgggctcaagtgatcctcccacctcagcctcccaaagtgctgggattataggcatgagccaccaagcccaggctgactactttaaaaaaattttttttagtaaagatgtggtctcactatgttgcccgggctggtgttgaactcgtgcttaagcagttctcccacctcagcctcccagagtgctgataactgcacccggcctgactttttttgtgtgtgatgttttgctcttgttgcccagtctggagagcagtggtacgattttggctcactgacacctccacctcccaggttcaagcgattctcctgcctcagcctcccgagtagctgggattacagacgtgtgccatcatgtccggctaatttttgtatttttagtagaggtaaggtttcactatgttggccaggctggtctcgaactgctgacctcgtgatccgcccaccttggcttccaaagtactgggattacaggtgcgagccaccgcgcccaactaattttttgtatttttagtagagtcagggtctcaccatgttggccaggctggtctctaactcctgatctcaaatgatccatcctcctcagcctcccaaagtgctgggattacaggcgtgagccaccaggcctggccccgggctgacttcttgaaagaacattttccaccacatatctcagtgcccacgttttctcaattcactgccatctactcttgcctgtggctatatgaaaaggttttctcctgttgctggacacctcctcatagacctgtgttctttttgcaagcatgtagtttggactcttttcttgtaatgtgttcttccttttttcttggtgttcattatcatcatacctttttgagcatttcagttatttctggcttcttcatgaccaccacttcctttgtgttggtggcactctttggctagatcactgcccctctccattccatacactggaagactatgctgtttttacctgtaataacagcttacctgggcactgatatttttcagctgactgtggggaaatgtttgtgaggtttggaaaacgcctccttagattgtgcccattccacctccccttccattagggttctttcttttgggcaccctcatacccttgccatagttttctcatccctatccagttaaccactcaatcacttttcgtgccctgccaaggctctgtttcttcctcttctttttttttggagacagagtctcgctctgttgcccaggctagagtgcagtggtgtgatcttggctcactgcaacctccgcctcctgggttcaagcgattctcctacctcagcctcccgagtagctgaaattataggcgcccaccaccacgcctggctaatttttgtatttttagtagagatggggtttcaccatgttggctaggctggtcttgaactcctgacctcaggtgatctgcacccctctcagtctcccaaagtgccgggattacaggtgtgaacagccgtgcccggccaggctttgtttctctattaattacagacctgattgtgctggtccagtggctttcccttccttacagaatagaatgcagattgctctgcatgacataccatatcctctggtctaaccatcgccccatctttccacccttattttcaaaaatctcctttctgaattctttttttttttttgagacggagtcttgcactgtcgtccaggctggagtgccgtggtgcgatctcggctcactgcaagctccgcctcccgggttcacgtcattctcctgcctcagcctcccgagtagctgggactacaggtgcctgccaccacacccggctgtttttttttgtatttttagtagagacatgatttcaccgtgttagccaagatggtctcgatctcctgacctcgtgatctgcccgcctcggcctcccaaagtgctgggattacaagcgtgagccaccgcgcccgaccgccaaattcttgtgttactggtcattgaggttatttgctcaagctgtttcctcaccttagaaagtattcctgaaccatcgttaccgctctttccaggggacttgtcctccttcttcaaggtccatccaggtcagatatcatcttatctgaagctctctggcagaatcacttgccttttctctgagttcataccagagaagataagcttttgttacagcacttaattacattgtgctgttttccctgagtgttttccagataaagctgtatctctagtagctagaacaaggaatggcccatagaagacagtggtttgtggccggatgcagtggctcacgcctgaaatcccagcattttgggaggccgaggcaggtagatcacttgaggtgaagagtttgagaccagtttggccaatatggtcaaaccccatctctactaaaattacaaaaattagctgggcatggttgtgcgcacctgtaattctagttactcatgaggctgatgcaggagaattggtggaacccgggaggtggaggttgcattgagccaagatcatgccactgcacttcagcctgggcaacagagagagactctatctcagaaaaacaaaaacaaaaaagtggtttgtatgagaccagtcggggcaataagaattgagacaaggagctggatgcagtggctcacgcctgtaatcctagcacttcgggaggctgaggcaggcagatcgcgaggtcaggagttcgagaccagcctgaccaacatggtgaatccctgtctctactaaaaatacaaaaattaggccgggggcggtggctcacacctgtaatcccagcactttgggaggctgaggcaggcagatcacgaggtcaggagattgagaccatcctggctaacacggtgaaaccctgtctctaataaaaaataaaaaaattagccaggcgtgttggcgggtgcctgtagtcctagctacttgggaggctgaggcaggagaatggcgtgaacccgggaggtggagcttgcagtgagccgagatcatgccacagcactccagcctgggcaacagaggagactccatctcaaaaaaaaaaaaattagccaggcgtagtggtgcatgcctgtaatcccagctactcaggaggctgagacaggagaactgcttgaacccgggaggcggaggttgcagtgagccgagattgcaccactgcactccagcctgggcgacagagcgagattctgtcacacacacacacacacacacacacacacacacacacacacacacacacacacagagagagaatttgagacaagggacctgtggtcctaactgttcttgaggctgagcctcttaaaaaaaaaaaaaaaaaaaaaagccagtgcagtggcctacacctgtaatctgagcactttgggaggccaaggcaggtagatcgcttgatcccaggagttggagacccgtctggcccatatgatggaaccccatctctacagcaattagccaaacgtggtggtgtgtgcctgtggtctcagctacttgggatactgaggtgggagaactgattgagcctgggaggttgaggctgcagtgagccataattacgtcactgcactccagtctgggtgacagaggcagaccctctctggaaaaaaaagttgacacaaggccactgggcctggcaaggagaagatcaccattatactgcagtagtaggtggcagagtgactaagaaggaagcgtaaaagatggatgggagcacttagaatttatctttaaaatacctgatttttttattttttgagacagagtcttgctctgttgccgaggctggagtggcgcgatcttggctcactgcagcctccgcctcccaggttccagcgattctcctgcctcagcctctcaggtagctgggattacaggcacgctcaccatgcctgggtaatttttgtatttttagtagagacggggtttgaccatgttggccaggctggtcttgaactcctgacctcagctgatctaccccccttgacctcccaaagtgctaggattacagaagtgagccatcacgcctggcctctaaaagacctgatgtttgtggtgaccattttctggaaaaatttgtgacattaaattgtggatatgtcttctttgaccaatccagcagctgtgggagacatgtttagaacagcgttgtctttctgtgatggtggacgtgctgtatatctgcactgtccagtaccatagctcccagccacatgtggctattgagcattgaatatggtcagtgtggccaaggaactgaatttgaaaatgaaaaattttaggccaagtgcagtagttcacacctgtaatcccagcacttgtggaaggctgaggcaggcagatgacttgagctcaggagtttgagaccagtctgggtaacatggcaagacctgtcttttattcaatactttaaaatttttacttacttgataaaaaggaagaatattttaaaatttaaacatcagttttttgttgttcttgtttttgacacagggactcactctggcacccaggctggagagcaatggtatgatcatggctcactgtagactttacctactggctgaagctgtcctctcacctcagtttcccacccttacccacccagtagctgggattacagacactcaccaacacgcctggctaatttttattatttgtagaaatgaggtctcactgtattgcccaggctggtctcgagctcctggcctcagacatcctgggattacaggtgggagtcactgtgcctgaccagcattgtttttttgtttttgtttgtttttttaaagataaattaattggccatgtgtggtggctcacgcctgtaatcccagcactttgcgggggctgaggctggtggatcacttgagataggagttcgagaccagcctggccaataaggcaaaaccctgtctctactaaaaatacggaaatgagccgaacatagtggtggatgcctataatcccagctacttgggaggctgaggcgggagaatcacttgaacctgggaggcaggattgtagtgagctgagatcgtgccattacactccagtctgggggacaagatcgaaacgctgtctcaaaaaaaaaaaaaaaaaaaaaagataaattaattaggccgggcacagtggctcacgcctgtaatcccagcactttgggaggctgaggtgggcggatcacctgaggttgggaagttcagaccagcctgaccaacatggagaaaccccgtctctactaaaaatacaaaattacccgggcatggtggtgcatgcctgtaatcccagctaccggggaggcggaggttgtagtgagttgagatcgcgccattgcactccagcctgggcaacaagagcgaaactctgtcttaaaaaaagaaagtcacaatgtggctagtagctaccacgttgggcagtgaagctgtgacattaccagttgtaggattgaatgcaatccagactttttgtctgttgtgttcacacttgaagcagtgactctgctgcctaagtatgtataatttttacttttttttttttttttgacggattctcactctgtcgctcaagttggagtgcagtggtgtgatcttggctcactgcagcctctgtctcctgggttcaactgatcttcctgcctcagcctccctagtagctggaactacacgtgtgtactaccacacctggctaatttttgtatttctttttttttttttttgagacggcgttgctctgtcacccagactggagtgcagtggtgcgatctcggctcactgcaacctctgcctcccgggtacaagcggttctcctgcctcatcctcccaagtagctgggactacaggtgcatgccaccacgcctggctagttttttgtatttttagtagagacggggtttcaccgtgttagccagggtggtctcgatctcctgacctcgtgatcctcctgcctcagcctcccaaagtgctgggattacaggcatgagccactgcatccagcctaatttttgtatttttagtagagacggggtttcaccacgttggccaggctggtctcgaactcctgacctcaagtaatctgcccgcctcagcttcccagaatgctgagattataggggagagccaccacacctggccccgtactcttttatattaatatccatgacgccttttaccttttctgaaatagattttttcagtttctctactgtcactctatcaaaatttgtaaattttccttggaatattagacagaggattaagccacgtgtttttccagtccaacttttgttacatctgtattttccttttacatgttgactggttcaaactggctagcatcccaagtaaggtgtgaattaaatcctgacatggggctgggcgtggtggctcatacctgtaataccagcactttgagaggccaaggcaggcgaattacctgtggtcaggagttcaagactagtctggccaacatggtgaacccgtctctacaaaaaatacaaaaattaaggctgggtgcagtggctcacgcctgtaatcccagcattttgggaggccgaggcaggtggatcacaaggtcaggagttcaagaccagcctggccaagatgttccccgtctctactaaaactacaaaaattagctgggcgtggtggcgggtgcctgtagtcccagctactcagaaggctgggacacaagaatcgcttgaacccgggaggtggaggctgcagtgagctgagattgtgccactgcattccagcctgggtgacagagtgagactccatcttaaagaaaaaaaaaaaattcctgacaacggactgtcaaagctatttgcttctcacagtctgtgggtattatagatggacggggacccgccaataaaggaggggaaggctccttttgtgaaactgatttgcttctgtcttctaaatcagtatgtgtacttgggcctactaatcaagtcttactgttttgtctgtaactttttttttttttttttttttgaggtggagtctcactctgttgcccaggctggagtgcagtggcaccatctcggctcactgcaagctccacctcctgggttcatgccatttttctgcctcagcctcccaagtagctgggactacaggcacctgccaccacgcccggctaattttttgtgtgtgtggtagagactgggattcactgtgttaggatggtgtcaatatcctgacctcgtgatccgcctgcctcggcctcccaaagtgctgggattacaggcgtaagccaccgcgcccggcttctgtaacttttatttattgtaagttgttagctattggaattctggacagaacagagctcctgagtctgttcactgctgtaagaagtaagaagtgtcatgactctttttcagcagaggaattagtctattaatgacatgtggctggaaatagacctgccgctcagaacctgttctggagttaagtccttccaagatgggcctagggaatctgagaagcacagcaggttcctctcagcaagtgctgctgaaccccaaactaagctcacacattcttcttgggttctgcctggagagtccctattagcctcatccctaagcaaccactatgctcctttttttttttggagatggagtctcgctttgtcgcccaggctggagcgcaatgtcacaatcttcactcactgcaagctcagccccccgagtagctgggattacaggtggacgccaccaggcctggctgatttttttttttgtatttttgtagagatggggtttcaccaggttggccaggttggtcttgaactcctgacttcaggtgttccacccgcctcggcctcccaaagtgctgggattacaggcgtgagctaccacgcccagcagctgctttctgtctctgtagatttacctattctggatatttcatacaaatatggtatgaaacatgtggttctttgtgactggtttcttttactgagcatagtattttcaagattcatccatgttgtagcatgtttcagtacagtactgtacttcgttccttattgttgctgagtagtactccactgtatggctataacacatggttagatatgtagcttagataggattgttttgttaattaaaagctaatgaacaaagatttcaaagtgtgagatattagtcattagtaggctggccattgaacagctccacatttcaaaatgtgagatactaaattagttattagtgggctggcccattgaacagctccagaaggccttcaggaagttgtccagacaaatgtgagtaagcatcatggtcacacaaatgtgagaaaattaccaaagactgctatgtgaaatgcggagagttgctcattaatgcatggttttaatttacctactgaagcatagtcagtagccactgtagcatctgaagaacatatgatggacacaccactcccacactcagcacccagataagcaaggcaggcagcaatgcagatgagctatagttatcccaggaaatcactttgacttgtaaagtgtgaaaaggactggccttcacctatcattctttctatagcagagctccctaaagctcagaaagccacagctggctggatgtcatggctccacctattataatcccaccactttggaagacagaggcgggtgggtcacttaagcccaggagttcatcactgagcccaggagtttgagaccagcctgggcaacatggcaaaaccccgtctccacacacacacccacacaaatagaaaaaaatttagtcgggaatggtggcacacacctatagtcccagctactcgggaagctgaggtgggagggtcacctgagcccaggagtttgacgctgcagtgagccttgatgacagcactgcactccagcctgggcaacagagtgagaccttgtctccaggaaaaaaaaaaaaagagaaagccatccccttccttgacatcatctgtaatgagtaaacagacattaaaacagtaagagtaaacaggtgtaagacatgctagaaccaaagaaccaagagttgatgatttcagagtgactcaaacatatgtgacattgttattatttcttcctctggtgtgtacagaaaaaagatacacacatctaaaagaaatgtatgcaaaaacatcataaaagcatagaaaacaaacataatagggtttttttttttgttttttttttttgagacctggagtctcgctctgtcccccgggctggggtgcagtggtgtgatctcactgcaacctctgctcccgggttcacaccattctcctacctcagcctcctgagtagctggaactacaggtgcccgccaccacgcctggctaattttttttgtatttttagtagagacggggtttcaccgtgttagccaggatggtctctatgctgacctcgtgatctgcccaccttgggcctcccaaagtgctgggattacaggcatgagccaccgcgcccgaccctttttttttttttcccccgagatggagtctcgctctgtcacctaggctggagtgcaatggcacgatctcggctcattgcaacctctgcttctcaggttcaagcaattttcctgcctcagcctcccaagtagctgggactacaggtgcgtgccaccatgcctggctaattttttgtatttttagtagagatggggtttcaccatattagccaggatggtctcaatttcctgacctcatgatccgcccgcctcggcctcccaaagtgctgggattacaggtgtgagccaccacgcccggcctgtttttttttttttttttttttttttttttttttttttttttttgagacggagtttctctcttgttgcccaggctggagtggaatggcgtgatctcggctcactgcaacctccgcctcccaggttcaagcggttctcctgcctcagcctcctgagtagctgggattacaggcacccgccaccatgcctggctaatttttttttgtatttttagtagagacgggattttgccatgttggccagactggtctcgatttcctgacgtcaggtgatccatttgcctcggcctcccaaagtgctgggattacaggcgtgagctgccacgcccggtcatgtaacagttttaaaaagcccatacggtcatactgaatatagacatagacagagttaatcaaatacatcagagactgagtttgtgaagttaaggaaaaatattcaaactagttaatcgccctaagttgcatattaattaatcgagtctttcagtgtcaccaaggtttgcctgagtaggcaaaggagaataatacgctaaagctgtagaatcacttctcttgacacggggaaggaaggagggtaagacagtggaatgtttagaaatgtgtactctgaaacggattgcttaatttacttcagtgtccaattctgcctcttactggctagcagtgcgactgacgttgaacaaattagcctttccatactcagtttcttcatttgtaaatgagagtattagaacttacaggaggactgttgcgaggattgtttgtttaaagtttataactgcattatttgttagctgtttcttatatttttcctcttctacaaagtagtggtgggagacaaggcttccctacatttagtttgatgcctgtggttctaagtataaggagaaaacggaagggaggaaagaggaagtaaaaaaatgaaagatgacctaaataaatggaaaggcgtccatgttcatatgtcagaagacttaacattgtaaagatgacagtactccccaaatcgatctgtagattcagtgtaattcctatcaaaattccagctggcttttttgcagaaattgacaaactgttactaaaatacataccaaaattcaggggacccagaataaccaaaataatcttggaaaaaaacaaagctggaggactcacacctccagattttaaaacttactgcaaagcaacagtaatcaagactgtggtactagtataaaggtggacaatatagaccaatggaataggattaatccaaagtaaaccctcagttgctaattagttgatttctcaagtgtgccaggaccatccagttggggggaaaatagtcttttcagtaaataatgctgaggtgactagatttccaaatgaaaaagaatgaagttggaccccttacctcatatcatgtatgaaaattaactcaaaatgaatcaaaggcctaaagtgtaagacttaaaactatagaaagaagcatatatattttttttacgaccttgaatttggctgtggtattttagatatgccaccaaaccatcagtaaccaaagggaaaaatagataaatttgacttcaacaaaataaaaaacgttgtgccccaaagggcatcatcaaaaaaataaaaaaaacaactgagtttaaaaatgggcaatgggggctgggtgcggtggctcattgctgtaatcctagcactttgggaggccgaggcaagtggatcacctgaggtcaggagtttgagaccagcctggtcaacatggtaaaaccccgtctctactaaaaataaaaaaattagccaggcgtggtggcagacgcctcccagctatttgggaggctgaggcaggagaattgcttgaacctgggaggcggaggttgcagtgagccaagatcgcgccactgcactccagcctgggcgacagagtaagactctgtctcagaaaaaaaaaaaaaaaggtaggggggcaatggaccaggcgcagtggctcacccctgtagtcccaacacttagggagccaacacgggagaatcacttgaggctaggagtttgagactagccagggcaacacagcaagaccctgtctctacataaaagataattaaatttgtttttcccccgagacagtcttgctgtcacccagactggagtgcagtggtgccatctcagctcactgcaacctccgcctcccaggttcaaacaattctcctgcctcagcctcccgagtagctgggattacaggtgcctgccaccacgctaggctaatttttgtgttcatagtagagaatggtttcaccatgttggccaggctgctggtttcgaactcctgacctcaagtgatctgcccatctgagcctcccaaagtacttggattacaggcgtgagccactgcacccagccaagataattaaatttttagaaagtgggggcatcacttgagcccaggagtttaagaccatcctgggcaacatggtgaaactccatctttacaaaaaaaacacaaaaattagctgggcgtggtgtgtgtgcctgtactcctagctacttgggagactgaagtgggaggattacctgagcctgggaggtcaaggttgtggtaagccatgataacaccacctcactccagcctggatgacagtgagaccctgtctcaaaaaaaaaaaattaaaagttgtaaaagaaatactgttatttgtgtattgttactggtgacttaattagatataactgacttttggttaaataaacctctactccaaacttataagttatttctgagactaaacctagcctggaaaatgacacgtctgggagagctaagcgtgatttcctttcttgacaaaccatgtacttgtaaagaatgctgcattatagcaaagtggaaaggagagataattctgcaaaatttctcctgcgtttttcaaggagaaaacagcaagtttgattttctgtgcttgtactttttacttctcaacttctgtgtattgccgcactcccagtatcccagaaatcacttaggctttcattttgtccgataatcacttgtaatttttgtctttgtcaccattagtggctaaatgattttattctttttctgggccaaatgttctttatcagatatttttctttttcttttctttcttttttctgagacacagtctcactctgccgcccaggctgtaatgcagtagtgcaatctcggctcactgcaacctccacctcccaggttcaagtgattctcgtgcctcagccttccaagtagctgggattacaggcagatgccaccatgcccggctaatttttgtattttcagtagagacggggttttgccatgtttgccaggctggtctcgaactcctgacctcaagtgatccgcctacctcagcctcccaaagtgctgggattatgggcgtgagccaccgtgcctggctggactagggtctttaaacgtgaattccctccctataagcaaaggtggagacagagtctggacattctaggaagggaaggcacaaacagaatagaagacacatgcagtaatctcagacacaccagagcacccggaaggaatggagtgcaggctgaaagtgcagaggggaaggtggggctggagagggcccaaggacaggcaatgatttattccccatctataaggaaacttttcaaaccataacagaagatttaagtcaatactggaacaaatattgtgggcatgttgaactataaacaaagcaaagatagctctttttttttttttttgagatggattctcgctctatagaccaggctggagtgcagtggtgtgatctcagctcactgcaagctccaccttccgggttcacgccattctcctgcctcagcctcccgagtagctgggactacaggcgcctgccaccatgcccggctaattttttgtatttttagtagaaatgttagccgggatggtctcgatctcctgacctcgtgatctgcccgcctcggcctcccaaagtgctggaattacaggcgtgagccaccacacctggccgaaagagattatttctcaagaattgaatgtcttctaggtagggtgctacgcaaaggtggcagccttttctttttctttttctttttttttttctgatacgatggagttttgctcttgtcgcccaggctggagtgcaatggcgctaactcggctcactgcaacctttgcctcctgtgttcaagtgattctcctgcctcagcatctcagtagttgggattacaggtgcccaccaccacgcccacctaatttttgtatttttagtggatatggggttacaccatgttggtcaggcttgtctcgaactcctgacctcaggtgatccacccacctctcaaagtactgggattgcaggcatgaaccccagcacactcggccaaagcagccttttcttgaactggggaattcctgttgacgtttctttgcatcccatagggtcctggttgtttgactttgggcaaaagcccatgcagattaggccttatgagagatgtaaagtttattaaatctttatttggtgagacagggtcttactgtgtcactcaggctggagtgtagtggcatgatttcagctcactgcaacctctgcctcctgtactcaagtgatcctcccatcttagcctcctgagtagctgtgaccacagatgcgcaccaccacagccagctaattttttgtattttgggtagagatggggtttcactgtgttgtttaggatggtctccaactcttaggctcaagcaatttgcctgccttggcttcccaaagtgctgggattacaggtgtgagccaccacgcccagtgtctatttttttattttatttatttatttatttttgagacggagtctctctctgtcacccaggctggagtgcagtggcacgatcttagctcactgcaagctccacctcctgggttcaccccattctcatgcctcagcctcctgagtagctggaactacaggcgcccttcacgacgcctggctaattttttgtatttttagtagagacgggatttcactatgttagccaggatggtctcgatctccttacctcgtgatctgcccacctcagcctcccaaagtgctgggattacaggtgtgagccaccatgcccggccaatatttttttatttttatgagatagggtcttgctattttgcccaagctggtctcaaactctggactctagctgtcttcccacctcagcctcctgagtagatgggattacaggcatgagttgccacacttgactctaactggggaacttcactctctgtcttttttttttttgagacgaattttcgctcttgttgcctaaactggagtgcagtggcacgatctcagctcactgcaacttcctcctcccgggttcaagtgattctcctgcctcagcctcctgagtagctgagattacaggtgcggaccaccatgcccggctaatttttctatttttagtagagatggggtttcaccatgttggtcaggctggtctcgaactcctgacatcgtgatccacaggcctcggcctcccaaagtgctgggattacaggcgtgagccaccatgccaatccttttttttttttgacagagtctcactgtgttgcccaggctggagtgcagtggcgcgttctcagctcactgcaacctccgcctgcctaattcaagtgattctcatgcctcagcatcctgagtagcctttcaggggttacaggtgcctgccaccaacccagctaactttttttttttttttgagacggggtttttctcttgtttcccaggctggaatgcaatggcgagatatcggcttactgcagcctctgcctcctgagttcaggagattctcctgcctcagcctctcgagtagccgggattatgggtacatgccactacgtccaacttatttttatattttttgtagagacggggtttcacaatgttggccaggctggtcttgaactctggacctcaagtgatccgcctacctcagcctcccaaagtgctggcattacaggcatgagccattactcctagccttgactgcatgctcttgtttgaagatatgcattgagcacatttccctatcatcgatatgcttcttattgtgctttcatgattagtagtatcttcaatttactccctttttgcaaaaaaaaaaaaagttactagattttgtagatttggataaaattctataatatctgtatctatatatatacacacacacgtattcactgctgtatgtaatattgtcctgagaattcacaaatgagtaatggcagcactgtcagccctctgagtttttttgttttgttttcattgtttatttttgtcgttgtttgccctctgagttttcttctggtacccctgtggattgtcttatccattctggttggggaacataccctttagacaatatagttttgataatgagtatttattattattattattattattattattattattattattattatttttgagacaagagtctctgtcacccaggctggagtgcagtggcatgatcttggctcactgcaacctccacctcccaggttcaagcgattctcttgcctcaccccaccacgcctgggtaattttaatatttttaatagagatggggtttcatatgttggccaggctggtctcaaactcctgacctcgtgatctgcccgcctcggcctcccagtgtgctgggattacaggcgtgaatcaccatgcccagctgagtgtatataatttaggattagtttgactataggtaacagagacttgaaaaataccaccttaaataagacagtcatttatttctcattcatatggaagaaacatggaaggtaggcagtcttggggctgagatggtggctcccaagatcacctgagatccaggctcctttttaccttttggttcttccagccccacggtatggcattcattctcacataccaggatggctgcttagaaaccagcccttactttagatttaagcagcaggaaaggaggaggataataaagacttccctttaagaaagactttctggaagtcccacaacatactgctgattctcacatctcatggtacatggccatgtctccaagggaagctaggaagtgtagtctacaacaaagtacatagctaaaaatcgaagtatggtctaggagggaagggcgggaattgggatggttgaccatcactgtctgccagatggaaggaatctgcagatttctctcttttttccccccactgggggcgagagtggtggtaacagctttattgaaatataatccacatatcttacaattcacctttttaaagtgtgaattatatatactgtgggctgggtgcggtggctcacgcctgtaatcccaacacactgggagagacaggcaggaggatcgcttgacctcaggagtttgagagcagctggggcaacgtggtgaaacccggtcactactaaaaatacaaaaaattagccgggtgtggtggcatgcacctttagttccagctacttgggagactgagattggaggttcacttgagcctggggaggctaaggttgcagtgagtggagatcgcaccactatactccagcctgggcaacagagtgagaccctgtctcaaaataaataaaatgtgtgaattatatatactataatcaatagtttatagtatattcatagagttgtgcagccatcaccacaataattttggaaaaatctttttacctgagaaactccagtattccattagtcattttccatttctctccacccccaagtccctgccctaggcaactaccagtctattttctctttctgaatttgtttattctggacaattttatataaatggaatcatgcatgttggtttttgtgactgggttctttcacttatataacatttccaagatctatccatactatagcatatatcagtactttatcctttatcgctgaataatattccattccattgtatggatatattatattcatcagttgttggatatttgggttctttacattttttgacaatatattatgaataatcctgctatgaatattcatgtagaggtacaagttgttatgtggacatatgtttttgtttctcttagatatatacctaggaatagaattgcagggtcatacctactcacatcctttgctcattttttaattggattagattatttgtctttttattattgaattgtaagagttctttattttttaattttttctatatactgtatttaggcctggggaggtggcttatgcttgtaatcccagcactttgggaggctgaatcgggaggattgcatgagcccaggagtttgagaccagcctgggtaatatagtgaaacgctatctgtataaaaattagtcagctgtggtggcaggagcctggtagtcccagctactggagaggttgaggtgggaggatcgcttgagttgagcctgggaggcagaggctgcagtgagccaatattgcaccactgcattccagccttggtgacagaatgagaccctttctgaaaataactacataatagagaaacacatagataggttagataggtacatagattggatagatgcgtagatagatgggcagtggctcacgcctgtaatccctcagcactgtgggaggccgaggcgagtagatcacttgagctcaggagttggagaccagcctgggaaacatggcaaaaccctgtctctgccaaaaatacaaaaattagctgggcgtggtggcgcatgcctgtggtcccagctgctggggaatttgaagtgggaggatcacttgagcctcggaggtggagattgcattgagccaagatcacgccactgcattccagcctgggtgacagagtgagacctcatctcaaaaaaaaaaaaaaaaaaaaaaaagatagatggatagataaatagcgtacttcatgtcagaaggagttctctctttttttttttttttttttttaagacacagtttcactctgttgcccaggctggagtgctctgttgcccaggctggagtgcagtggtacaatctgggctcactgcaacttctgcctcctgggttcaagcgattctcctgcctcagtctcccgagtaactgggattacaggtgcccaccaccacacccggctaagttttgaattttttgtagaaacggggttttgctgggttggtcaggctggtctcgaactcctgacctcaagtgttctgcttgcctcagcctcccaaagtgctgggattacaggtgtgagctaccgtgcccagcccaaaaagagttctttatgatttcaaccttgcaagagatcctgagccagaccaccaacctaagctgcttttttgtagttgagtcataagagtttgagacaaggttccactctgtcacccaggctggagtgcagtgatgcaatcatagctcaccacatcctccacctcctgggctcaagcaatcctcccacctcagcctccttggtagctgggactacaggtgcatgctaccacaactggctgatttttttttttttcttttccttctttttttagagacagtgtctcactggggttccccaggctggagtgtagtgatgcaatctcagctcactgcagcttccacctccagggctcaggggattatcccacctgagcctcccaagtaactgtgattagcatgcaccaccgctcctggctaattttttgtatttttagtagagacagggtttcactatgtttcccaggctcgtcttgaactcctggactctcaagcagtccacctgtttcggcctcccagattgctgggattataggcgtgagccactgcgcccggcccttttctttctcccctcccctctcatgcttccgtccgtccttcctttctcagtgtctcactatgttgtcagggctggtctcttaactcctgggcctgagcattcctcctgcttcagtctcccaaagtgttgggattacagacatgaaccactgtgctcggcctcaattgatttttcttttttgagacggagtttcgctcttgttgcccaggctggagtgcaatggcatgatctcggctcaccacaacctctgcctcccgggttcaagcgattctcctgcctcttgctcctgtgtagctaggattataggcatgtgccaccacgcctggctaattttgtatttttggtagagatggggtttctccatgttggccaggctggtctcaaactcctgacctcaggtgatctgcctgcctcggcctcccaaaatgctgggattataggcgtgagccaccgcgcccagccaagaatgctgtttctttacaaacaaatctagattggtaaaagaaggaatatccaaacttagaaagattgcagaatgtctacccaaacaacctgccgatgacttttttggttctttcctcccttgggtactccctttcatcagtcctttcattgtttttaccctgcttgacaaattgtttcctttttttttttttttttttttgtgagatggagtcttactctgtcccccaggctggtgtgcagtggcccgatcttggctcactgcaagctctgtctcctgggttcacgccattctcctgcctcagcctcccaagtagctgggactacaggtgcctgccaccatgcccggctagttatttgtatttttagtagagatggggtttctccgtgttagccaggatggtctcgatctcctgacctcgtgatccacccgcctcggcctcccaaagtgctgggattataggcgtgagccactgcgcctggctcaattgattttttaatgttaatattgtatcctgcaaccttactgaacttgtttattctaaaagttttctttaggatttcccacattacaaaatcatctcatgtgtgaattgagatagttttacttcttcctttccaatttggatgtcttttatttcattttcttaccttattgccctggctaggacctccagtatcctgctggatagaagtagcaagaacaggccaggcgtggtggctcacgcctgtaatcccagcactttgggaggctgaggcaggtggatcacctgaggtcaggagttcaagaccagcctggccaacaaggtgaaaccccatctctatcaaaaattagctggatgtggtggtacgtgcctgtaatcccagctacttgggagtctgaggcaggagaattgcttgaacccgggaggctggaggttgcagtgaactgagattgggccagtgcactccagcctgggcgacagagtgagactccgtctcaaaaaaaaaaagaagtggcaagaacagacattcttgtcttgttcctgatcttagggggcagacctttttttcagtcttttaccattaagtataatgttagttacgagtttttaatgtataaccttttggtgccaggtggatcggcgtactagaagtttgaatttgagtatgctaatagaggtttatgccccatggttaccaaagcatgtgtcatcctgtaagctacctatgacttcttgtgcattgcaggtaatatctgtgttttgtgtttcagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtgagtatacttttcataacaactgatgccattttccatgttagaatatttatggagcatgtagagaattagagctttttgcctcttcagtataccatataacaaaaatgttggaaagaagaatccattctcatcctgccatcttagtccaagtttgttctttttttttttttggagacggagtctcattctgttgcccaggctagagtgcagtggctcggtcttggctcactgcaacctctgcctcccaggttcaagtgattctcctgcctcagcctcccaaatagcagggattacaggcatgttgccaccatgctgagctcatttttcgtttagtagagatggggtttcaccaggctggtctcaaacttctgacctcgggtgatccacccacctcagcctcccaaagtgctgggattacaggagtgagccactgtgcccagccttcccccaggtttaaaggattctcctgcctcagcctccccagtagctgggattacgggaatatgccaccacacctggctgatttttgtatttttagtagaaatggggtttcactacgttggccaggctggtcatgaactcctgaccgcaggtgattggctgttttttcatttttaactgctactcatccagactttgtttacattcatatgtatttgacatggtgtccttagcatatgtgttttttttttgttttgttttgttgtttgagacagagtctcgctctgtcgcccaggctggagtgcagtggtacaatctcagctcgctgcaacctccacctcccgggttcaagcaattcttttgcctcagcctccagagtagagtagctgggattacaggcgcacgccgccatgcctggctaatacttgtattttgtaaagatgcaattttgccatgttggccaggctggtctcaagctcctgacctcagatgatccacctgcctcagcctcccaaagtgctgggattacaggcgtgagccaccttgcccagccatatgtgctcttttcaagtttacgtatatttgaagtttagttcattgccatatagataatgctcagatgaacttctttgtatgcttggactttgacaaaaattctgtcaaagtatttaatcagatgtcccagtattagattactagttcaagctctgcctcctgggttcacgctgttctcctgcctcatcctcccaagtagctgggactacaggtgtccaccaccagactggctaattttttgtatttttagtagagacggggtttcaccgtgttagccaggatggtctcgatctcctgatcttgtgatctgcccgtctcggcctcccaaagtgctgggattacaggcatgagccactgtgcccggccaaaagatttttttttactttaacataaaatagcctgccacagttgttttattttattgtcattgatggtgagaacagtgcttccccatttctgtcctaaaagccctctggcaagactggaacaaagctcttgtgaaattggagggtttttttgggttttaattttggttttggtttgtttttgtttttttttttaatcttctgcttccttttgttgtctaagtaatgctttgcttggcctctcatacttttttttttttctcttaaataaagagacagggattgtactttgtctcccaggcctgcagtgctgtgacatgatcatgcagccttgaactcttgggctcaagtgatccttccacctcagcctcccaaatagctggcactgtaggtatgtgccaccacacctgggtaatttatgtttttagagatgaggtcttgtgttggtccagctggtttcaaacaactgggctcaagttcttccatctcagccccaagtggctgggcttacaggcgcaagccagcgtgcccagctctcctatacatcttttgaagtgggtcagctgaaaggaaaaaacccctaaaactagaatgaggtgctcttctccaacattctcatttttcttgagcattcagttatatgtctcatatgctgctaacacttgatatattagcttccattcatcccctttctcctttcttactttgtttttgtttgtttgtctagagacagagtctccctctatcacccaggttggagtgcaatggcatgatcttggtttacaacaacctccgcctcctgagttcaagcaattctcctatctcagcctcccgaggagctgggattacaggtgcctgccaccaagcccagctaatctttgtatttttagtagagacgaggtttcgccatgttggccaggctggtctcgaacttttgacgtcaggtgatccgcccgccttggcctcccaaagtgctgggattacatgcatgagccaccgtgcctggccacttctacttgtccacattacttatttctttctgtcctagggccacctagcctccttttgtggcactgtgtgaggaatgtgggttagatcagctgctcagaactccagggtccctcattgtagggcttcctgatagttgtttgaccatcagtaagctcctgacctttgagccttcctcatttgtaaaacggtttttataggtgacatcaaggttctgtgaagtaacggaaaatgtttggcagcaccaaagcgctttctaagagatgaatactgccatgttcaaaaccctctttcatagtttgtagtccttttttttttttttttttttgagacagagtctcgctctgtcgcccaggctggagtgcagtggcgtgatctctgctaactgcaacctctgcctcctgggttcacgccattctcctgcctcatcctccggagtagccgggactacaggcgcccgccaccacgcctggctagttttttgtatttttagtagagacagggtttcaccgtgttagccaggatggtctggatctcctgacctcgtgatctgcctgcctcccaaagtgctgggattacaggcgtgagccactgcgcccgtcctatagtttgtgctcttttttattcaaatacagagtgagccacgatgattgctcttatgctaataggaactctaagatactttctggcccaagtatagatggaaaaaatacaacaaataccagcctaacagaattttgggatgtaccctgaaggtggcaaaccaatacagagggtgttaattcagcctcagccaagcatggatgcttggacataggtgtttttgtggtcctgataggaaaactggttttatatggacacagggcccagttgtgacaaactaggtagaaatgtgatgacatcttcaggattggtgtcaagttatagccctcttacctaacttagattgatgcaccatacatagaaagatccattggcttggggaagcaatgtcaggttggcattttcatagcttatttctcaaaagcctagtagtgaatgtatattactggttgtatcctaacattttctccagagagtggctgttaattgctgcatgtctgtaagcatgaactggaagggtcttttccatctgtggcagtatgtatgttttggaagcagctctttggttctcttggaaacattatttctgcctgggcatcttggaacaaccagaatcttgcccataagaaatttagagaccttgacttaaaaccttgaggcatggtctgtgagtatttttcttgtgctgcaaaccttggacatcactgaccctcgcaagatagggggaggttctcacttgaggagagtcccctggaataaaagtgtttgattgaagagcatattacaggctacctgcctgcctcagagcaactcaagagtccccaagatgggagagggtactgtgtaggaatattcatttaacagtatgcaatagtataaggccagacgtcgtagctcacacctgtaatccagcactttgggaggctgaggcaggaggatcaccagaggtcaggagtttgagaccagcctgcccaacatggcaaaacccaatctctactaaaaatacaaaaaattagctgggcgtggtggcaggcacttgtaatcccagctacttgggaggctgaggcaggagaatcacttgaacctgggaggcagaggttgcagtgaactgagactgcgccactgcactcaagcctgggcgacaagggcgaaactctgtctcaaaaaaaaaaaaaaacagtaggcaatagtacagcctagggaaccatacaagattgtaggtgatcatggtaccaagagtaggcctgctcacaatgaaaaggccccttttgatatgagacagactcaacatcttggaagcattttatcaagcgccaatagaggctggatatatgactaaacaccgtggggtggagggggccgggagagtgggatttgccagggagtaaatgagctccattattgtgagggcagacagattgtgataattgggcatcagtatatcttagttacacatgccagaatgatggtttgcatgacagaagtacagtgggccttgtggaggttatttgtgatgcatcctggggcaaaagttcgggggtggaagagccatcaattttaaggaagaaatcatttagaaactgaaatttgggctgtgaaggtgctaagagaagaaagatgtgttccaagtattggagggagacctcttgggcctcaaagggcctctgtacagaggatgtttaacatggagtctggtgataagaatggggtagcagagctgggtgcagtgctgggcagtgttgaatgggacttgtattcagagcccaggcatcagtttacccttctaccacaggagggtgaggatgtacccggatgtgaaaggagtactctctcaccttacgtgatgcattatttcagacatttcttgagtagtaaaggcacagccaaaagggctttcctgtcatctcaggccttgcctaacagccagcatggtgtcttttcctacctaccaactcaaaatacagatttgtttccatggtttccacattatagcagaaaatttacttagtcttgtatcttcctctctcgcctgtatgcctggtaggatgttatttaaaatttgatttcttccctcctgtctgctttctttcctagtagaatgttatttataattaaacacttttataagctacagagttatttttgacttgacattttgaattatgccacttggttcagttctagtatctgttttgtttttttgtttttttcctaattgagtcaaggtctcactgcctaggctgcagtgcagtggcacaatctctgcttactgcaacctccgcctcccgggctcaagcagtcctcccacctcagtctcccaagtagctgggactacaggcgtgcaccaccacagtcagctaatttttttttttttttaaatggagtttcgctcttgttggccaggctggagtgcagtggtgcaatctcagctcattgcaacctccactcattgcaacctccgcctcctgggttcaagcgattctcctgcctcagcctcctgagtagctgggattacaggcatgcttcaccacgcccagctaattttgtattttcagtagagatggggtttctccacatttgtcaggctagtctcgaacttccgacttcaggtgatccgcccgccttggcctcccaaagtgctgggattacaggcgtgagccaccgcacccagcccacactcagctaagttttattttatttattttttttttttttagagatggaggctcgctttgtcgcccatgctggagtgctggagtgcagtggcacgatcttggctcactgcaacctttgcctctcgagttcaagcaattcacctgccttagcctctccagtagctgggactacaggcgcacgctgccgtgcctggctaatttctttcgtattttagtagggacggggtttcaccatgttgcccaggctggtctcgaactcctgagctcaggcagtcagcccgcctcagcctcccaaagtgctaggattacaggcatgagccaccgcgcctggccacactcagctaatttttaaggtgtttttgtagaggtgggttctcagattttcaattttgagaaatttcaacctaaaataatttaaatatactctcatttgagcttgatgctcataaaagtgaatactcggccgggtgtggtggctcatgcctgtaatcccagcactttgggaggccgaggcaggcggatcacgaggtcaggagatcaagaccatcctggctaacatggtgaaaccccgtctctactaaaagtacgaaaaattagccaagcgtggtggcgggcgcctgtagtcccagctgctcaggaggctgaggcaggagaatggcatgaacccgggggcagagcttgcagtgagccaagatcttgccactgaactccagtctgagcaacagagtaagactccgtctcaacaaaaaaaaaaaaaaaaaaaaaaaaaaaaaaaaaggccaggcgcggtgggtcacgcctgcaatcccaacactttgggaggccgaggcggacggatcatgaggtcaggagatccagaccatcctggctaacacagtgaaaccccgtctctactaaaaatacaaaaaattagccgggtgtgatggcgggcacctgtagtcccagctacttgggaggccaaggcaggagaatggtgtgaacccgggagacggagcttgcagggagcagagatcgcgccactgcactctagcctgggcgacagagcaagactacatctcaaaaaaaaaaaaaaaaaagaaaaaagaaaaaatgtaaatactcctgtgttttactgttttagaccgtctgccatttcaatggtctgccatttcaatgtactatggtaagtgtcactttttctaaaagtgggtggggggattaaccttgcactcttgtggttgtttttcccattacaggtagagttggctttgtgggacacagctgggcaggaagattatgatcgcctgaggcccctctcctacccagataccgatgttatactgatgtgtttttccatcgacagccctgatagtttaggtgagtggccctgcaccctgatatttgtcactgcctgtgtagctagttggcatctggtttctgggcatcaagtggctgaaaagcagacatgaacttcagagaagcaatcatcgtcagtggccggagtcctggagtttgggattgtagagcgtgggccttgggtccctttcagcctaggtctcccatgggtactgtatttaaaatgtatccacctaggcagggcacggtgcctgacacctataatccctgcgctttgggaggtccagacgggtggatcacctgagggtcaggagttcaagaccagcctggccaacatggtgaaaccccgtctttactaaaagtacaaaaaaattagccaggcatggtggtgcacgcctgtagtcccaggtacttgggaggctgaggcaggagaatcgtttgaacctggtaggtggagattgcagtgagccgagattatggcactgcattccagactgagcaacagagcaagactctatctcaaaaataataattattattattattactaaataatattaaatgttatttaaaaatctaactgccttgtaaactagatgaattccagatacaaagatgagtaaactaaggctggtgcggcggctgacacctgtaatcctagcactttgggaggccgaggctggcagatcacctgaggtcaggagtttgagaccagcctaggcaacatggtgaaccccttgtctctactaaaatacaaaaattagctgggtgtggtggcgtgcacttgtaatcccagctattccaggggctgaggcaggagaatcacttgagcctgggaagcagaagttgcagtgagccaagatcatgccactgtactgcagactccatctcccaaaaaaaaagatgagcaaactagatgagttccaaatgtaaagccatctcttttggggaaagactttcttttttttggttgccctgtcttagcctttttctgaagtgtcttagctgatagaagcttgaatgtgatcatttcattagcctaaacacagccacataattcagaagtcagtaagtcagtattcttttttttttttttttttttttttgagagggagtcttgctctgtctcccaggctggattgcagcagcttgatctcagctcactgcaagctctgcctcctgggttgatgccattctcctgcctcagccacccaagtagctgggactacaggtggccaccaccacgcccggctaattttttgtattttttagtagagatgggatttcaccacgttagccaggatgatcttgatctcctgacctcgtgatccgcctgcctcggcctcccaaagtgctgggattacaggcgtgagccactgcgcctggcccagaagtcagtattctttagaaaaagactgaagaatgctaacctgacattctgtgaaaccaggcttgaaaaaacttgctttaggtttgtgctgaagatgatgaggtatctattaataaacttgtgctgcagccctccctgtcatgacagggcagcaggtgggtcaaggatgttgtcgtcattaccacaaacagcctttgagggtctgcttgtggcctcgggttgcctggatagttagtgttagagtgattgtgttgttatggttgtccctaccttaatgatgataactggggttgctccaagatattgagccacttgtttaaggtcatgctggcccaaggagctgagctaagattgagtcctctgtgcagtatgtcccaggacagagaaagagcacgtattccatgccgttggttcacttagatcattttcagcagttatgattgattgattgatttagaggcggggtctcgctctgttgcccaggctggagttgagtggcacaatcttggctcactgcaacctccgccttccaggttcaagcaaatctcctgtctcagcctcccaagtagcttggactacaggcatacgcccccacgcctgggtgatttttgtatttttagtagagaccgggtttctccgtgttggccaggcttctctcaaacttctgacctctggtgatccactcaccttggcctcccaaagtgctgggattacaggtgtgagccaccacacccagcctagttttggttttcaaactaatatgacttccttttgtgaagctgctggaaggccctggaggctgggcagagctttaggccacagagaaaatttgagctagttgacactctcctatcagatacacacataaataacttcacctagatcctattggaatgagaaggactgtgtgcctttgccctcgttatctagtgtataattcttgagggaaaaaactgcctccagagcaaaacattttgtctcttcagtctcacttttttctttttgagacagggtctcgctttcttgcccagtcttgagtgcagttgcagattcagtttactgctgcctcgacctcctgggctcaaacaatcctcccatctcagtccccacccagtagttggtactacaggcacacactgctgcgcttggttaatttttatattttttaggccgggcatggtggctcacgcctgtaatcccagcacttcgggaggctgaggtaggcggatcacctgaggtcaggagttcgagaccagcctggccaacatggtgaaatcctgtcgctactaaaaatacaaaacttagccaagtatggtggcatgtacctgtaatcccagctactcaggaggctgaggcaggagaattgcttgaacctgggaggcagaggttgcagtgagccgagatcgcatcactgcactccagcctaggtgacagagtgagactcttgtctcaaaaaaaaaaaaaaaaaaagtttgaaaatttattcaccaaaagtggcgacagtcaatttattcaaattctatgtacctcaaactccaggaagggggtagactattggtataatttcacatattcaggaaataactacagcacctactaacagaacatctattctaggccaggcactgtggctcacacctgtaatcccaccactttgggaggccaaggtgggtggatcctgaggtcaggagttcaagaccagcctgtccaacatggtgaatccctgtctctactaaaaatacaaaaaaatcatccgggcgtggtggcgagtgcctgtaatcccagctactcgggaggctgaggcaggagaattgcttgaacccgggaggcagaggttgtagtgagctgagattgcgccactgcgctccagcctgggcgacagagcaagagtccatctaaaaaaaaaaaaaaaaaacttctgttctagatgagggaagacagaataggctcccctcaatgcccccaaaaaagtaaatcagaaaataacaacagtaaacccagtaacagtaaatattacaaataacatttgtagaggtgggtcatggttgtatgctgttttgttttatttatttttatttttgtttttttgagacagacttttgctcttgtcacgcaggctggagtgcaatggtgcgatctcagctcactgcactccgcctcccgggttcaagcacttcttctgcctcagcctcccaagtagctgggattacaggcatgcaccaccatgcctgactaatttttgtattattagtagagacagggtttcaacatgttggccagactggtctcaaactcctgatccacctgcctcggcctcccaaagtgctgagattacaggcctgatgagccactgcacctggtctatttatttttatttatttatttatttatttattttgagacggagtctcgctctgtcgcccaggctggagggcagtggcacgatcttggctcactgcaacctccacctccctggttcaaggaatttccctgcctcagcctccctagtagctgggattacaggtgtgcaccaccatgcccagttaatttttttgttttgttttgttgtttttgagacggagtttcgctcttgttgcccaggctggagtgcaatggcacgatctcggctcactgcaacttccgcctcccgggttcaagcgattctccagcctcagcctctcaagtagctgggattgcaggcatgtgccaccacgcccagctaattttgtatttttagtagagacggggtttctccatgttggttatgctggtctcccaactcccgacctgaggtgatccacccgccccggccttcacagtgctgggattataggcatgaaccactgcgcctggcaatctttttgtatttttaatagagatggggtttcaccatgttggccagactggtctcgaactcctgacctaacgcgatccacctgcctcagcctctcaaagttttgggattatagacgtgagccactgcgcccagcctatttatttgtttttaagagatgaagtctcactttgtcaccctggctggagtgcagtagtagcgtgatcatagctcactgctaccttgaatcctggactccagtgatcctcccacctcagcctctcaagtaggtgggaatgcaggcacatgtaccactgtaaactgctaagtttttgtatgtttttgtggagatggggtttttgacttttttgatacagagtctcactctgttgcccaggctggagtgagtgtagtattgcgatctcgactcatcacaacctccacctcctgggttcaagtgtttcttctgcctcagcctcccaagtagctgggactataggtgcacaccactgcgcccggctaattttagtaattttagtagagatgaggtttcgccatgttggccaggctggtctcgaactcctgacctctggtgatccacccacctaagcctcccaaagtgctgggattacaggcacgagccaccacgctgtctggagatggggtttagccatgttgcataggctgttcttgagctcctaggcccaagctgtctacttgccttagcctctcaaaagtgctggaattacaagtatgagtcaccacgcccagcctcttttggttattttcaaaagtcacttttttttatttgagacggagtcttgctctgtcgcccaggagtgcagtggcgcgatctcagctcatggcaagctctgcctcccgggttcacaccattctcctgcctcagcctcctgaatagctgggactacaggtgcccaccactacacccggctaattttttttgtatttttagtagagacggggtttcactgtgttagccaggatggtctcgatctcctgacctcatgatccgcccaccttggcctcccaaagtgctgggattacaggcatgagccaccgctcccggccaaaagtcactcttcagccatttgaaataccagtaaaccccatagggtagaagttatgctgagagttgatgaacaagttagaaaaagaacatgtggaccctgggtcagctgctgccctagaatggggaccccttctgtaagctatgtcagaatcatctaccagcagtgacagatgtcctgtaaagtgcctgcctttgtggggcaggaagtgccccccgtgaaactaccttgtgttgtggatcttttgctcctccagagcccttactcgggccccacctacagagatgctcagcaccactcttggctggactgagaaaaagctgttggttctctgtttaaaggaaagggattatatttcctttttatggttttgaaactagtgagtttcattaaatgtctagcatttttctgaagccacaaagaaagtgtctctgcaatttcactgaggttcttggaaagtcttcaagatagaattgtatgtatccccaaattctctacatttttctttcagaaaacatcccagaaaagtggaccccagaagtcaagcatttctgtcccaacgtgcccatcatcctggttgggaataagaaggatcttcggaatgatgagcacacaaggcgggagctagccaagatgaagcaggcatgatctggggcaggactgtcttgtagtattcttgaactagggccccaagtttggaggtttggggagcccagcaggaaccttcacaggccaggttgttttagaggctcagaagcccctctgtggccctctgaccctcattaattgggatcttcacagaagatccctaagatagttcaccagtcctgtgagatggaatgtttttttatgaggtagtgctatgcccataaggactgctggcctgagaatgaaccatttcattagtagctagtaatcagtggctctagatgtaggaactttcttttttttgatatggagtctcattctgtcacccaggctggagtgcagtggcgcaatctcagctcactgcaacctccgcctccggggttcaagcgattcttctgcctcagactcccgagtagctgggactacaggcaccctccaccatgaccggctaattttttttttttttaatagatggggtttcaccctgttggccaggctggtcttgaactccttacctcaagtgatctgcccacttttgcctcccaaagtgcagggattacaggtgtgagccactgtgcctggcctctgttagactctttatttttattttttgagacacagttttgcttttgtcacccaggctggaatgcagtgatgctatctcggctgcaacctcagcctccaaggtttaagtgattctcctgcctcagcctcccaagttgctgggattacaggcatgtgccaccacgcctggctaatttttgtatttttagtagagacgggttttctccatgttggtcaggctggtctcaaactcctgaccttaggtgatctgcccgccttggcctcccaaagtgctgggattacaggtgtgagccaccacgcccgggcctgttagactcttgattgccttccccagctattactttggtacatgtgaggccaaagataaattagtggcaactgaaagataaggaaatcttgaaggctgggagtccagatagaaagccctaatgccttccctctcctccactcccaatgcctttttaaaagtgatgatggatgtggcatcttggcctctcagaaaccagctggcctaatggcagggcttcctcactggaggagaagcattgagatcttcaacctaagttctcttactcaggtttctctgtctgaatgtcaagggtaggctttatttccttcagggcatttagtcctggattggtagcttgagtaattttgctcttgattgactccttaaccttccagggctcctctgacctcttccctctacttcccagtgaataccatgtttattagagattttatgtttggtagggggtagttaccatatgtcagtttaaaaatttcataagtttagcagtttgttgttttttttttttgttttgttttttttgagaaggagcctcactgtgtcgccaggctggagtgctgtggcacgatcttggctcaactgcaacctccgcctcccagatttaagcgattcccctgcctcagcctcctgagtagctggggttacaggcgcccactaccacacccaggtgattttttgtattttagtaaagaggggtttcaccatgttggccaggatggtcttgatctcctaaactcgtgatccgcccagctcagcctcccaaagtgctgggattacaggtgtgagccaccacacccagccaagtttaacagcttttgaaagtcttttttttttttaggctgggtacagtggctcatgcctgtatcccagcactttgggaggccgaggtgggcagatcacttggtcaggagttcgagaccagcctggccaaaatggtgaaaccccatctctactaaaaaattacttgggcgtggtggtgggcacctgtagtcccagctactcgggaggctgaggcgggagaatcccttgaacccaggaggtggaggttgcagtcagctgagatcatgccattgccctccagcctgggcgaccgacgagcaaaactgtctcaaaaaaagaaaaaaaaatcttttagatgaatttgaatactttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttct

SEQ ID NO: 35593 - DNA, 16550 bp, Homo sapiens
ccttacccggcgtgccccgcgcccggaggcgctgacgtggccgccgtcagagccgccatcttgtgggagcaaaaccaacgcctggctcggagcagcagcctctgaggtgagggcgaggggcgcgggccggtgtgggccgcagagacgttggagccggcgggggctggggactggcctcggggcgacttgaggttcgcgaagggcacgtcgacccccgcggcggcggcggcgacagggccgggccgggggcggacgcagacgggccgggctgaggctggggcccggccggagtcggggctgggcggacgggcgggtcggtgagctcctcgcacccctcacaggttcccgaagtcgctcgcggccgcttgtcctcctctgcctgtccctgcccccgcccgtcgcccggaagtccgcttggacgccgggctcttctccaggaaacctgggcttcctgcttccctcgcctctgcctttctcgtttcccgaggccgcccgcgcgtggacggttgggattagcggccgcgggggccggtgggggtcgtggggcctcccccacccgagtacaggcgagcgagcggcatccgggcggacccccgcctcggggaccgggaaactgaggctcgggcggcctgagacgccgtcaaggtcatgtaggtggtgggggcttgcatcttcgcctcccgactccatccagttcgtgtttgctgtgaagacggtaccgggtcaggggtggtgagagcgggcgggcaggtggacaggaaccccgtgcccttccctgtctgctgaacggaatgcgtggacctccgggggagcccagagtgcctcccttcacaccagtgagacgcaatttggggtcagcactcagggcaccggtggcctccagagggccggtcgatcttcgctttaactccagggtggtttccttgacgttgtcggcagtagataagaaggcctcttctgagctggtgaatctttaacctacctgaatctttaacctgcctgcggaacgacctgctcgcagactctaggccgcagaggccggccccagcgctctctcggagcacagcctgggtggttacggcgtgtgagattggggctggacagccgtgcgcacctagagtgttaaataaccattccgacggcacctcctggcactccctttcagtccaggcagccagttgctgctttgcaggaattgagcagaaatgcactcggaatcgcgggcaggaaaagaagggaggtcggaggctttggatggtccccgaagtcgccgcctagttgagagctgtagagttggtgccactgcccctgttggagtgggcagttgtagttcttgtttcagaactagtggtcagcagttttctttgccggctgttgcaaggctggtggttctggcgttttccgcagtgtgttgggaggagtgtgagatgccgcggtgcagttgtgtgcggcccctgtggccctctgctgttgcgttagccattgtctaacacgtgtgaccgcatggatggtgtcctcatttaatttgaattttcaccagcactgcctaggtagccagaaccataaggtcctgaaatgccgtactattagctgggtccaaaattgagaagaattgagtagtgtaaatgttagtcacacatctcattggacacattgttagagtgtgttgtccatgttttcacatgttggtagactggagaatagctgtcacttgtcttcaggcgtatcttgttgaaaataaatccaaatcactgcagcagtaggaatatgctgttgcctgtgaggcagattttcggatttgctagttgaaaaagatttgaaacagttggtttggacaacagctgagtcacacaatgactgtgagtgaaaagcaaaaactggttctgtgcccctcacagttctggttttgtacatcatgtggtctagctatgggctgtacctcttgcacaatatggagaggacattcagacatcttcaactgctcatctgcccctacggaccagacaggcttgaaactataggaagatgcatttgacctttcatttttcagttcagtagaatttaatatggactgtcagccgctgcggtgatcatggaagtagacctaagagaaaaaaacttgtgcaagttcacacgtggagtagtatatgaccatggtttcagagaactgaagcagttctttttagattcttcaaattaaatgtctccttggtgtatttaaacctgctgttactcacaggccaggctccaccaagctttcctacacacttcttcctgagctgtgaccattctcctgagcaagaggctgcagccagcctgggctggcgggcccatactgtctctcataggcattctctccccttgacctttcacctccgtaaattcaagagggtgaaaggaaatagagtgcactgtcaaagataattgggagagaaacacgaaaaggcctcgcagtggggatcttaaattatgagaacttgtgttttctgtgttgtgcctgctcctcattggcgtggatggttggtaggggcattctgcccgtagcgtctgaagtggtcttttggaaaagatttggccccttcatgttgggattccaggacttgccttcatcctcaggttaatattctcctgtgattgttacaagctctctaaggcatagttgcatttattgccttacagctgcgcagctgccgcaccgtccagataggtagtttcacattctcaggtgggtcagatgaccttgttagcgacttgacagacatgtcctggatgctctttgttcccaggaggctctcaggtcctcccccagggtcctgtcactcagccacctacagggatggggagacagtgaggctggctgataagccataaagtccttgactaatcctggtttcctggttctcacacagtggtaacaagggcttgcagccggttgtcagccaacagactgggaagggtggtgcttcttacaggccctgataacaggagaagcctaaatgacaagagaagagacagggaaagcataaaaggcaggcagattttcacaggcacagcaattgaaaatgattctgtttagaaggcagacattctcccacacccttgaggcccagggctcactgctggtgtacagcatgaagtggacaggagagttgattcagtccatgaacatttcaggaagttagaagtctatagttgtggattgcaaaatacatatctggcctgcctcccatttcctggctaaaatacttggaatctccgaagtgatgatgtctttttgtaccctaatgagttgaccagtgatgggcagcccctacgaaacttcagggtagggctagtcacagggccaaggcaggattagagggtttcagccccaccctccaattttcccagagtggagagggactgaagattgagctggtcaccaatagccaataatttaatcaatcacacctataccatgaagtcacacttttgccttcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatgaggtcaggagattgagaccatcctggcgaacatggtgataccccgactctactaaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtctcaaaaaaaaaaaaaagaaaaaaaagaaacagcatgaaattccttgttgatgggaaatacccgaaaggcctgcctgggttttcagagagcttccagaaagctgaattcatggaggttcctggagaatggcacagccaggagggaaaggtagcgccgtgtctcttccctcatacaccgcccactgcatctctccatctgtatcctttgtaacatcctttatgaaaaaccagtaacctttagtgtttttctgagttctgtgagccactctagcaaattaattgaacccaaggggaaggagttatgggaaccctgatttatagatggctgtccagaagcacaggtaaaataacctggagtttgtgattgcctccaggtagacagtgtcagaattgaactgaattaaacgacacctagctggtgtctgctgcagaacgcagaactggttgcttgcttggcatgtagggagaaacccctgctcatgtggtgtgagaagcgacctgtgttataagagtgtgtgagaaactgagtttgggttttcctatgtcctcaaaatagtatattttgaaagccttctaggcagaatgtattaaaatagtttttactccctgaagggatgccagcaagctagaaagattcatttccaaagggcttccagtggtagcatggctagacatgagacatctttccatttgtgtcatacagcaagttatttttgcagtaccatatacgctatgcgggaaacttttaagtattttataggtttgatttaggtacaaatggccaagaagctatcatctatactcatcctggggattgggaacggaggcagttagatgtgcctgtgctttgtaccttctgtagatgggaatgcagttgctcactcaccaatcaaatttattgatttatatttaaaatactatgaatacatcttctggcaattttggtggtgacattttccttaaaatatttgtactagccaggcactgtggctcacacctgtgtagtgcaatctacttgggaggctgaggcaggagagtggatcacttgaacctaggaggtcaaggttgcagtgagctgtgatcataaccactgcactccagcttgagtaacagagcaggacccttagctcttaaaaaaatttatacctactcatcagctgaggacctgggggcaggtttagaaaacagattttgaacacacatccttccctccctcttgtgtctgacatcactgagctgccacacttttgccttcagtagttaacagcatctacaaccccattttcccacatttttatggtcaaaagaatgttcagactgacccacacatgagtacagtttttaaaaagcatgcaattccttgttgatgcgataggtttttcgtgacgaacttaatttttagggaaagcacatctgcagatgtgtacagttgatcttcatgagccctatgggcctgataaacattcttttgccattgttttctcctctccttggtggtgagtcacttgtgcagtgcccagcggaagagggtgggaggctggggaggaaggcctgttctgggcaaaggaagccctgcttgatgagcatgaggctccacgggggcagtggctgtgacggtgagtgccacacagagctgcccacactggtggagggaaggcagggagataccaggaccatccggaaggggctgagtgtcatttgacaggtgccatgtgagcagagatgtgaaggagtggcccgggacaatcagggcagaatccctgaggtgagtgcgctggctggcagagtttggagacctgtcaggagtagggtgcatactgggtgggaagcctgctggggtgtgcagtggccctcggagggggtccgcggttcccagaaaaaggaatttggtaatctgtggtggcatttttgggtggcagcactggcacctttggcagtggcaagaacacttcctgtctgaccttcatgtaggggaggtcgtctgatgtcccagacctgttataaatatgaaaaaaaaatttttgtgcatagttttaacaggtgttctgaagttccaggaacaaaatcaccttataaatcaaagatgactgtgtattgttctcttcagaatcacagcaagaattcagtttccagaaggaaaagctacagtagttgcttcatggacatggcttgcccttgaggttggtggtgtcagtgcatgagcagcctggtaagggtggttctctggccgccacccttggtcctctagcgtggttgtgaagtcactttcctttactccccattgcatcatagttgggacagagcagtggttctctgccgtcttgtgcgagtgctgggatgctgtctctacttccttttgggttgccagaggcagcatttagagcacagtgtgggcattatgttgtggaccaaggcagcctattgcaaggacctgatcgggcggcagccgtggggcagctctgagtagaacatcgggtcacctggctgactggtgtgctgagaacacgcaggaggaggctggagacggggttcttgcctggggaacaggagggaggctactcgcatcacagcggagaatgcctgttgggtttgggaggggggtttcggctgcaaagctggctgtcaaggggcaggaattgggaggagggtctaaagtcttgaagagaaatgtggggtcgttgtgtaggggccaccatcacctggagagcagggcagatgccagcgtgtgtgtgagaactaggtcacttgaagggaggtccccagagtgtccccggggtgtgcctttctctcacctaggtctggagtgcctccagaagcgaggatttcctgcaagggcggtggcctcccagggtctgtgggggggcatccccgtctctttacatgtctgactgaccagagtggggtggggtggcaaggtggtgctcgtcccaaagctgggggaaacctggtgatggttcccactcccattgttgcacttcgcttttgatttctctggaagagcaagtctttgtgtggtgtttcccctcagcctacatttttaaaatgaacgtttcttgaaggcagaaatcaagttttaggcattggctcaatcactggtgcagccattgcattaattttctttaacctggtgcggagaagctacaagggccccacccccttctagtggttggaggaaggagcaacttgctctcccagtttatgacagcaacaccagcagtgtgctgttccagttccccttttttttttcaagtggtgtagaaaggggccttcagggccctggatcccccagccccacacaatggtgggcctatgttcgtccagaacagtgcctggcagtagctcagtgcccagcatgtctgtggtgagtgtgtagttcaggaagtgaactggcaaaactgagtatcaccctctcttcctgggttcttgccactcccctgaaaaccagggtagcattgtcacatcagatagctccgctacgtgtgcgctgaccatgctgagatgggcactgtggactcagcctctggtcattgctggaaccagcggcctccatgtgaggtacaggggaacgcactgctagcagatggttgggatgtggacactcgtcctgccctcttggcttggtgctgtgccatcgcacagtcattcgctgtttagcatgcatgggagagagtgaagcacaagggcccaggcccctgggagtgcctgccctcaagttggaagagcccttgggcacagcataggcgcctggcagaattggactgggccatgatccagggcattgggacctcacctaggagttggggttctggtcagaagccctgtggagacagggtctcccctgtgggcaccaaactgacctcaaactgctggttctttggccctggggacggggctggttgaagtactctcccggcagctgtcacctgcagggagaggtgggggtaggggtgctgtgtttcttagctgttcctcgttgcagtgttaaatccctgcaggttccttattctcagcttgtgttgtgagtttcagtgttgggggctaatgtgggtttgcgtttttggtcttggttttcccagtggccagtccatcagccactgcactgggggccaggtagaggccaactgcaccctgcctgccagagtagaaatactggtaggccccaggctctgctgccccttccatgtccttgtgtaagcatccatggacaaagctgactcacggggtgtgcacagctgcagggaggccaggaaacaggggttttattctagagggccttgtgctcagtgacagaccagagtcccatcactgagagagcagggctggggcagcacaaaggactggagagcatttgccatgatgccatgtgcacagccagtgcaagtccttcattgtagctgtggtcagaggtcatgagacactgccttcagcagccctgggagtccacctggtgtgtggttagagctgtgcatctgcagatttcagaaggacttacgtttggtgaggtgctttgaagtaacacttcacaaataccaagaagcaagaaatacacaaataagcaggtaatggttctttggtgtttacattagctagtgggcaacggttctttggtgttcacattagctatagtcccagaactcagtccatgaggtggaatcacaaaaatggaattcatttctggctgtcagtacacaaactgatttaagatatcaccttgaattttaagctgacaaacagtgatctaaactgaatttcactgattgccccacctgaaagtcagacctgatagataatgccctcccttaactcaaggccagcagcagatgtgttagaggggacccttgtgcctcgcagccctcatctcctaatggctgtggggtcactgtgtcgagttgtaatgcctaatgagctcctctaaaaacatcctgaaacttgtgtaaaaaaaacagcagactcccagtggaactcgccttcagatgcagcccagaataagagttctagaatgtgtgtgccatccttttgtctcaatctgcatgattgcaagtctcttcaacatgattgggtgcgtggagtgtctcggtcatgtgtcttcccctctgagcatgccttttgattcgcacctgtgtcacaattgtgccagcctgtgagatgtgtctgcctgtcaccagtatcggcacatttagttttccctttacgtgagttttggtaaaatagtgacaaaatgtaatgcagtgctcagtcacagaaaaatgtcaggcctacagaaatggagcatttggctggcgggtagcgtgatgaccataggctttatttggctggtgtggtaaacaagcagcagcttgtgcaggtgagaataaatggccatattgcatttcattttaaggactcccttaaaatgaaaatcttcgtgtgggacatgaacacaggctttcacgaaattgatcatctacactatatgtatgactgttgaaaggctgttgttcctcagaaattcttaaaatgttatgtaatgtacatgagtcccttcaggaagtcatcagctttgttcagtttcctcagattagatagtaaaactgagattatgaactataaagatgtgtgtaatttatctgtcagtgaacttgactttaataaaagctttttgaaaaagaactctgggtggggtgcattggctcacacacatagtcccaactactgtggaggtcagggcaggaggatcactggagcccaagagttcaagatcagcctgggcaggatagcgagaccctgtctatagaaaatattaaaaatcagctaggcatggtggcttgcccttgcattccctgccacttgggaggctgaggtgggaggttcgcttgagcccaggagctcaaggctgcaatgggctgtgatcgaaccactgaattccaacctgggtgacagagtgaggccctgtctcaaaaagagaactctcgatgtcactggctttccatgtaagcagagcacatcatgtgagccccattcgtggatgtcagtcagcagaacagaatcttggacctggagcttgtttgtcctgtgctagaggttggaggtgtctctgtctttctgttggttcctgtcagttcaggtcacttagagattctgttacatacaccagctctgacaggttgggggagatgatcaaccttccgcctgcgcctgttcccttccctgactcatgccaaagtatccctgagatctgcaagggaccgaggacagtactggctggtggtctgggtacaggccacagaggcatctggaccccatgtgcatctggaccagtttggttggatccattcatggacacaaaacggatgtgaactcacagagctacattttctccctgcccctgttcaggcacagtgaggtgtcggggaatgtagctgccagagttgactgtcccgttctttggtgtaatgcctgaaggccacctttaccattggtctgtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaaggctctgagaaagtcaggtttgctcctaccacaggataattccgatgaacctgaaaagcgggttttggcttgtgtgcagggactctggtggaagaaagggtgacagcacctggcctgggcatgacacaagttaggacccgtaccaagaggccctggaattgagggtgggggttgctgtggactctttctccctcttaggaaactctattgggtctccatctgtcacagaagcagtaaatgatgtaggggctgccaggtatagggtcctgtggggatgctggaacatgccgaggcaggacgtgccagccaccctctgcccatatgtgcagcagggccacagatgtgcttgtcggtaggagagaccaagctgtctgtgtgccgatgtcttgacacctgagacttcaggttcacccatcctggttctgccattccattgcagggtggcttccctcctttggggactcttaacgctttggtctgttaaaaaaaaaaaaaaaaatccgggcgtggtggctcactcctgtaatcccagcactttgggaggccgaggtgggctgatcatctgaggtcaggggttcgaggccagccctgaccaacatggtgaaaccccgtctctactaaaaataaaaataaaaattagctcagcgtggtggcacgcgcctgtagtcccagctactcgggaagctgaggcaagagaatctcgaacctgggaggcagaggttgcagtgagccgagatcgcacctgagaggttgcagtgagctgagatcaagccactgcactccagcctggatgacagagtgagactctgtctcaaaaaaaaaaaaaaaaaaaaaagccaccaatggggagggcctgggattactggcatcacaaaccccactgcctgcaggctgcatgatctcctgggcatggttggcggcactgccccgggcatgaggaggcagcaggcatgtgtggatcacggacagtgctggggtcgagggggttggtgacggtgtgacaccccttcccctgagtggctgggtgttactgtcaattctcccaagtgctgtgcttcagtggtcgtggcagtctggtgctgcctctgcccaactggcaggcgacccttattcctgagtccctgctgacttggtgtcctaggtttattcctcctagacttgttaacttgtacagttaacaagcctttgacaccacacaccctcgcctcagctttccaaccccctagtaataacaacatcaggactccctgagtatcctccaccatatgttttcctggagtaactcataaaaggccctcttttcgttccatttcatgcttgggtttttcatgcgaacctgtcattattagtttttccgcattgcctagagttgcccaaccccataataagaatacgtaggtggcgtgccccattcttgcaggtgtccacttcctgctccagtctgagggggttggctaggctgctgctctctctccatgtggggttggctaggctgctgctctctctccacgttgctgtgggctcgcatcctctccctggttccctgggggagcttcttagggagggagcatgtgagagatctgaggccctgcagtttgggagttattttcattctcccctaacacttgttggatactttggctgggtatagaattaaagggtttcgaaagcagtgtttcagagtcttccattctctggggcatcagaggtgtcatttgcccctgtgcattctggagtccaccttgcacctttattgggtctcatctaggtccttggctttgcgcttcagccctttgaggccgaagcccagattcctgggtccccactctggaacagggaaaaatttcaccccgtaatttcgtacgttctttctttttagggtttctgttggttgatatcttaagttactcctcatcttcctttttcattctgtttgtttttgttctgccttctgagcaccttcattttgaattttccttttcagctatttgtgtatctatcaggtttctctccttgtcctttgttaaaatagtattctgtcttcagtctcctgtcttggttgcctccttgcagattccttttatatttgggtctcttatgttggtggcctttcaaaggcagacaggcctgtctcttggtggggggtgggggtgggcggagctccagttgcttgtgtgtggatctgctggggcatatagaactctcaggaattattctggaatttcatggctcaagtgtgttgtcatggctcagcgcaggcctaagccctgctgcagctgctcccctagaccaagcttgtccaacccttaggccgcatgtggcccaggatggctttgaacccgacccaacacaaatttctaataaaacattgagattttgggggtttttgttttggtttggttcaccagctgttgtgttagtatattttgtgtgtggtccaagacaattcttcttccattgtggcccagggtagccaagattggacattgctgccctaggcagtcccagcttcatcccttgggtcccaggcggtccagttttctctgcctggtcaatcatcacatccaaggtcttcctcccttttctctctgcccttcaaggcgtgtgtgtcattttggtgtcttcattggtagtggttgcaggagtggactgagagggcaggtattcagtctcttctgtgctccatgggtggtggtcttcctctgggcttagaaaacctggccgtccccaaaaagggaacactacagtgaaggtccttataaatttcagaactcatttaaatttcagaataggtgacatgttcaaaaccaagagcaaagtgtccaaaggacactgatccagcttgaaggggttctgtggctcatctgggatgatggcagtgttaaatcagacacgggcggccagttcacacccactgaaacacacaggcatgtgtgggctcttgctgatgttgagaaatggagaagaggcatttccttgccgtagcgtgctggggtgactggatgagagagtcaccagcggacagtcatggctgtgattcagccaaaagccacctgtgtgtggaacccctggtggaggaggtctgatgaggggtgggtgtgctcacaggctcctggcatgtcctcttgaaggcagaagccttcctcactcggggtaagccccgcttgcgggtgcagtgaagaagcagtcattgtttcagaaagtgaccagtgttttctaaagtccctgttcgggataaaatcacctgattcgtgaaattgcccactggccagtgaggccaaagcctaacaacttcagtgtcctcacagaggcgtctgggcagtggaggcccttcctgctggagtctccgcagggctctgatggtgggtgccagctgacttaattgctgtccccgatatttgtgttctgctgagggaacccctacccttgcggtgtggggcagacatggcgggcgtgccccatcgaggctgtgtcctcatgggagtgtgtccctgaaggtgtcctgctgagtctggcgtggccctgtgtgctctggtccttgtgagtgtgggcaggcacagtgagtggtgctctctggccctggaaggttctgtgttggggtgtagaggagccttgcacgcacctggaagccagtcctcaggcagccagcctcccctcctgcataggctgggatgaggcagcctttctggccatgcagctgtggggacagcttcccaagatgagggcaacagtttctcaattcctgactcagccattttccctcagcccccatcctgaggtggatttggggggcatgggaggcagggctctttccctgtttccctgcaggcttccaggaggtggggtgaggcagtggtgcatccctgggtgggtgggttctgagcaaccactgctgggcagcacagaaccagacatggagcaccttgtctctccaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggtgaggtgggggccagcagggagtgggctgggctgggctgggccaaggtacaaggcctcaccctgcatcccgcacccaggcttcaacgtggaaaccgtggagtacaagaacatcagcttcactgtgtgggacgtgggtggccaggacaagatccggcccctgtggcgccactacttccagaacacacaaggtaagtggctggggcctggtcccatgggcactcctgcttctagagagggggggccagcccatagatggggcatcgatgcccatagatgcggcaggggggctgtgttcccatgaccatttgacactggctgcccggcaggcctgatcttcgtggtggacagcaatgacagagagcgtgtgaacgaggcccgtgaggagctcatgaggatgctggccgaggacgagctccgggatgctgtcctcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 35594 - DNA, 30493 bp, Homo sapiens
ccaggaagggattcccgtccagtgtcaggttatccacctcgggcagctcgtcaggctgcggcgccctgttcagtctgttgcagctgagatcgagcactctgagcttggctggcagtcctttaggcacctgttccagcccagcgaacgacagattgagggagttcagggcgctggaccacatgcatctcggagcgctagggtttacggtggcgcgcagcgagttgtggctgaggtctaggctgtggggctgcacacctgccgccgccagtgcggcgcacacgcctgtgggcgtctccattcctgtgttgcgcagcgctagattctggatggccgggaacttgtggggacagagagccgccatcagtccgcgttcgcccagtccaggattgtcagacaggtctaggctggtaagggccgggaaggcgcgaacctgttcgcaggaaaaggcaggcgagtgtgcttgggcaatgctcagtaccttgaggcctggcttgagccactgctgcagctcggcgagccaagaacgccctgtcgcccacgacacgttgcgtaggcgcaagctggaaagtgcaagtcctgtggcttccagaggcagcggaggcatggtgccggttatctttaggtcctcgagcgtcagttccttgaggcgggagtacgctagcacacgcagggcgcctaccagtagctgagcaggaacctgtgcggctcccactgtgagccgccgcacgcggagagccttgaccgtgtcagcatactgccgcgggtcggcgtccgcatcgacgcgctttagaaacggctctaggttgagaccgccggcatggatctccacctctactgcagacacacactggaaggcttcggaccagtcgggctgaggttcggagaagttgcagacgcagcggaaatcttcatcgtccagctcacaaggttctggcgtggtcgcagagacgtgcaccagcggcagcagcagcagcaacaagcaggacgcgcgctcctggggagagagcagaggtctaggaggccccatccaacccctgtggctcccgagtggcacgcgttcgaccccaagaccctacactcaccatggtcgataagtcttccgaacctctgagctccggacaggctctggaagtgctttagcttctttcctacacagcggcacccgccggcttccaggcttcacacttgtgaactcttcggctgcctctgacagtttatgtaatcctgggatgtcattcagttccctcctctgtgaaccctgatcacctccccacctctcttcctccgagccagcccccttcctttcctggaaatattgcaatgaaggatgtttcagggagggggaccgtaacaggaaggattctgcagggcatctagggttctgtgtctcctggcagtgtcctgatgactcaggcgccccaggcggtgaatgccctgttgactcgggagcctaagccttctctggtgggtgtgggaaaaggatgatcctcagtgccttaggccagtaccatactctgcactatccaaccccccaatccccctaccttatatcccagagaatctacttgattcatttctttgacttcttccttgtcttggtttatgttgatctcctgccaccaaatccaagtccctgaatatcctcagatatttaactgcatgttttgtggaagagattgtgaacctcatctgttggcaccaaggggggtagaattaggttcaagaaaaggaagttggtctaaagaaaaattcccccttcctttttttttccttgctcctttgattaagtaataactttctttcttttttttttttttttttgagatagagtcttgctctgttgctcaggctggagtagagtgccatgatctcggctcactgcaacctccgcctcctgggttcaagcaattctctgcctcagcctcccgagtagctgggattacaagtgcccaccaccacacccagctaatttttgtattttttagtagagacaggttttcatcatcttggccaggctggtcttgaactcctgaccttgtgatccacccgcctcggcctcccaaagtgctgggattacaggcgtgagccactgtgcctggcagtactaactttcttaaaagtggatgtatttaacagagacacattggccaagtctctgggtcacttacactatccattttctgtcctgaaattgtgaagcaaggtattttgaatcagttttcccacttgcacgttgctctctcctgccctcccctcagtacaatctctgtgccctaggaaggaagggatgggactatgttgaatgaggattaattagtaactcaccagtttcgcaaaaaacagacaaaaacagaaaacaaaacaaaatgaaaaaaacagcaaacaaaacaaaacaaaaaaacaacaaatgtcccagagaataaggagctacgcatttacaacagccctcacaggtccacatccctagacctctggggaaagaactatatgaaagtctttttttttttttttttttttgagactgagtttggctctgttgcccaggctggagtgcagtggcgtgatcttggctcactgcaacctccgcctcccaagttcaagcaattctcttgcctcagattcctgagtagctgggattacaggagcccaccaccatgcccggctaatttttgtagttttagtagagacagagtttcactatgttgaccaggcactcctgacctcaggtgatccgcccgccttggcctctcaaagtgctgggattacaggcgagagccaccacacccggcctgaaagtcttttttacttttatttatttatttgagacggagttttgttcttgttgcccaggctgggcgcgatctcagctcactgcaatctccgcctcccaggttccagcaattctcctgcctcagcttcccgagcggctgggattacaggcatgtgccactacacccggctaattttgtatttttagtagagatggggtttctccatgttggtcaggctggtctcgaactcccgacctcaggtgattcacctgcctcggcctcccaaagtgctgggattacaggcatgagccaccgtgcccggcagaaagtcttttttaaattcccacttcctctttaattgagaaagaagtagctgcagatttgtccccaatccaaacaagaaggctcatcactgccccctgcgggtcctgttgggcataccccaatgcactgggccatgccctggtgccatgccaggcctctgtgatatccctgaggaccaagatatgattatatctgactcaaagtcagatagccagtcttggaatcccagctttacgactgaggttatgagacttgggcctcccttctgtaaaatggagatgatagtattacctgtttgtgagtaaagtctttggcacagaaacacatctttttagtgtggtcttgatgactagtcttctttctcagagtctctgctttcagagaactcaggccactgaagtctgacacctcatcatcttaggggaggcactctgggtggggagttccaagttaagaggggcagtgatggttctgcaaagatctccaactcacagcttgattcaacaaatgtctatcatttgtctaccgagtactagggttggtagaaagccctgggacacagacatgacaaagacaagtccctgaagtgctccaggaggtgggtagagcaaacatgaacccagaacttccgtccatagtgcagagggctcttaaaagaagagaaaccaaaggcttgtgttgttgggggagaggggtggaggggaggaacatggtctggagaaaggaacagccagccctgtacaagacaggacatggggctggttcttacagggttaacagtgttgctagacaggtagatacagaaaggcaatttgggcagctgtagctgtctgagcagacactgggcagaatatagcttttggctgggaacttttttcatcttccccacctggagcacatgtgggttttgttgttgttgttattgttgttgttttagatggagtttcactcttgttgcccaggctggagtgcaatgatgcaatcttggctcatcgcaacctccacctcctgggttcaagcgagtctcctgcctcagtctcctgagtagctgggattacaagcacgtgccaccacacctggttaattttgcatttttagtagagacggggtttcaccatgttggtcatgctggtctcgaactcctgacctcaggtgatccacctgcctccatctcccaaagtgctgggattataggcatgagccaccttgctgggccaagtgtgggtcttagaagctagcctgggttaggtgcagtggctcatgccagtaattctagcactttgggaggccaagctgaaaggatcatttaaggctgagttccaggctgtgataagccatgattgcactactgcactgcagcgtgggcaaccgagcaagaccctggctcaaaaaaaaaaataaataaataaaataaaaataaaaaagtttttcttggggaaataagaaaataaattttttttaattaaaaaattaaaaaaagaagccagacagttgcatgaggaagggctcaagatccaggccctatccctggccagagcatggtgcacagcaggtactcagtaaatggctctccaggggctggatggatactgggagagaagatatggaggatggaatgatggcctgtagatattttaacatgctgttttgtggaagagattgcagacttcattgattaactccaaggggtagaattaagttcaagggaaagaaattggttttaagaataacctttttcctagatttgtacttaattgaacctttgcctaagttatatggctttttaaaaattagaggtttcctgtaaaaattcttaggtgccaccgggaccctaatcttctggagctgccaagggggtctgggaggagacaacatcaaataattacactataacttaatgatagctgtgaaaagggttgtgaagaagctgggtcattggtacaatggttctgagtaggtgacactggacttgacatgttgagaatggtgttgagggaaggatgctggtagaaagaaaagggaaggatgcaggcagagaaaacagcttgtgcgagagcctcccccaagagtgggagtagggtggaggagaaaaagaacagggcttgttgacaaagagaaggtcccagaagaggtgagtccagattggagaggtatgcaggggttagaccatgtagggctaagtcggccacaattccaattttgaatgtgaggaacacggttttttattcactagtgtttcctcagtgcctagtagactagtggcactccacatttggtgaaagattttatcctaaaaattatgggaattcagttttatgcagagaagtgaaataatgatatctttctcattttcatcacatataaaatgagaataatggtcattgtggtgaacattctgtaaagcaaaaataaaattctaaggccgccccccacaaccatctgaatggacttcctcctcagccagggctctttcaaaattaaacccgagtgaccgtttcaggccatgatgggaagtaggggttgaacgtgcctcattatacctctctaccgttaacatcaacacagactttaagtttgataagaaacattttacaacccattctctctgaagcctaggatttgaaggtttcctctgcaaataagaacttgggtctccacaatcctttatcttaacccagacattcctttctattgatttcaggtctttagagaaactcaaccaattgtcaaccagaaaaatttaaaatctacctataagctggaagccccccaccgccccacttcgagttgtcccgcctttctgttgtcccacaaaccaatgtctttctctctttccccctcccctctcttcccttcctcctttcctcttttcttttctttctttcttttctccctttctttctttctttctttcttccttcctttctttcttttctttctcttaggaataacgctcaaaatcctaagggaaattgaacactcgaacaaaggattattagcaaagcaattttacttctgctcagaggggtgtctgcttggccagtcgccatgagagcacacctgaacaaaggggcacgagagcctttattcctgacgcaagtcctgcccctgtaccctttccccattggccggggtcgggtcatacaatctgaactaatcccggttggctaaacatttgatttttttaggtaatgtgggcacgtaaaagaaagtggagaggaaaggggaaggggtgcctgtaatgaactagaaagttagtcctctttccaaataatgaaaggaatgtgagctggtactgataacgtctggtactgataacgtcttgtactgtggcgtgcctcggcatctaacgaaggcaaaaaggagaaaaaggaaaacaaaagtgtgtgtgggggggagtactatgaattaaagaataaaagattgatctaattatttgaagagaaacctcatcatatcccagatttctttctttctttctttcttttttttttttttgagacggagtttcgctcttgtaccccaggcaatggggcgcgatctcggcccactgcaatctccgcctcccgggttcaaacgattctcctgcctcaggctcccgagtagctgggattacaggcacccaccactactcccggctaatttttgtatttttagtaaagatggggtttcaccatgttggccaggctggtctcaaattcctgacctcagctgatccacccgcccaggcctcccaaagtgctgggattacaggcatgagccaccaggcccggcccaaccagtgtatttcttgaatgaactgaagtctcatatctccctaaaatatgtaaaaccaagctgtaccggaccaccttgggcacatgttctcaggacctcctgagggctgtgtcaagggccatggtcactcatatttggctcagaataagtctcttcaaatattttacagagttggactcttttcgttgacaattcaatgacgcttcaagcgtttttggcagctctcatcagtgggatccgcattaatagtgaaacggcatcatggcgcttcccgcagttcgggattgttttgaactttcatctagagcgtattgtgggtggggaagttgtgtttgctgagtagattgtgacactgctggcttgggtcactcgaggtcagggatgagagactttttttcctagaattggtaagacaggaaatcaatcagaggcagagcgacgcctctggctctggtctagtggtgcagcgtctctagccctcgccccgcccaccgtccccgcgaggcgtccactcgccgagccccgccctcacccagcacccaccccgctcctcgcgccctccccgcctgttcccgccctgtgctgaggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcaggtgtgggcggccgagggagcgcgggggtatatggcggtcggggataagttgagaccccaggctcggagccgcgggttctgggttgtggtcgtccttcccacgctcagccggctcctctgcccccagcactgcggaaggcgcggagggagcagcagctggtcagcaagaggctgctgagaaacgacgccccagaggaagctggagagggatgtgtggctgcgatcctcggggaaaccgaggtgagggggcaaggtagggtgcgctggagtccacgcccgctggcgccagactcccgggagtactcgaggtctgccccaaacctgaacgcaatccactctacacttccacgcatccagtgggtcaagccagaaacaggggaatcatcctgcacaactctttgacccacaaccccatatcgatccatcatcaagtcctagttgtttacctcctgaagagctttggagtctttacatgcctcaccatcgaagctgccaccaccacctcctctctggatactactgcagtctcctaaaaggtcaccctgcatctatgcttgtcaccgtcactacgtcctttaaaaacacgtggagaccaaaatctttcctgtgccttgcaaagcatagcatggtctagcctcttcctaactcaaattttatcagttttctcatcctacccaccgtcctctttttagttcctgcaacgatatatcggatttgtgtctcaagcccttggcattcgctacgtctaacgttcgtttcttttggtattctgtcttgagagcctattttttttcttttcttttctttttttttttttgagactctcgctctgtcgccaggctggagtgcagtggcatgatctcggctcactgcaacatccgcctcccgggttcaagcgattctcctgcctcagcctcccgagtagcagggattacaggcgcgcgccaccactaatttttgtattttaagtagaggcggggtttcatcatgtttgtcaggctggtctggaacacctggcctcatgatccacccgccttggcctcccaaagtgctgggattacaggcgtgagccactgtgcccggccacctacttgtttcttgtagaatattaatcattatctaatggtttgtctattgttatttctccaactagactttaattgcaggaaaacctagatcctgtgttgtcattgaaaacccggttgcctgcacattatctggcatatagttaagtactcagtgtttattgaatgagtgaatgaaaggatttattcagtaagcattgagtatcccctgtatttgtattatgtttacgtacatagtttaccgtacataccatgttgacatatatattatcaacttattcctaggtcatactattccattgtatgcttactttatgccaggacactgtgctggtcactgaggtacacaaagatgaaaggatagagtccttttctttgaggtgctcacagcccggtgaagaagacagatgtcacaagggaaggaaacatgaggaacaagagaaactcctaagtctctcaaaaagagctaacttcccagaggaaatgaggagcagaaacctgaagagagtgggaagctggagagggtatccaggcagaagaaatagcatgtgcaaaagctcggaaatgtaaaaaaaagaaaaagaaaaagctcatgttaggctggttgttgttagagtgtaggttgcatggggagaatggctagaggagtaggttttgccaggctgagaggtttaaatatccttgaaagaaccctgtatgaaggcaggatagatattgttattctcattttcaggtgaggaaacttaggttcaggtcccatatggagtaagtggcaggtatggtattagaactcagttctgattctctgtccactccactgcaaggtagatgcttattagttgcattagtgtgaatgacaagttctgaaggtgtgatattggaaggctcacaggtgaagtgggcagagagagacttaggacttgctttctgtgaaccgtgtgttctcctttccctgccctgaactccaggtgcagcagttcctgcggcaagcccagcgggggacagaggaaaaggagagagagggggctctggtcagccttcgtcgaggcttgcagcaccctgaaacacagcaaaccttcatccggtcagtgtggatggtgtggtggagggaggagttggggctctgagggatggaccacaagctaagcagggctctggtactcactcacataggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagtaagccctgtcccttcctatcttgttcttggtttagattttaaaattgtgcttttgggaccagtttgagctggcaggtaggaggaagaaaacatgtttgcccttatgcctacagccatggctacacccatcatctccccaccctcttgtgagccgcaaggatagctgctccagcgtccccatcacctcccctccccatctccccacacgcagcctggcatgaaacaggccaagcccagtgcttttgttgcctgttctcaggagctgtgtctgtatacactgggtaacctgatcgtggagagtgaggctgtgagaaggcagctcctgccacagggcattgttccagccttggctgcctgcatccaggtgactcctttcttcctccctgggcaacccttcctttgctcctccccacatgctccatctactttggttaggtagctccagcctctgccctgtgccaaggggctgaaagtctctgaagacctgatgacccagcttccagtcagatccttaccctgtctacttccagtccccccatgtggctgtgctggaagctctcggatatgccttgtcccagcttctacaggctgaggaagctccagagaagatcattccgtgagtaaaattgtctttagatgtgcagccagaggtgacccactcagtagtatagctcccggatgcctgaatgatttccaaagctgttgcacattttaaattcatgtgtctggctaggaagggctttgggtttggacactttcccatctgggcagggctttgggtttggacactctcccacctgctatcagggtttggtaagaaccactggcatcttcgtggttcctacttacagccctgcttctgccagcagctccatcttggcctccactctccctcagcacatgctacaaatgttgcaacctggcccaaagctcaaccctggggtcgctgtggagtttgcctggtgccttcattacatcatctgcaggtaacagggcaattgggaaagtaccacagatcttccctggggctcccttccatgacattcaactctttgaacttgtgtctggaattgctatagtgagttttcctccctccactgtcttctctttttggagcccaggagacccacagaccttagctgtttctctttttttttgagacagtctcactctgtcacccaggctggatggagtacagtggtgcgatctcagctcactgcaacctctgcctcccgggttcaagcgattctcctgcctcagcctcctgagtagctgagactacagatgcgtgccactatgcccggctaatttttgtatttctaatagagacggagtttcgccatgttggccaggctggtctcaaactcctgacctcaggtgatccacccacctcagcctcccaaagtgctgggattacaggcataagccaccacgcctaggcaactgcttctcttcttaaaggtggaattgactatatacctagggactgcttgcttcctgttgcccagccaggtcagcaatcctctgctcattggccatggggctctgtctactctggggttgctgctgttggacttggctggggctgtccagaaaaccgaggatgcaggactggagctggtaggtgaagatgtcaggtgaaattctgggagatgtttcttgatactctggaatgcaggtaacctcttccttcttacacctgaccccccaatttgtctttgcagctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactggtacgcaccataatctgcccaggcctggacatttggataatggggatatttcctcatggcctaggctgaggtgggtagtattgacaggggtggtgggggaaagcagtttttcaccctggtacttctcttccagcaaacagtcctagtttctgtacctccttgctctccctggatctgattgagcctctcttacagctgttgccagtatctaacgtggtgagcgtaatggtatgtattggggttacttgaatccaagatctggtagtcggattgtatgggacagcagtcctgagccctcagatgtacccttagttgagagccagcaggtggtggtgtgtggcctcagggcccaaccaatctaggtgtgtgtcccttaaactggattatttatccttggacaaatcaactaaccaccttaagcttcagtctcctcacttataactgaggataatcttgcatcatagggtagttgtaggagtatgagaacatgtatgtagaagagcttggcatggtgcctgggcatgtggtcaccatgtcatatattttagctattgttatgatctttgtgtttcattctttgtagactatatatgtgtctatctgcaggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggtataggtttctggcccacatcctcagtcacccctgttctgaagccacacagtggctcccttcccatccagtcctaactatagttgtttctctgggcctggctaacctatataggttccatgtcagaaacttcatcctcttgttggggaatgcaccctctggagtaggctgacccatgaggctgtgggaattgagtcttaggacacagagaccaggtgtgttgaattttcttccctgcccctaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgctgaagagagagagggaggtgtctttaactattctgcaccctggaggctaccaaagtaaaataaaagatctttgtctttatcttagtcttgttaagacaggaagagtattaaagagatatgatcaaaatacatttggtatgcctagaattaatacaataggtctcaaacacatctaggaagcccaagtccaaatagaattttggctgattctggatggccgcaatgggttgtttcagggaagctttcgggggcactgtaggcatttattattaactacggtgagcaatgtattgcatgggtccagcctcagctgggagcccattctctctctttttttttttttttttttgagacggagtctcgctctgtcacccaggctggagtgtggtggcacgatctccactcactgcaacctccacctcctgggttcaagcaattctcctgcctcagcctcctgagtagctgggattacaggtgcccgccaccacacccggctaatttttgtatgtttagtagagacggggttttaccatgttggccaggctggtcttgaactcctgacctcaggtgatccacctgcttcagcctcccaaagtgctgggattacaggcgtgaaccaccgcacccagctgggtacccattctctaggctcccataggctatctaacataatacccagcacaatacactaaagttactcgtgtctatctcctcctgtagtctactggcttttggaaggagaagcttttttccttctccaattattagtgcatgtctaatgtctactgtgtctcacagatatctactctgagaaccaatctgcttaaggtggtcactctcctccacctcctcccgtcattcccagggcaccatatagttaaaagctgtgattaaaatcctgttattcagtatgtataaacatttattgcatacctacaatgtgttaggcaacatgataggaaaatttcattttgcaatacattgccatgccagtcttagaggggtaagtgcattctaggaaggggaataaatgtaaaggctcaatcctgttaaactctagctgcatctaaagttgcagctagagtttaacaatagtgcaaaacaaagttttgattccgttttctaatctctacagtgagaaaagaagaacacgcttcctcctaactaatgaagattaaatgagttaggcagggaagcactcagcacagggcccagctctatgtgcaaaattactgagattctcacacactacctggactgacactggctacacgttatttggagaaactatattgactaacttctctcctgtctgaagcccattcttaactacaaaaacgtcagctcctggtccctacgcaggattcggtcagcctgcatacttatgttgcccggaatacaacgcatcatataaccctgcgaatataaatttcttcatggaaacaagatcaacagcaaggctaaagtccgagttctagtttctccacgggtttctgcacgaccttgggcggtcccttctcttctcaaacccttgttcccctaccggagccccagacccctggcgtcccgcactcaccgtagcgggcccagagcttgggctgcacatcggagcattcgcggattaggatgggtaggtcgggattcgccttcttcagctccacgtagcgtttctcaatgaagtccctgcggggccggagagagcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgccgccatccttgttaatatcgaagtcgccaattccaggtcttcaggccaagtgctccggtctgaccaaccgcggaccctaaagcctagcccataggctgcatgaggcaggggcggggtaaagcttggccaatgatataaaagtattgtaggaccgctgcgaggtcaatttctttgcgctcggggttggtcggagggaaaaacaggaagcggaaaggctgcgaacgcaaagcagtgtgggttgattctgaggtgcactgtgggaaagagcttgtcgctgcggtgttgctgttggagactcgattgttggtgacagcgaaagaacgataacaaaatgccggagcgagatagtaaggctcaggccatccgttatttcttccccatggcacttggggcacttggcgcattattgtagcttctgagcttaagccgggtgtgtgtgtgtgtgtgtgtgtgtgtgtgtgtgtgtgtatgtatgtatgtgtgacgcttgagcccggagaagccacagggtcctaagtgaggccgacagctccaaactccgtccccagtcctcactcctactccaagtgatgatgggcggcttttgtgcgtggatcgctttcccccagtcctgtccccatacttaatcctgggttgcgcgtatttatcttttacgtagtattttagacgtgatcttccggaagtcttctctgatcctccagcgcaggattagggtcctctgctttgtgctcccacagcttcttgtagtttcctatttcagcacttattacattgtgttgacactgtcgctgttctaacttttgttctgtattgttcactactatatctcaaatttttgcataggatctgacacgtaagagactgattaaattaacgtcaattttttttgtcaggtgagccgttctccaaccctttggcccccgatggccacgatgtggatgatcctcactccttccaccagtgagtattttgtgctaggaccatggaaatgagttgggcaatgaatagaaaagtggtggtgatggtgaaagaattctgaatgtcttgtcatcaaggatggtaaaaaattatacccgctggccctttatctctgtgagccttaactggatcaggccaagtgcataagggtattagaagggaaattcctgcaggaaaggtgttaagtttttttttttttttatacgtgttgtgtaattacacattatataggaattacttcttccaatagcaaattaaaacataggaaataagggtaaaatcatctttttattttttttgagactgagtttcgctcttgttgctcaggctggaatgcagtggtgcgatctcggctcaccacaacctccgcctcccgggttcaagcaattctcctgcctcagccttccgagtagctgggattacaggcatgttccactacgcccggctaattttgtatttttagtagagatggggtttctccatgttgatcaggctggtcttgaaatcccgacttcaggtgatccacccgcctctgcctcccaaagtggtgggagtacaggcgtgagccaccgtgcctggcccccgataaaatcatctttgataacatccccaattccagtccatttctttttttttttcttttcttttcttttctttctttttttttttttttgagacggagtctcactgttacccaggctggagtgcagtgatgcaatcttggctcactgcaacctctgcctcctgagttcaagcggttctcctgcctcagcctcccaagtagctgggactacaggcatgtgccaccatgcacgactgatttttttttttgtatttttagtagagacagggtttcactgtgttcgtcaggctggtcttgaactcctggcctgaagtgatccacccgcctcagcctcctaaagtgctggcattacaggcgtgagccaccgtgcccagcctcagtccttttcttagaagtaaccacagttaccttttttggcatatcttttcctcccgttgcccaggctggagttcaatggcattatttctgctcacagcaacctttgcctcctgggctcaagcaattcttctgcctcagtttccccagtagctgggattacaggcatgccccaccatgcttggctaatttttgtattagtagagacagggtttcgctatgttggccaggctggtcttgaactcctgacctcaaatgatctgcccgtctcggcggcccaaagtgctgggattacaggcgtgagccactgcgcctggccctcctactcttttttaaatgcatttatacacatacatgcatatctgaggaaaacacaacattgctttgtgatttaaaatatttgagttaaatgatattatgctgtatatatcatttttgcaacttgcttctttttaaaccctgctcagtgtttctgagattatctttcagagcagtgacaagcattccctccttggctaaactttagtcaggttccccaaagagtcccatttttcagcaggactcatccgtggcctgctgagcacagttttaacaaagaaatcaaccaccgctccacccccatacctaaccaagttgcttttagtaattttctataaattctcacttgtccctgttgtattcggaattaagttcagtctctctactctattacaatggtcttgactcttgttacagtagtcttcaataaagtcttccttggggagaagaggaacttgattagatatcaagttggattggatatcaagagtgggaaaactttctgtgaactgacttaggattcctttttaaaactgaggtcagcaggccaaggaagagccctagtcagaagagagctttaaaggagtctgactttaatttgatcaagagaggagtctttgttagtgtaccaattaaaataatctcttgtaccattagtgctgtctttccctctttgggaaacaccatcatagtttagtcagtctccagctaataaacgcttagtctgtttcagactgattcttttcttttttttatttttttgagacagagtcttgctctttttgcccaggctggagtgtaatacctagatctcggctcactgcaaactccgcctcccaggttcaagcgattttcctgcctcagcctcctgagtagctaggattacaggcgcccaccacaacgcccagctaatttttttgtatttttagtagagatgggatatcaccatgttggccatgctggtcttgaactcctgacctcgggtgatccgcctgcgtcagcctcccaaagtgcggcgattataggtgtgagccactgcacccggccagactgattattttcaaggctataactgaattaaatttacaggccttcttatatacatatgtcagtaatggaccaggctaaatataaataaatggagttgctggctcataggatatatatacttaaattttaacaaatactgcaaaattgcccttcaaattggttatactggtttacattctcatcagcattatatgagagagtccccttcccaaattctcactcacacttgatttatcaaactttctggtagttaacactctgatgcattaaaagtggcatggcatatctggtcgggcgtggtggcttacacctataatcccagcactttgggaggctgaggtgggcagatcacctgaggtcagaagtttgggaccagcctggccaacacctctaataaaaatacaaaaattagctgggtgtgttggcgggcacctgtattcccagctacttgtgaggctgaggcaggagaattacttgaacccaggaggcagaggttgcagtgggctgagatcatgccactgcactccagccggggcaacagagggagactctgtcttaaaaaaaaaaaaaaaaagctgggtgcggtggctcatccctataatcccagcactttgggaggccgaggtgggtggatcacaaggtcaggagttcaagaccagcctggccaatatgggtgacagtgagactccgtctcaaaaaaaaaaaaacagtgtcatatctttgttttaatttgtatttccctgatttctgttaatttaatcatgatttttacttgttcctttttcatttcttattgagtcctaatatttaaaatctttgccttttcttctagatcaaaactcaccaatgaagacttcaggaaacttctcatgacccccagggctgcacctacctctgcaccaccttctaagtcacgtcaccatgagtaagtctttgggtgatccaacctgtctcccaacttgtttcttgctccttcctatttctttctactaagtagaatgacttttaatagtccctcaggtatttatgatactctctaaagtttgagaactgcccacctacaaatattggtgtggatttctgcttgattgaaagtgttactttgatcagtattctaggtctttctaaaaatcctcaaggagacttcttggggtttctggggctgtggcaatattttgctatcagtgaatttctcgtctcttctaggatgccaagggagtacaatgaggatgaagacccagctgcacgaaggaggaaaaagaaaaggtgaaggaagggtgaagggttttagattttaaggtggatagtgtttaggggaaagaagtaggggctaattatgaagctagaaactaagattttgtcttgaggctctctactttcttaatgaaacagagtgatacttagagtggcagtagagggctttggaataggcctatctatattttaatctcatcttcgctagtttcttggtggataacctagacatttgcttagcctctctaatccacagatagaatggagatacagtagcaataataacttttatcaggatgtcatgaggatcagctgtgaaagtacatgtaggcatttagcaccaatgcctggcatatggtaaccacccaataaatcttgacggccatcatcattattatatcatcatcgttatttatatgatacgaaagtttcaggacctggtacttggcttttcctttattctgagagtggaccagcaaataatacgttcttttcagctgaaatttagaaggtggtaaaaattcagaagattttctgatttttgtgtggaaaagtcttatatctatagagaattggtagagttgggtggtattaaaaagttctgaagtgacagatggagtgtcccaagttggcactggaaaagtatatctataagctggaagaagttgtagttctgattttgagtaactacgaagaggtggccagcagttctatcaggacagacatgagcttttccccatagagagtaggttggagatgtagggaagcaagcaggaacagttctgttgaccttgaggtagcagctgatgagccttatacatttgcctttctctggtcacagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcgtgagtactgagggaacagggcatggttccctcagcatccgagagtcatgcaaatacaatgtgaactcttcctcttactttcctgccctggagcctacaataagcgatttcagaggcatttgccacccacaaagggctgttcttttttttttttttttttgagatggagtctcgctctgtcacccaggctggactgcagtggcacgatcttggctcatggcaagctccgcctcccaggttcatgccattctcctgcctcagcctcccgagtagctgggactacaggcgcccgccaccacgcccggctaattttttgtatttttagtagagacagggtttcaccgtgttagccaggctggtctcgatctgacctcatgatccacccgcctcggcctgctgaagtgctgggattacaggcgtgagccaccgcacctggccccccaaccccctttcccccaccccctttttttttttttggagacagagtcttgctcttgttgcccaggctggagtgcagtagcgcgatctcagctcactgcagcctccgcctcccatgttcaggcgattctcttgcctcagcctcccgagtagctgggactacaggcgcccaccaccatgcccagctaatttttgtatttttagtagagatggggtttcaccatatccaccaggctggtctcaaactcctgaccttgtgatctgtccgccttgacctcccagagtactgggattacaggcgtgatccaccacgcctggacagtactgttcttatgtggcctctttcattatacagggacaaatcagctgcagagaagagaagacagttgatccaggagtccaaattcttgggtggtgacatggaacacacccatttggtgaaaggcttggattttgctctgcttcaaaaggtgagtcctggtggtcaggtggggagtaatactgtcgtgctgaatgctcttgtatgggtctggcaagatgaggagggagattcctgagagttcagactgagtagaagaagggctaaagatggcccctctgaaaagctgattgctactcatccttcaagtatcaggccaaattttatttccttggagaaaccttccctgatcacccaggtgtggttaagcacttcccttcacctcctgcttcctgtacctttgcatagcccttctgtttcatttaccacagcagttattgtactttgttgaaattgtttaatttgtctgtctcatctgctataagctccattagagtaagaacaatatctgtcatgtttaatattatattcttagttcctggtacagtgtggtgtagtggatgttcaataaatatataaaatgagtgtcctaaccctgcttgctttcctgttaggtacgagctgagattgccagcaaagagaaagaggaagaggaactgatggaaaagccccagaaagaaaccaagtaagtaaatattatggaaaggttgagaatttagaaaggtgggacctaaagttagagcacatttagcaaaaataaaacttttttgtcttttcaggaaagatgaggatcctgaaaataaaattgaatttaaaacacgtctgggtgagtacagtttctatactagtgactatgcattctggatgaattgtacggaatttaatgctctgggaaggatatgcttctcctttcccccaacctcctttcttctttctttctttttgagacagtgtctcacttaatcgcccaggctggagtgcagtggtgtgatcatggctcagtgcagccttgacctcctggactcagcctcttgtgtagctggcaccacaggcatgtgccaccatacctagctaatttttttttttattttttgcagagatggggttctctgtgtattgcccaggccggtctcaaactcctgggctcaagtgatcctcctgccttgacctcccaaagagctgggattctttcttgcccccaaaacaactaactcccataaaatactctaataagactcagacatagatttaattatttcatatgtcatttatgtctcctcaggtagattgaaagatttttcagtttggggcttatgagttaaaagaagtaacatggttagtgattaaaagttcaaaacttggagtcagagagacctgagtttaaaccttgatgatgaaacagcactaagtgtatgattttaggcaactgactttgctgtttgttcatctgtaaaaattgggttactatttaccacatgactttattgtagggatgaagaaaaatgaaatctataacatgcctatcatattgagcaggtagtagagctgttttttccatcatcatcaatattaccttaaacttcatccttcttcctcacaggacttaatacaatacaggtgcatagtgcccttgaagaggcaatgtagaagagtggacaggagcccaggctttggagttacatggcctggttccattctttgctccattacttagtagatacatgactttaggtaaattacttaaatctcagccatagtattcttatcagtaaaaaggataataatatccacttcatagggctgttgcaaagattaaatgacgcaaagcttgcatagcacttggcatggtggctagcacagagtaagcacataagtgacagctgttcttgtagatcctggctacttgctgctcttctccttattgtaggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggtgagtgaatggaatcctgagagcctatcatgtgagcctcaagcctgggaatcagcctggcctctgccccgtgtcccttgtccaccatgtcaccaagtgctgttcacttttacctcctaaatctcaactgaatccattcacttttccactttttcaccaataacattccagtctaagctataatcatttgctggaactattaacttactatttttttagagaccaagtctcactctgtcacccaggatggagtgcagtggtgctatcttggctcactgcaaactccgcctcccaggttcaaacgattctcctgccgcagccttccaagtagctgggactacaggcattcatcaccacacctggttaatttttttatttttagtagagattgggttttaccacgttggctaggctattcctgacctcaagtgatccatccgccttggcctcccaaagtactgggattacaggcatgagccactgcgccagtcctctggagctattaaaaaggcttctaattggtttccgcacttccactctggtttccgcacttccactctgatttgttattatatcttgttattgaggtgttattcacatgccatataattcatcctttaaagagaatttttttaaaaatttttgtggatatatagtaggtatatatatttatgaggtacatgagatgttttgatacaggcatataatgcataataatcacatcatggaaaatggggtatccatcccgttaaacatttatcttttgtgttacaaacaatccatttatactcttttagttgttttagaatgtataaattattactgcctatagtcaccctgttgtgctatcatgtagtaggccttattcattctttctatttttttggtacctattaaccacccctacctcccctacccttctaaaatatacagtttggctgggtgcagtggctcacacctgtaatcccagcactttgggaggctgaggtgtgaggatcacttgaggttaggagttcaataccaggtgggccaacattgtaaaacctgatctctactaaaaattagccaggcgtggcggcatgtgcccgtaatcccagttactcggaaggctgaggcatgagaattgcttgaacccagaaggtggaggttgcagtgagccaagatcgtgccactgcattctagcctgggcgacagaatgagactctgtctccaaataaataaataaaatgtaaatttttgtctcactacagtttagaagcttttagtagtatctcattcttaggataaagagcaaaatctttaccatgactttgagcctctgcaacatctggcctttctagaatgttctagactcctgactttcttgaatggtcttgattcattttgatgcagggcttttgtgcaggctgttttatctctggaatatcctttcacagcacttcgtttccctcccttcacctactgtattgtaattcagtctttagtttgttaagtgaatgaatgaataaatgaagagatttctgctgagtggtttaacattcttgtttcttggtattttcaggcccagaccacactgaccacaaatgacattgtcattagcaagctgacccagatcctttcatacctgaggcagggaacccgtaacaagaagcttaagaagaaggataaaggtacctggagggttagagagagaagccttacccacagaggacgtttggggataaaaccaaggtctcctggagctttctgtctccagaatattgagaggctcctgggaagcagagaaaaatgggagtactggagcattggcaaggagacagttacagccagattctgtctccttaacctacctaagaagcagtggtcaggtctgaagcatgagggatggagagtgggtagcttatgtcctatttatttattttttttaaaagagattttttggtgaaaaccagaaaacctagacagattctaaaaaggctctaatacttgaccgacattttattttattttatttatttattttttgagacggagtctcgctctgtcacccaggctggagtacagtggtgcgatgtctgctcactgcaacctctgcctcccggggtcaagcgattcttctgcctcagcctcccaagtaggcactataggcactataggcacgcatcaccacgcctggctaatttttgtattttcagtagagatggggtttcactgtattggcctggctggcctcgaactcctgaccttatgatgtgcccacctcggcctcccaaagtgctgggattacaggcatgagccactcttcctggccttattttattatttttatttatttatttattttgagacgagtctcgttttgtcgcccaggctggagtgcagtgatgccatctcggctcactgcaacctctgcctcctgggtttaagcaattctcttgcctcagcctcctgagtagctgggattacaggcacctgccatcacacccggctaatttttttgtacttttagtagagatggggtttcaccatgttagccaggctggtctcaaactcctgacctcaagtgatccgcccgccttggcctcccgaagtgctgggattacaggcgtgagccaccgcacccagccttgacccacgttttaaacagaagatgtttaaaagggcattaagagctggagaggatggtgaagttcagtggaaattaactgaggagtatgttcctgactcctctctttaaatttcagggaagctggaagagaagaaacctcctgaggctgacatgaagtatgtatcctagcccctggcatctgatcagagggagggggtctgtacatttcttgtgtctggcattttggggaggtgctgacatgagaatctggagaaatggtcagggggagtgaaggtgtatgtgtgaatttggccagctagtgatctccattttcccagtatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgaggtgagatgtgggcccttagtaccaggtgatggagttgcccctctctggaaatgtgagcaaggttgggtaaggaattgtttcaaacttgggggagggatgagtaggaatctctcatggtaacactaacttcacattttgtgttctttccagcccatggacgttgacaaaggtgagttgtacacacagcatctcacagttgctctagcagtcctgctttcccctggtagggctcagagctggcaacggtgggattgggggacctcctggttctgggttcttgtaagaactgtgtcttgctttattgaataggtggagttccctccaccttcctgggccatggcagggcatatttgctcttagatataattcctgtggccctggggttctgaggaggtgaggtagaggtcaagtatggaatgttctggataccctaccctcatctcaaccagagtgactcattaattggagtttgtttaaaactttgttagacaaaagggttctatgccttaaaaatgttttttaagtgtgttgtggggaggaggttgtgagagcctcagttcaaggtctgggctgagttctcttttctcctaggacctgggtctaccaaggagttgatcaagtccatcaatgaaaagtttgctgggtctgctggctgggaaggcacagaatcatatcctttattttaatacgttcctgggttccagagaactggtctctttactccaaccccccctgcctccctgctccctcctaccctgcccctctccttcccttttacgctgaattttgacagaatgaaaccatcccttgttccttcccagagcacccataacagctcacagcccactcagaattttcatgttggggcttctagcccttggccccctcctggctgaagctttacagcaataggtagaatcctgtgtagtgttttctttaacatagcatatgctgaagaagccagaagacaaaaagcagctgggagatttctttggcatgtccaacagttatgcagagtgctacccagccacgtatgtgaaacctggttaaggaagggaggctgggatgattgggaaacaagttgggggtgaaatggaaatttgattcgctaagtcccagggctacttcttttttttttttttttttttttggagacagagtctcactctgtcacccaggctggaatgcaatggtataatctctgctcgctgcaatctccatctcccgggttcaagcgattctcctgcctcaccctcccaagtagctgggattataggcatgcatcaccacacctggctagtttttgtatttttagtagagatgaggtttcaccatgttggtgaggctggtcttgaactcctgacctcaggtaatctgccctcctcagcctccaaaagtgcggggattacaggagtgagccactgcgcctggcccaaggctacttcttacttggatgaactattttattaggctctaagtgggaggtctagggggtggtcattcctatgcagataacctcttagtcgggtaggtttccagatgaagcatagggtcagggtatgcaacatctgtttaactcttgcttctccttaggatggatgacatggctgtggatagtgatgaggaggtggattatagcaaaatggaccaggtatgtagttagaaggatggtgggcgcctttgggcagttattatttgttttacatgtatctccttccccactcctaaaaaatctatctcatttactgggccccaccctcctttagctgcagcagtagaaacagcagcattgagggtcatgagcagcttaactatttcagagtctttgcacaagatcaaatgacatagggtcaaaaatctattttttacttcctatagcaaagtgccaggctttgattcccatggtaggcagtaagcaagcatcaatgcataagtagaaagggcagaaaaaattgcagtctttggaaaataactaaattttattctagccaggattgaagttttcctctaagtcttaagcaaaattaaaaagaaaaaaaccactaatgccactaatagtgaagaagtctgtgttcttcccctgagttcactgtattgaaatagcatggtttaatcttggagccttgtttaatcctgcctctactgtttattagttttgtgaacttgccaagttctttcactgtttatgcctcagtttcctcatcaggaaaatggagagaaatatagttccctcttcatagattttatgagaattaagtgagatatgcatttagtgtacagaataatgcctgtcacatagtaagtatgtaataagcatttattattacttatcagggtatgatttatgaattgtggaacctgggattatgggagagtctggcttcaatcaagggctgaaattccatttccactgacatctcttccttccccatcccccgattctgtcctgcaacagggtaacaagaaggggcccttaggccgttgggactttgatacccaggaagaatacagcgagtatatgaacaacaaagaagctttgcccaagtgagtcggtactgaatatgggcagggtgtgaggaggggtgtggggatttggtggaatagtgcatataaggttagagggtgtggtctggctgagatgttccccactaagttctttgcccacaggactctgggaaaacctcgccactgctatgcaatctctgatgcattctttcccaactgcttttttcagggctgcattccagtatggtatcaaaatgtctgaagggcggaaaaccaggcgcttcaaggaaaccaatgacaaagcagagcttgatcgccagtggaagaagattagtgcagtaagtaggatggccccttgggtgggagggtttcagctgggagaagacattagcctgcagattcaggaacaggcaaggggctggagagccatggaaatgagaggtcagccttgggcctcaggtgagcttagatgggcagcttggtgatagactatcctgttgtttttgcagatcattgagaagaggaagaagatggaagctgatgggtgagcggcattattcttcctctgtgggactggtgggaattgcttagtgtattgatcttatactgacccatttctccttccattgcagggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgct

SEQ ID NO: 35595 - DNA, 31931 bp, Homo sapiens
ggcacgtgacggtcgggccgcctccgcctctctctttactgcggcgcggggcaaggtgtgcgggcgggaaggggcacgggcacccccgcggtccccgggaggctagaggtgagaggggagacctgagcgcgtcctcgggcctgtgaggacctcggggggctgggagcgcctctgcggctgaggggtcgggcgtggccggcgactgaggggtcgggctggctcttgagggcccaggccctggccgacgcgcccgccgtgagcgaggaggcccgaatccgggcgtctttggttgggttgcgggcccaggccgcgccgccggggtcgggaggcgtggcaggtggcccgacagccttctttgacctctgggaaagctgacttattcctatggctttgcttctagggctttcttaggcctctttgccggctgcctgggcagccgcgaggtgggctggagtaactgggtaaaagtatagggtggaatcgggcctactaggtacccctagtagtagggaagggtggtattagaccgagagggaatgtttacaactagcgttacagtttaatatttgaaaatccaaagcggagactggaccctagttccctgaagagaaaggggaatgtaccagaaggagaacacgcagtggttgagaaacttagcagttacagcacctattctggaggcgagtaatccagttggagagggacagggcgttaaaagcaggaaagcccccgaaagctcatctaagtgcatctctttccacaccggaggcctggaggtatgaaatgactggcccaaggtcatgcgattagtgtactgatggtgctgggattatagttcagggatagaccgtgcagtggttaacgctaaggccctggctcgagtctttgattggtcattggttgctctgtgaacttcggcagttttcttaccctttgtgcccccgttcttgtcaagtaatggatataataatacccgatggatttgtgaggattaaattaagatatgtatacaataagacagggaagtccgacatttagtaactgctcgatgatcattgcggtacgttattataatctgaatgcctttggaccaatacactgccatcctagtgaactggttcagtcctgtttcgcaggacctgaggtcacagttatggtgatagaagaaaccgggcattgtgtattaccgctgggcatgacacaagtgattgctggttgagggaagttaaactgagcttaatattaaaagattgagaggacaagattaaccatagttaagtctttttacctctgatttaggaaatggaagattttgcttaattttttaataagtagatttttttaagggggaagaattttattgatctttaaaatcattctgtatctcagtcttttcccaacattgtttgagggtcatgaatagaagcaactgccatatggatcaactgttgtacatttggtataattatacttagagcagaggtaaaggactatgtgggagttctcctgtgcatcagccagggtgcacacacaagccaggtaactggatcatgagaatgctcgagtgaactgtgtgtgggggtcagtgttgcacaacagaaattttctgacttatctgcaaatggctgtcagcattccccgacaccttactatccttactccccagttcatttagcgcattatcttctcagggccacaagggataagtgttttgacagaagtcgttgctgccgttttggcaatcacactattgcatccttttagttagagttctctttgccctggaagacagcttaaggggatgaagtggcagttggtgagcatgaattgcaggctcatgaaacttgaattgtgtgcccagtgtggtaaccttttttttttttttttagacggagtctcgctctgtcactcaggctggagtgcagtggcgcgatctcggctcactgcaagctccgcctcccgggttcacgccattctcctgcctcagcctcccttgtagctgggactacaggtgcccgccaccacgcccggctaattttgtttttgtatttttagtagagacggggtttcaccgtgttagccaggatggtctcaatctcctgacctcgtgatccgcccacctcggcctcccaaaatgctgggattacaggcgtgagccactgcgcccggcccagtgtggtagcttttgtcccactttggtttccgtaacttcaaaataggaatgagaagtctcctgggttcctcacctttagggggcaattgggaggggcagataaaatggtgaacatgaaactactttaaaaagtgtaatgaattggctgggcacggtggctctcacgcctgtagttcgagcactttgggaggctgaggtgggcggattacttgaggccaggagttggtaaccagcctcgccaaaatggtgaaaccctgtctctactaaaaatacagaaaattaacctccagctactcgggaggctgaggcaggagaatcactaaacctggaaggcggaggttgcagtgagcggagatggttccattgcactccagcctgggtgacagagtgagactccatctcaggaaaaacaaaaaaaaaagtgtaatgaactgtgcaaatagaatacgccgtttataataactcctaggaaataataaaagtacctaaacagttaaaacctatacagcttttggtaaaacttttcaggaaagtcctggttgaattctttgttactccaacagatgtactttttttttttttttttttttttttttgagacggagtctccctctcaggctggagtacagtggtgtgatcttggctcactgcaacctccgcctcctgggttcaagcaattctcctgcctcagcctcccaagtagctgggactacaggtgcccaccaccacacccggcccggttttttgtattttagtagagacggggtttcaccgggttgtccaggctggttgcgaactcctgagctcaggcagtccgcccacctcggcctcccaaagtgctgggattacaggtgtgagccaccgcgctcagccttacttatttttttagagacagggtcttgctcttcatcaggctggagtgcagtggcgtggttattgctcactgcagtctcaaactcctgctgttattggttcaagtgatcttcctgcctcagtctcctgagtagctggatccacaggcggatgacgctacactcagctaatttttttttttttcctaatttttcatagatacttcgctttgttgcccaggctggtctcgaactcctgagctcaagcgatcatcctgcttcctccaactcccagagttctgggattacacgcgcgagccacgatgccaaccaggagaccagaaattaagctcagctttctttctctcccttcttccctccctccctccctcctttccttccttccttcttttttaaaactttgtggtatctgtttgtgaattgcttattttacttaccatattgtcttcaaagttcatccatgttatagccggtgatgggatttccttcctttttgagattgaatagtattccattgtatgcctatgccacatatggtttaatcattcatccattgatggacacttgggttgcttctgactgttggctgttgtgagtagtactgctatgaacacgggtctgcaaatatctctgaaactctgccttctttttctgtttgtttgtttgtttgtttaaggcagtcttactctgttgcccaggcttgaatgcagtggtgccattacagctcactttattttttatttttttgagacagtctcactcttgttggccaggctgcagtgcagtggcgtgatttcaactcacactgcaaactccacttcccgggttcaagctattctcctgcctcagcctcctgagtaactgggattacaggcatctgccaccacacccagctaattttgtgtttttagtagagacagggtttctccgtggtggtcaggctggtcttgaactcccgaactcaggtgatccacctgcctcggcctcccaaagtgctgtgattacaggtgtgagccaccacgcccagcctgcccagctaatttttgtatttttagtagagacagggttttgccatgttggccaggctggtctcgaattcctgacctcagatgatctgcctgccttggactcccaatgtgctgggattattggcgtgagccaccgcgcctggtggagtggtggagtcttttttttttttttgaggtggagtctctgtggcccaggctggagtgcagtggcgccatctcgggtcactgcatcctccgcctcccaggttcaagcgattctcctccctcagcctcctgagtagctgcggctacaggtgtgcgccaccacactcggctaattttttgtattttagtagaaacggagtttcatcatgtttccctggctggtctcctgagctcaggcagtctaccagcctcccaacgtgctaggattacaggcgtgagccaccccaccctgcccaacgactcacttagcttcaacctgtcagactcaggcttctcctaccttagccttcttagtatctgggacaacaggtgtgtgctaccatacctggctaaatttttctttttttgattttttgtagagacaggataatttttttttttttttgtatagacagggtcaggctatgtttatgttggccaggctgggaaataaggtcttaatagaggaagttgaagattcctgggggaatagcatgtagagcagctatagagggagagggtgctgattactagctaaaagacttagaaatttttgcaaacatggactcatgatagtttttgggtgatgagtcttcttgtaggatagcttgaaagaggaggaggaaactagaggccctggtaatataaggtaacattaagtatcctgatgtcagtaatggagaagagtgaaagactatgattgattgggtgactgtgtgggcagaggatgtgaggagaaaaggacatcttgtgtgtgtgtgcgcacacatttttagttgtgtatcttctacttgttttctcccccaccttgtacctgtactttctcaagcccaaaaatgaaaatttacctgctaccaaccacatcatcttgtgcatctgtgtagctcagtttttatttctttagatctgtggtcctccgtggaaagagagccactaccccaagacacatctaatataatacacagggcgcttacgtggttagaaaagaagagataagccgggtgcggtggctcactcctgtaatcccagcactttggaaggccgaggcgggcagatcacgacgtcaagagattgagactatcctggccaacacggtgaaaccctgtctctattaaaaataacaaaaattagctggatgtggtggtgcacacctgtcatcccacctacttgggaggctgaggtaggagaatcacttgaacccaggaggcggaggttgcagtgagccaagatagtgccaatgcatcccagcctggcgatagagcaagactcatctcaggaaaaaaaaaaaaaaggagcttgttttggccaggtgcagtggctcacgcctgtaatcccagcactttgggaggctgaggcaggtggatcacctgaggtcaggagttcgagaccagcctggccaacatggcgaaaccctgtctatactaaaagtacaaaaattagccgggcatggtggtgggtgcctgtaatcacagctactcaagaggctgaggtgggagaattacttgaacctgggaggcggcggttgcagtgagctgagatggtgccactgcactccagcctgggcgacagagggagaatccatcacaaaataaataaataaaatatataaattttaaaaagtagcttgttcttagtttaatattctttttgagttctaaaacgctaatttgaaaacatgtctattgatgatatttgagcaaccgtatccatattaagccttaatatgagaggaattatcttctgtgttaatttttttttttgagacgaactcttgctctgtcacgcaggctagagtgtagtggcgtgctcactgcaacctccacctcctgggttcaagcagttctcctgactcagcctcccaagtagctgagactacaggcgcccgctatcgctcccagctaatttttgtatttttagtagagaagagtttcgccatgttggccaggctggttgtgaactcctgacctagtgagccacctgcctcggcctcccaaagtgctgggattacaggcgtgagccacggcgcccggccatctctgttatttcattgtaatgttttaacgggtaccccctgtaaattagtgtatgaaagggcttttgtctgttgtaaagcactttacaaatgcaaaagtttgttggaaattgtatttgaatgccccacatctgtgtaaccaatcctctctatatgaggatgttgtgtatgtttcagttttattttgaaattttccagaaatggaatcttttaactgattttagggaaaccctttaatctctctaggctgcctttctttatctatgaaatgaaatagtaagttctttttagctctgcgatttaaaagctttaattttaaatgagagagtggttagtgatcttcatgaagtttgataggtggcaatacatttaactgattttgctctttatgtgtagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggtttgaaatggtctttgaatctattccttttacgtcttgagatgataaaattatgaagatacccgggtgcagggaaatgtagtctcaactactcaggaggcctaggacaggagtgtgagtccagccttggcaacacagggagatatcatctctaataaaatataaaagaaaaacatggtgaagataaatttggaacgttttcaaagggaaagcaaaattcgtgaaaatacttattgatctctctggcagcctttgtcttgctagaggccaattatatgggttgaatttgaaggccagctatgaaatttttgtgacagttgaaagcaaaccaggagaatagattctagataaaaaggcatgttgctgaaaatttaaatttttaattcatttatgtatttaacacaggttacttacaaagctccagttccaacaggggaagtatattttgctgattcttttgacagaggaactctgtcagggtaagtgttttccagagaaatatatgttagaggcagacatgtaaataagatgggatagtagattcctttttggatagcatcttttatagtgaaatgtctaactttattttattttatttatttattttttgagacagaatttcgctcttttgcctgggctggagtgcaatggcgtgataccggctcattgccacctccgtctcctgggttcaagtgattctcctgcctcagcttcccaagtagctgggattataggcatgcgccaccatgctggctaatttgtgtgtgtgtgttgttatttttttagtagagatggggttttgacatgttggccaggctggtcttgaactcctgacctcaggtggtccacttgccttagcctcccaaattgttggcattacaggcatgagccaccgcacctggcctgaaatttctagctttaatatcttcagtgttaacatccatgcaggaaaatagtcttttggaatttgtggtttttacttccacttctttccctcccccactctaccctatattttgttctttgattgaggaaaaaaattttctcttgatgttaaaacatcagtggaattatctcataggtttggtactttttcatataggtttgtgagttgaagataatgtattatcattagttgtgtgacagatttaaaggttggaagtagagtggttaaataggctaagagcagaataggtcctactttaatgagtatttacataattttccctcacaagtcaactgtcattttaagactgattttgggatttgttatttacaggtggattttatccaaagccaagaaagacgataccgatgatgaaattgccaaatatgatggtgagaatcccatttggtttagatataatagcagatagaggtttgacatgttgtctccatggcatttcctaagactagtttaaaaggacatagtaggctttaagatttttccagccaggtgcggtggctcacgcctgtaatcccagcactttcggaagccaaggcgggcagatcacgaggtcaggagatcgagaccatcctggctaacacagtgaaaccccgtctctactgaaaatacaaaaaattagctgggcgtggcagcgtgcatctgtagtcccagctgctggggaggctgaggcaggagaatggtgtgaacccgggaggccaagcttgcagtgagccgagaacgcgccactgcactccagcctgggtgacagagcgagactccgtctcaaaaaaaaaaaaaaaaaaaagatttttccatggaagttttgccacctttgtgtgttgcctaattttttttttttttttttttttatttaaggttcaggggtgcatgtgtagccttatatttaataggattagatctgtttaatcacctgtgctactgaatgttggaaatttctagacagtagtataatacactacagttttaaaaagccatatctgaataatatttgccaaataaagtgtgtttatttattatttatttacttttttgagacggagtctcattcttgccacccaggcttctggaatagagtggcgtgatcttggctcaccgcaacctctgtttcttgggttcaagcgattctcctgcctcagcctaccgagtagttgggattacaggtgcccatcaccacgcccggctaatttttgtgtttttattagagatggggtttcaccatgttggccaggctggtctcgaactcctgaccttgagtgatccgcctgccctcagcctccctaagtgctgggattataggtgtgagcgaccacggctgccccagtataatatatttatgcaactaggaggtgttttttttggcatttaaaggaccttcagaggtagagttaagcagtggaacttttttgtgttgtcttgtaggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtaagtgaaatgcttgttggataaaagctttctgcaaagggtaatcttagaagacattatgtaacttttactctatgttaaaaaattatgagattatataagtggtggtagggatttttgggtgaatttaaacaccttgtaattaatagtttttcctggctaatgcattattttgaaagaaactggttacttattttcctgactctaaataacttgtagattttgcagaacaaatttaccggaaatctgcattaatagtttttgtaattaattaattacaaaactagtaattaatagtttttcctgcctaatgcattattttgaaagaaactggttactcattttcctgactctaaataacttgtagattttgcagaacaaatttactggaaatctgcattaatgttcaatttaattttatttatttttgtggcatttgataactattcaaaaacaatagaagatggaatcctttgtaagggtaaacatttgacctatgataaaacgtgactaagatgagggagagaggaaatacattaagagagtttcgatctttcaaaatgccatacagttttctgcttttctctctgatattaggtatgaggttaatttccaaaatggaatagaatgtggtggtgcctatgtgaaactgctttctaaaacaccagaactcaacctggtatgtaattcccatttctggaatgtggctggacacccactattaccttgtaagaattttgtaattgggccgggtgcagtggctcacgcctgtaatcctagctcccagcactttgggaagccaaggcaggcggatcacgaggtcaggagattgagactatctggctaacatggtgaaaccccatctctactaaaaatacaaaaaattagccaggcgtggtggcaggcgcctgtagtcccagccacttgggaggctgaggcaggagaatggcatgaacctgggaggcggaacttgcagtgagccgagattgcgccactgcactccagcctgggcgacagagcgagactccatctcaaaaaaaaaaaaaagagaattttgtaataattgtgaaaataaaggcttcctcccctgctgtttaactcttttgatgagttgggaaaattgactttgacgctaacgtgctttttatttgaagtgtaaattacaaagttgttaccaactgtttttatctgaatttctggttttgcttctgtgtaagttttagttttggcaagcttatttctttgttttatgaggaagcaataactgtctagatgtgtgcattacttttttttagacacttaaacgttattttaaatttactgatgattgctggttattcctttttactaaacaaacttgtagttagcttttcctttaactgtcactaatatatttggaattttataagaggaattatcatacacttttgaaacgttgcttttgaacactttgagtacagtgacttcaaataatccttttttgtttttgaaggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaagtaagaaaaagcattagtttgggggcttatggtattacatatatatcatccatttaatttaaagattgtatatctggccgggcactgtggctcacgcctgtaatcccagcactttgggaggccgagatgggcagatcacctgagatcaggaattcgagaacagtctggccaaaatgttgaaacttcacctctactaaaaatacaaatattagctaggcatggtggtgcacgcctgtaaccgaagctagttgggaggctgaggcaggagaattgcttgaacctgggagggagccaagatcattgtgccacagcattccagcctgggcgaaagtgagactcaatctcaaaaaaaaaaaaaaaggctgggcgcggtggctcacacctgtaatcccagcactttgggaggccgaggcgggtggatcacaaggtcaggagatcgagaccatcctggctaacatggtgaaaccccgtctctactaaaaatacaaaaatattagccgggcgtggtggtgggcacctgtagtcgcagctacttgggaggctgaggcaggagaatggcacgaacccgggaggcagagcttgcagtgagccgagatcgcgccactgcactccagcctaggagacagagcaagactccatctcaaaaaaaaaaaaaaaagattgtatatctggagagtaccccagcctccaaacaagaagaatctcagcctggtatggttgctcatgcgtgtaatcccagcactttgggaggctgaggcgggcggatcacttgagatcaggcattcgagactagcatggccaacatggtaaaaccccgtctctactaaaaatacaaaaattagctgggcgtggtgttgagtagctggtgtaatcctagctactcgggaggctgaggcagcagaattacgttaacccaggaggcagaggttgcagttgagtcaagattgtatcactgcactccagcctgggtggcagaggaagattctgtaccccctccacgaaagaaaagaatctcttcactttagtatcttagttgggaaatgaccttaatttgtcagcattaaaagaagcttcttggccacgtatggtggcccacacctgtaatcctaacacttcgggaggctgaatcggatggattgcttgagtccaggagttccaaaccagcctgacaacatagtcagaccctgtctctacaaaatcttaagaattaactgagtatagtggcatgtgcctgtagtttcagctactcaggaggctgaggtatgaggattgcttgagcccaggaagtcgagactgtagtgagccatgatcttgccactgcactgtagcctgggtgacaaagtgagatgctgtctcaaaaaacaaaacaaaaaacccaaaaaacttcttttccacaggaactgaggttcgagataattttaagaatagaataggtgtttttggccaggcatggtggctcgtgcctataatcccagcactttgggtggccgaggtgggcggatcacctgaggtcaggagtttaagaccagcctggccaacatggtgaagccccatctctactaaaaatacaaaaattagccgggcatggtggagggtgcctgtaatcccagctactcaggaggctgaggcaggagaattgcttgaaccctggaagcggaggttgcagtgagccagattgtgacactgcactccagcctgggcgacaggaagactctgtctcaaaaaaaaaaaaaaaaaaattggtattttttgctggacatggtggctcatgcctgtaatcccagcacgatgggaggctgaggcgagcagatcacttgaggtcaggtgttcaagaccagcctggccaacatggtgaaacgtcatctctactgaaaatacaaaaattagccgggtggggtggtgggcgcctataatctcagatactcaggaggctgaggcaggagaatcacttgaacccgggaggcggaggtcacggtgagccaaggtcatgccattgcactccagcctgggcaacacagtgagactccgtcccccactccaaaaaaaaaggtgttttttttttttttttctacaaagagctttgctgatctaatttcttccttttttttgttgttgttgttgagaaatgttgaataatagaataagttatatttataattatacataaatccaataaaaatagtttttcagaagtatcttgtagttgaacttatttggatgctccaatacctggacaattgacaattgagttgaatcattttgatacagggttttttttggtttgtttgtttattgaagcttttcctgctagtttgagatcataaataggcatgcctctttctgaagaatataataaccttttttttttttgagatggagtttcactcttgttccccaggctggagtgcaattgtgtgatcttggctcaccacaacctctgcctcttgcattcaagcgattctcctgccttggcctcccaagtagctgggattacaggcatgtgccaccacgcctggctaatttttttttttttttttttagtagagatgggttttctccatgttggtcaggctggtctcaaactcccgacgtcaggtgatctgcccgcctcagcctcccaaactgctgggttataggcgtgagccaccgcgcctggactacctttttaatttttttgaggcggagtattgctctgtcacccaggtgggcgtgcagtggcgtgatcttggcctactgtgacgtctgcctcccgggttcaagcgattctcttgccacagcctcctgagtagctgggattacaggcttgtgccaccatgcccagctaatttttcttttttttattattattatttttttttttttccagctaatttttctgtttttagtagagaccgggtttcaccatgttggccaggctggtctcgaactcctgacctcaagtgatctgcccgcctcagctcctgaaagtgctgggattacaggtgtgagtcactgtacccagcctagaatataacaacctttttttcttttttttgtgacggagtcttgctttgtcatccaggctggagtgcagtggcgccatcttggctcactgcagcctccgcttcccaggttccagtgattctcccgtctcagcctccccagtagctgggattacaggcacacaccaccatgtccaactaatttttgtatttttagtagagccttgttggccaggctgatctcaaactcttggccatctgttgatccgcccacctcggcctcccaaagtgctaggattacaggcgtgagccactgagcccagcttaacctttttttgttatttccaaaagtaatacatatttaaggtatagaaattcagaagccataagtaagcaaaaagaaaacacttaaagcgagggagaggggttgaagacaagttggttaattggtacagaaataaggtagaaggaataaattctaatatttgatagtacagtagggaaattatagttagaacaatttatggtgtatttcagaagagctggaagagaattgtactgttcccaatacaaagaaaaagtaaatggagccaggtgcagtggctcaggcctataatccctgcgcttttgggaggctgaggtgggaggatcacttgaggccaggagttctagaccagcccgggcagcatagtgagaccttgttcctacaaaaaaataattattcaggcttggtagcatgtacctctagtcccaggtgctcgggaggctgtggtataaaaggatcccttgagtccaggattcgagattgcagtgagctatgattgggccactgcactccagcgtgggtcacagaatgagactctgtctctataaaatagaaagaaaaggtaaatgtttaaggttacagatatttcaattactgtgatttgtttgttttgttttgttttgttttgttctttttgtttttttgagatgggagtctctctctgttgcccaggctggagtgcagtggcctgatctcagctcactgcaacttctgcctcccgggttcaagcgattctcctgcctcagcctcctgaatagttgggactataggcatgcgccaccatgcccggccaatttttttgtatgtttagtagagttggggtttcaccatgttggtcaggctggtctcgaactcccaacctcaaatgatgggcctgcctcagcctcccagagtgctgggattataggcatgagccactgggcccgtccaatgactgtgatttggtcattacacattatatacatgtatcaaaatatcacacgtaccccgaaaatatgtacaagtacgatatgtcaataaaaacatacacaaagaagtcacttaaaattatcttaaacatcagcattgtgatatatatttgtcaatatgtgtatatacacatatacaactttacatgctatatctaacttttttatttttttatttatttttatttttttttttgagacggagtctcgctctgtctcccagactggagtgcagtggtgcgatctccgctcagtgcaaactccgcctcccgggttcacgccattctcctgcctcagcctcccgagtagctgggactacaggtgcccaccaccacgctgggctaattttttgtatttttggtagagacggggtttcaccgtgttagccaggatggtctcgatctcctgacctcgtgattcgcccgtctcggcctcccaaagtgctgggattacaggcgtgagccactgcgcccggcccttttttatttgagacagaaacactgcaatctccacctcccaggttcaagcgattcttgtgccttagcctcccaagtagttgggtttacaggtgtgcaccaacatgcccacctagtttttgtatttttagtagagacagggtttcaccatgttggccaggctggtctcgaactcctggcctcaagtgatccacctgcgttagcctcccaaagtgctgggattacaggcatgagccaccacacccgtttcttaacaacaaaagagtgtgaagttcttcctcacagaaatattcattttcattatcactgacacagcagcataggattccttgtttggatgtgctgtaactcagtctcctgtgtattagatatctaggtgtggaatctgggctttaatatacatcacacttaagatgcttttatggggcccatgtggctgggcacggtggctcacacctgtagtcttaacaccttgggaggctgaggttgggcagattgcctgagctcaggagtttgagaccagcctgggcaacattgcaaaaccccatctctacttaaaatacaaaaaattagctgggcatggtggcacggggccgtctgtagttccagctactgcggaggctgaggcaggagaatcgcttgaacctgggaggcgggcgttgcagttagccgagatcacaccactgcactccagcctgggagacaaagcgagactctgtctcaaaaaaataaaataaaattttaaaaaatgcttttatggatttaaaattgttttttcattctccatgggagttaaaaagtagaaagtagaatcatgagtggacatgcgttttaataaattggaggtttgtgtaatttcagtaacgtaataataccagctctattaaaaatgaagaaatggaccttttgtactgggaagtagttgtaagtccacgtatttgtcttctcactggtgtatatgtgtaagcccaataattgtgttagtttatgtagtttcttgttttttttgttttttttttttagtgtctataagtcaagtctttggtgttaaagattttaactatcatttgctgtaattcttagaaagccgagggactaatcatttatgtttcgtgcataaggaaatgggcgttagcttccccaagaccccaggagccaggcattgttcttaccccaaagcctcaggtcagacttctgctgcttcacgttagaagtcatgatcttttgtattatggtaaagggagcttggaaaattaagtacttttaattccatttaatgtttctttcagtcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactggtgagtcttggggaactgtcttcaagtgtaagggagcatttcatatattccatgtggcttgaacaacgaaatgttggttgagtaagctctgataatttcagtaatccatgatgcagtctaatctgtagggaaaatatagagtactatagctggaaaggggccatagtgtaatcatctggattgactcaccattttacaagccacagaatgccacacttgataagagtttgtctgtggtgacactgttggtttgtggcagaatctcaggtcctttaacctggctactccagggcttctgtgaactcacatttaaagccaaagttctgaaatgctaaattttaatttgaaaaataacctttttcctatttaaacaacagtcaattctctgctgtgggttgggtggtagaatacaaagccacaaggacaccaccatctgcctacacagagcttgaagtccagttgtgaggcatgatgttggcatgtggtatcgtaagggttcatgagaaggtgccacaggagaccagagcaccaggtgtacctaaactaggcatggtttcttggagcaaggcaaatcagattgagacttggcagtgaggtgagaattaaggagttggtgaatatgggaaggggtgtttctgattgaagaatgtcgtatgcagaagtagaggagcagcaatgagcttgacatgcgagggagaaattacatggccttttatgtagggtgcacattgaagagtgaggagaaatgaagatagctggggctgtattcttgtatatggctgtctttgaacttgcaacttcacacagtgactccagaaatgtcagaaagtgaacaaagaaattcttaccctttgtaaaatatcctcctatgcttagcaattacattctagattatctttttcctccttgaaaggtaagatacatataactgaacttttgtactgcactagtataaatgccaagtttacttgtatatttggtgtatattagatttggacttagccttgttcagtattatattccttaactagctttatcacctaagaaggcccctgtacccattaagcggccactccctgtttcctcccccaactcccagcaaccactaacctgctttctgcctctctacatttgtccactttgtatatttcatataaaatggaatcatacagtatgtggctttctctgtccagtttctttcatttagcacagtgttttccaggtttatctgtgttgaagcatgtatcagtactgcattcctttttatgattgaataaattctactgttttgataatgccacattttatttatccatcctttggtggacatttaggttgtttgctcctttttgtctgtgattatgaataatgctgctatgaatgttcatgtactggtttttacataaatatgttttttcttttcttgcttttttttttttgagatggagtgtagctctgtcgcccaggctggagtgcagtggcgccatcacggctcactgcaacctctgtctcccgagttcaagtgattctcccgccctagcctcccaagtagctgggatcacaagcgcatgccaccacacccagctaatttttgtatttttagtagacacggggttttaccatgttggtcaggctgatctcgatctcctgacctcaggtgatctacccgcctcagcctcccaaagtgctgggattgcaggcgtgagccaccacacctggcctcttttctttagacatgatctctgtgttgcccaggtgggagtacagtggtacggtcacggctcactgcagcttccactttctggggtcaagcgatcctctcccgccttagcttctcaagtagctgggactgcaggtatgcacgcctggctaatttttatgggttttttgtttgtttgttgagacagagtctcgttttgtcacccaggctggagtgcagtggcacgatctcgtctcattgcaacctctgcctcccgggttcaaacgattctcgtgcctcagcatcccaagtagctgggactacaagcgtgcaccactgcactcgtgcctcaccctccaagtagctgggactacaagcgcgcactactacaaaaaattcttgtatttttagtagagatgggatttcaccatgttggccaggatggtctcaaaattctgatgtcaagtgatctaccagcctcagcctcccaaagtgctgggattacaggcgtgtgccaccgtgcctggctgtgcatgttttttctttttttttgagacggagcttcgctcttgtcgcccaggctggagtgtagtggcgtgatcttggctcaccacaacctctgcctcccggtttcaagtgattctcctgcctcagcctcctgagtagctgggattacaggcatgtgccaccacgcccagctaattttgtatttttagtagagatggggtttctccatgttggtcaggctggtctcaaactcccgacctcaggtgatctgcccaccttggcctcccaaagtgctaggattacaggcatgagccactacacctggcttaatttttgtattttttggtagagacagggtgtcgtcatattggtcaggccggtcttgaactcctgtcctcaggtgatccacccgccttggcctcccaaagtgctgggattacaggtgtgagccaccgcacctggccttgtgtatttttttttttttactagagactgggtttcaccttgttgcccaggctggtgtggcctcaagtgatcctcctgccttggcctcccaaagtgctgagattacaggcatgagccactctgtctagctatagatatatattttcatttctcttgggtatatatacctaaaagtggaattgctgggtcatgtggtaactaactttttgagaaactgccaaactgttttccaaatgagcagtaccattttactttcccaccagcagtgtatgagggtttcagtttctctgcgttctttccagcatttgtttttatgagtcttttttattagagccaacttggtactaagtggtatcgttttgatttgccatttccctgatggctaatgatgttaagcatcttttcgtgtgcttattgtatgttcatattgtatatttttacattcgtatgtcttctttggagaaatgtctattaaaatcatttgcccatttttaaattgggttgtctttatattattgagttgtaaagagttattttactaggcccttagcagatatatgatttacaagtattttctaagaggaattattttaaattttgagattaaaaacaaatttttttagaatactctgttctgatccacaaagtggtactatactgtgaccagtgttgtcataactggctttttcttttgtatttaagggatgaagatgcccctgctaagattccagatgaagaggccacaaaacccgaaggctggttagatgatgagcctgagtacgtacctgatccagacgcagagaaacctgaggattggtaagaacttcagttaactttttttaattacctggtttttttgtttgtttttttttttgagatggagtctcactctgtctcccaggctggagttcagtggcgcagtttcggctcactgcaactttcacctcctgggttcaagtgattctcctccatcagccttgcgagtagctgggattacaggtgtgtgccaccacacccggcaaatttttgtattttttgtatttttagtagagacggactttcaccgtgttggccaggctggtctcaaagtcctgacctcaagtgatctgtctgccttggcctcccaaagtgctgggattacaggcgtgagccaccacacccagcataagttacctgtttttattgaagtcaatcttaatacttaaatatagccaagttccctaatttcagggtagaatttgacaattttaattatattttcttcttttttaaaaaataaatttttcctgaaaaactgttattactggaaatacaggagaagctggtctgggatactgtgaaaacatttcagcaggatcttggcagccctgggccagccagctgttcatagtcctgcatcacagaacctgtttataatttgttgtttgtacctccgtagggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccaggtttgtgcctcttgatggttgagttgctttcattaatctgtttgtattcagatagaagttttatctagagtaaggctgccaggttggtcattatattcaagctgttgaattaaaagcagaaagtagacttcctaagttgaaagagagcttaatgggttaggtattgcaaagataaacctagaaactggagtgaataactttctttaactttatttatttatttatttatttatttatttttgagatggagtttcgctcttctacccaggctggagggcagtggtgtgatgtcgcctcactgcaacctctgccttccggtttcaagcgattctcttgcctcagactcccgagtagctgggattacaggtgcctgccaccacgcctggctaatttttatatttttagcagagatggtgtttcaccatgttggccaggctggtctcgaactcctgacctcgcgatccgcccacctcaacctcctaaagtgctgggattacaggcgtgagccactgcatctggtcaactttctttttttgagactgagtctcactctagtggccaggctggagtgcaatggctcagtctcggcacactgccacctccacctcctgggttcaagcaattctcctgactcagcctcccgagtagctgggagcacaggtgtgctcacaggtgtgctcacctcacctggctgattttttgtatttttagtagagacggggcttcgccatgttggccaggctggtctcgaactcctgacctcaggtgatccacctgccttcgcctttcgaagtcctggggtttcaggcgggagccactgtgcccagccaagaataactttcatagttgctttgtaactatatttaaaaacaaaagagaaatggaaaactgttgatttgggtaccctgctcttgggtgctagggttgcttcagccataggatccacagctgagtctggacaatctgtgatgtggtgggtagaggactgtggtttgagtcagcatcttgactacatcaagtcagctcactgcttggcctcaatgcttgcaactataaaaagactgaggcccaaaagagatggtaaggatacaagtagtaaggttgtgaggctttaggcctcatgcaaaaatgtacaccctcagacctttgttccttttatctttctagccaagtaaaattatttataatctctacaaagagtggcaattaaaattatttataatcattaatttctactttatttatatacaaatactaatatatgtatatacatatacagaaacaggagaagctggtctgatactgtgaaaacatttcagcaggatcttggcatagtatatgtatatatacatatactaatatatgtttttctgtttgtaaattttttatttttttcctcatagtcgttaaagatgttatgtgaatgtatttttaattgtgtagtcaaacaataagataaaagttttactttaaaaaagttgccctttaggctgggcgtagtggctcacgcctataatcccagcacttgagaggctgaggtgggtggatcacctgaggtcagccattcgagaccagcctggccaacatagtgaaacaccatctctactaaaagcacaaaaattggcctggtatggtggcacacacctgtagtcccagctgcttaggcacgaggctgaggcacaaggatcacttgaacacaggaggcagaagttacagtgaaaaagaagttgccctttagttgttctcctgttggtggccatttaggtggattgtcacttttgctttcagagtcactgctgctgtaataatccttgtacatgtctgggtgtatgttgtgagtatttctctaggtagttatctagaagtgaattgctggttgatgatcatgtgcgttttattttaaatcaccactgaagaagtacgtactgacttatgctcccactctcattagcagttgctaagagtggaggctgttgaatgggccaggaacttgaggggttggtttggaccaaggtcatgggtgacagtagaaattggaagtagttggaatcctgcagtcttagaggcagagtgcgtaaaataatctgtagcatttgttatttattttcctgttgcttatttcaagtttcatgaagttggcatttctctccattgttcatgcaaaatttctcttacggtagattcaccataaacttttgttgatcattatctgaaatgattttctgaaacatttttttttctagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgaggttcgtgtttgctgcttgtgcatttgtgtctgttattgtaaggagctgttattttgtgaaagtctgtgttaaggttttttttcttcatttggcaatattggcataaaaagtataaccatatgcctgcaaaagacacaatattgggttttggggcatgatttcattagtctaatgtagtggctttagagtctgtttgtgttcagggttttttttttattatttgtctgggtatatatttcgaaatttgtcatttaggctatattttaatacactcttatatgttgaatctcggtttacactacatacagaattttcaaacaactggtcatgtggccgatttaagaattggagagccagggatactgagataagaaattcactggatcctgaggttaagggagccttttgcaggtgatgtagaagccagcttttgcacctatgagagtgaaatcatcttgattataaggagagcaagaggatggaggctttctctaatttcttttttacattttatgagcattttctctgaaaaagaaggtcctgcgtagtgccatgccataactgaactgcagaaaaacagcacggcctatgtttggtgtcaaaagctggaactttcaatcagccctgtcttgtttttcagccaggcgttgtggggcagatgatcgaggcagctgaagagcgcccgtggctgtgggtagtctatattctaactgtagcccttcctgtgttcctggttatcctcttctgctgttctggaaaggtaggaagtttttttttttagaatcaattttagagacatcactctagtgattattaaaaataactaagatatgttgcctgaggttttctttgtagtggctcagtaatgaccaagccatgtttggtgttgacttcagaaaccttacttactgttcctcagtggccgtttattgtgcccagatgggagcaggatttatagccccttggttgctattattatttatcctaatctgttactctccatagtgttcggcagcaactttctaaaaaaaaacaataaacttagataccaaactagccacttgggcaataatcagctttgcctgctggcatagctatttctattctttgtaattcagtctttgattcctcattatccattctgccttcaccttccccactctcaaaacagtatgttggggtaccacagccttattgttagtttttcttgtttagcctttttttttttgcatgctatcataaaaaaagaaagtcttattttggactctacttctgctaaatgaggattatgcttcatctggcattcatagcactttgtaactggatcccaagttccttttccagcctcagcctctgccactattctgtgtatcggtgcctcagtcaccttgacttttttgacctttattttcctgcctggcccttttgtttttattgttctaccttgaaacacacaagcacatgtgcatacacacacgtacatacacgctcttcagggtaggaattacatcctattcgtttctgtatatctatccctgtatacagcctggaacagaactttgcctgtaggcattcaggaattatataacataatacatgaacatgtaaacaaaattgtactttggggaacatttcagaaacagaccagtggtatggagtataagaaaactgatgcacctcaaccggatgtgaaggaagaggaagaagagaaggaagaggaaaaggacaagggagatgaggaggaggaaggagaagagaaacttggtaagaaacagagtccagaaaatctgctttaagccaagaccctacgatgttgttaaacctttacagtcaagttaaggattgtttttagccaggcgtggtggctcaagcctgtaatcctagcactttgggaggttgaagcaggaaaatcacttgagcccaggagtttaaggctgtagtcagccaggatagtgccactgcactccagctgagcaacagagtgagaccctgtctctctctctctctcttttttattttttaagacaaggtcccactctgtcactcaggttggagtacagtggcacagtcacagttcactgcagccttgaccttataggttcaagtgatcctcctacctcagcacccctccaagtagctgggaccacaggcatgcgctaccatgctcagctgtttgtttgtttgtttgtttattgatttatttatttgatatggtctggccctgttgcccaggctggagtgcagtggtgtgatctcggttcactgcagcctttgcctcccagattcaagcgattctcccacctgggcctcccaaagtgttgggattacaggcgtgagccaccagacccagcgagatcctgtctcttaaaaaaaaattgttggccaggtgcggtggctcacgcctgtaattccagcactttggggggccgaagcaggcagatcacgaggtcaggaggtcgagaccatcctggctaacatggtgaaaccccatctctactaaaaatacaaaaattagccgggcatggtggcaggtgcctgtagtcccagctactcaggaggctgaggcaggagaatggcgtgaacctgggaaggcagagcttacagtgagccgagattgggccactgcactccagcctgggtgacagagcaagactctgtctcaaaaaaaaaaaaaaaaaaaaaattgttggccaggcatggtggctcacgcctgtaatcccagcactttgggaggccgaggtgggtggatcacgaggtcaagagatcaagaccatcctggccaacacagtgaagccccgtctctacttaaaataaaaaagttagccaggcatggtggcgggcgcctgtagtcccacctattcgggaggctgaagcaggagaatcacttgaacccggaaggcagaggttgcagtgagccgagattgcgccactgcactccagcctggcgacagagcgagactgagtctcaaaaaaaaaaaaaaattgttggccgagcaaggtggctcacgcctataatcccagcactttgggaggccaaggtgggtggatcacctgaggtcaggagttcgagatcagcctcgccaacatggtgaaaccccgtttcactaaaaatacaaaaattagccaggcgtggtggtgggcacctgtaatcccggctactccggaggctgaggtaggagatccacttgaacctggaggcagaggttgcagtgagccgagatcatgccattgcactccaacctgggtgacaagcaaagtcgatctcaaaaaaaatagtggccgggcgcgatggctcacgcctgtaatcccagcactttgggaggccaccgaggagatcatgaggtcaggagatcgagaccatcctggctaacacggtgaaaccccgtctctactaaaaataaaaaaagttagccgggcatggtggcaggcgcctgtagtcccagctattcagaacactgaggcaggagaatggcgtgaacccgggaggcggagtttgcagtgagccgagatcgcgccactgcactccagcctgggcgacagagcaagactctgtctccaaaaaaaaaaaaaaaaattgtagatctagagatgtgttctaatgctaatatataatcaccaaaaataataaggttttgctcagttgtttaacttctgtcttagaagagaaacagaaaagtgatgctgaagaagatggtggcactgtcagtcaagaggaggaagacagaaaacctaaagcagaggtaaaggaaaggggtcacacattttgttttaccaagctgaaggtacatttatgtaaagggaatattttaatagggtagtttacagtggcttatggcagtaaaaattctgttaaagccaattttgttgaagtgggattctttgtgatacaggtcagtgttttgtttgataattttaagctacatattaatctcagaagtatctttttagctgaaaatcattttctgaaataagcagaaggttatagggggaaaataaaatgcttgctaagaaggaaacttcgggtcattaacagtctatttgcctctcctcactgtgccctgaaaagtatttcttatacaaatcactgtgttctaaactttttgtccccgttgtccatagatgggttcattcattcatttaactgacatttgttgagtgcccattttgtgccaggcattgtcagtgagtaagacagacaaagatactctgcctttagggagcttaaattctacttgggggaaacaggcaatgagcagtaaacattttaaggaagtaaacaacacagcgtattaggaagtaagaaacgatgaataattaaaacaggaaaagatactaaaagtgctagaggtaggcgggtcaccatgttaaaaccttactcgaaagatgacatcgaaccaaacacttgaaagaggtagagaacttttccatggggatgtaagtgggaagagcattccaggcacagagaacagccagtattgaggcctaaagtggttgtctacaaggccagtatggtgagtggacagagagagtggagaaaagaagggtggagaaggctccaggttagacaggctgttgtgtggacttggctttccctcctagtgaagcgggcagccatcacaggctactggacacaggtgtcacaggatgatgactgtgtctgctgtgtttcctatataccagggagaatcagggcgaccagttaggaggtccctgtaatcatctaggaaagatacggtggccccacaaagggtgacaggagaggaacagagggtatgagaactagttggagatctggatcttggttttgtggtagattggatatatagagtatgagagaaagggaacagtcactgtctgtatgtaccattgcttactaaagtcctttacccagcacctctgtgtctaaatctggtctctcccggaaagctctcctcaggttttactttcagctacaactctgccttcctattaataaagatcattgctatctgtatcttttgtatattttccatggatatgttctgtcttaactagaatgcaattcttaaaagtagagaccatgtttcccccaaactccctcacacgttaaaaagttgctggtgcatttaaaaaaagggaatattttcatagggtaatttacaatcttagcaacttgtgatagagtacagagcagcagccttggagtcagtctacttggatagccttccatcttcatgaatccttggtttcttatcctcagaatggggctagtgtgccataggccagtagattgtttgggattaagcaagattaagaaatcacagtgtctgatccttttttaagaaaatgtttatgggttagattgagaaaagtgtatgtttatagaaaacaataaagactaaactgaattagagtaggcataattccaccacctctgagacaaccattcttcttggtgcattttcttctcatcattttcctcatttttttcctcaaataagttaccctcagtctggctgatcttgaaaatatggtgaacttttattattttttaaatgtgctaattataatgaatttcttttcaatcaataggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtc

SEQ ID NO: 35596 - DNA, 5044 bp, Homo sapiens
gggcgggtcttcttccttctcgcctaacgccgccaacatggtgagtcttactgttgcgggctccggggccgtcgaccatgccgctcgacctccacctccgctgggaagctgaggcgccaaacggctcccagagggtcccgggaagcgcatggtgagggtccccgggccggctgtgcagcggaatcgggcccttcccggactcgcgcccttcccggactcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggcgggcgttgggaaccgggcttaagctactgaggcgtttgctgatttcgtccatccaggttggcgcctggctctcgggcgtttgttccctgcagcattctttttcgctgaatttaaccatgttgtctttagctgcagaaggtgacatatgtagcgagtatttctaagtaagtttcactgtcctttctcctccaattttaggtgttcaggcgcttcgtggaggttggccgggtggcctatgtctcctttggacctcatgccggaaaattggtcgcgattgtagatgttattgatcagaacagggtaagtgtcacaactttttactaaacatggcagtggacatgtgccctgcagatggcaataatgaattgtctcgatggctgtgtaagatgaggatgctatgggtagtcgctttattttaccattgaggaaacaggtaatggtacgggttttaagcacagcctgaagttagctattagtattgaatttcagtattagccacttaagctagagccagttataggctgaaacgttggttagttttaaatgagttactatacgtaaagtgagtttagaacagatccagcacgtagaaagcacttttgtatttactgctgtgtatttgaaacaagcaaactaaggagttgaccactgactataaatcagcagggatcagagtcctaaagttgcctgtaaattacatgtggttggtttctatggggtactatatagtttaagaaggagcatttaatgatgtggagaaatgtttgtgttgagcaaaagacatacatatatataacccagataggacaatccttgtcttttctgagcaatttattaaaatagtagtgtgggtttgatggccctgaacggataagtaatgttacagaaccatctgaccattttaattgctgttagattttgcactgaagttcttgatgtttgtgttctaggctttggtcgatggaccttgcactcaagtgaggagacaggccatgcctttcaagtgcatgcagctcactgatttcatcctcaagtttccgcacaggtaactgtccactaatcactcctccctcccatccccagatttgtttatgctagtaaaagtttgttttggagtaaacaatacggaagattcagagccatcctgaagagggatttgcatcatagaagtagacagggattatttacttttaaaatgtcttgcctgcgcgtgatagctcatgcctgtaatcccagtactttgggaggccacggtgggagggtctcttgagcccaagtttcaagaccagcatgggcaacatggcgaaaacccccatctctacaaaaaataaaaaaaaaattcgttgggcatggtggcacgcgcctgtaatcccaggtaggggggccttgggggtgctgagttgggaggatcgttttagcgaggtcgaggctgcagagagccgtgatcatgccactgcactccagcctggatgacagagtgagaccctgtctcaaaaataaataaataaaataaatgccttgaggtcacttttctatcctggtagtttagggctttgcctttgtttagatttgccatcttcttttcttctggtttctgccaaatttttagcttaaagtaaacaacaatactaagtcttgtgtttattgctactagctatcattagataagctctcagtgtgtgtcagttacacagtatttaatataagaggttttatccctagcttacatttaagtgaggcagtgaatagcagttcttttttgacatgaaaattaaaacactttagtgtgttgctatacagttaattcaacccacaatgatggttgcagtggaacatgtaattttgcatgctttaaaaaatagtcaaaaacttgctgtatgttggccgggcgcggtggctcacgcctataatcccagcactttggaaggccgaggcgggtggatcacgaggtcaggagatggagaccgtcctggctaacacggtgaaaccccgtctctactaaaaatacaaaaaaaaaatattccgggcatggtggcggacacctgtagtcccagctacttcagaggctgaggcaggagaatggcgtgagcccgggaggcggagcttgcagtgagccgagatcgcaacactgcactccagcctgggtgacagagcgagactccgtttcaaaaaaaaaaaaaaaaaaaaaacttactgtatgctgagcactacaggcactgtgggacgtgtattaacacataatggattttgaagtactggtagttgaaaacatgccacttgaacaacctcgagtgaacatagccatgctgctactactgtgacataccaattaggggtgaagcttgaggatacttgtcaaagttcaaagcagtagaaaatacttggtaacttagatttttcactaggtactcttgtaattctgccttggatccctggacaccctggattttatttttaggatgtttggccacaaattgttactgtaaatttttttttaaaaaaaagcctaacagttaatattaattaccttgtttgttacgagaatgaatggctcggatgtgtgcagtggctcatacctgtaatctcagcactctgggaggccaaggcaggtagataacttgaggtcaggaatttgagaccagcctagccaaccccgtctccactaaaagtccaaaaattagcccagtgtggtagtgtactcctgtagccccagctatttgggtggatggaacagaagaattgctagaacctaggaagcagaggtcacagtgagccaacgttgcgccagtgcattctccatcctgggttacagagcaagaccctgtctcaaaaaaagaaaaaaaaaaagaatggttttcaacacgtccactgcccgagtggaattatatatagtcagaggtgggttttttgtgttttttttgagggttttttttttcttttgacacggagtctcactttgtcacccaggctagagtgcagtgacgcaatcttgactcactgcaacctcaggctcccaagtagctgggattataggcacctgcaaccacgcccagctaatttttgtgtttttagtagagatggggtttcactatgttggccaacctggtcttgaactcctgacctcaggtgatccacccatcttgacctcccaaagtgctgggattacaggtgtgagccactgcgcctggtcaagaggtagtttttaaattcataaaatgggctgggctgggtgcagtggctcatacctgtaatcccagcacttcaggaggccaaggtggagggttgcttgagcccaggagttggagaccagcctgggcaacgtagcaagaccctgtctctacaaaaaatataaaaattagctgggtgtgctggtatgcacctgtagtcccagctacttgggaggctgaggcaggaggatggcttgagcctagaaggttgaggctacagtgagccatgatcatactattgcattccagcctgggtggcaagcaagatcctctctcaaaaaaaaaaagggactggattacagttttgattaaaatatgcttgaagttaataacctattctggcttactgaacacaaaaataagtaaaatacatagtgtaccaggtgttgtgtaacaggaagagtgcttttcaaggaacaaagaaagtgtctttgataatgagtgacttcaaagctgatttcttaatctgtggtcttggctcgttctagtgcccaccagaagtatgtccgacaagcctggcagaaggcagacatcaatacaaaatgggcagccacacgatgggccaagaagattgaagccagagaaagggtaataacttagggtcatttgaattctggtcctttctttttttggagggttcaagatagtgtgagagggataatttttatttgttgttttttttttaacagaaagccaagatgacagattttgatcgttttaaagttatgaaggcaaagaaaatggtaagatttaagatctgtatttttgtgtaacttagctttaaataataagggagcagtagccaaatcccatttcaggctgccagcttcttggaagctttctgtaaaaaaggagaatttatcttcatttgtatttcatgatgtccctatggaattgttacctttcttcagatgtagttgtagggaaacagactacttaatgccctttctaaaaccagcataaattggattttattgtatgtatacacaataagtgctttcttacattgataattttcagaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatc

SEQ ID NO: 35597 - DNA, 8671 bp, Homo sapiens
tgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggtccttacagttgtgggttgtgtggcttcttgccaggcagctgattggagtttgcgactgtgggttggtgagagtggagagcacagaatgtttgctggaatgcttccctctgcccacaggaagacacctttggcgcatgtgttctggtcagggcaaaggctccgtggtttccaccgcaagattgcaggagccttgaggcctgggccacagttttctcccttgggtgtgctccatggaaggtggctttggtgaccgccctgccactggtctctccccaggcaggcaggcagcctgtgcctccgccctgtctccagcggtggtggtgtggctgtgcttctgcaaggcccgcatccactcactgtctgccctctgcactctctggctggccagggcccccagtagtctgctcattgtgccctcacgcttgggcagagccgaactcaggggacccaggaagagcggagtgttggcccgtccagagttcttggcaattggtgtgtcatgtgtgcctcgtgccctgtgctgggcgagagtgggcacagctgcgcagacaacgcccttggcgaggctggagcctggacccctgcctggcagcagctgggtgaactggtgtcttctgcctgcgggcccagcctcacctcaatagcttactgctccctcaggagggaggaggggaggcctgggagcctgggcttggcggggtaagggtggtgcaggggcaacacctgtggaggaaacaggcggggttggggcccaccagcgtctgctgtctgctctgtgctgggttgcatctgttggtgtctgatcgttgtcagggccctgtggtgaagagacacacctgccacttgctgcttgcgaggaaagggggagatccccaacccaggagccagaggtgggactccagcaccccccattcctgggagttggaagtgaggcacgagctccccaattcctgggcatcggggatggggtttggggccgaggaggggatggagaccagggtcttgtggtagtttggtgggatcctcagaaggtgtggctctcccccttctgaggacgcaaaaactcccagagtttttggcgattgatgtgccacgtgtgccttgtgccctgtgctgggcgagtgtaggcacagctgtgcagacgacgcccttggcaaggctggagcctggacccctgcctggcagcagctgggcgaactggtgtcttctgcctgtgggcccagcttcacttcactagcttagcgctccctcaggagggaggaggggaggcctggtcagtggaggtcaccactgtgtttccttctgtgtgggtttatagtcacgtagcatctaggttcagacccgaagagcttggagccaggggctggggggaacagggcaggaccggccttggggcagccctgtcaggcccaccagtgccatgctggttgtgggttggcagggcagagtgaccttaagaagggccagctcagtggagcaacaggacagaagctcacatggggtccagcccacaggaccatttgagtagctctcccatatcgggtccttcgaagcacatgatttagctttactttttctccttcgtattagaaaagtcaccataataccatcaagtcataatttctgtgatctcagtgcttcaagtaggtgtgtagcaattgctggatgtgtcctgagaactgtaccccttccaccctggcgagaagcaggggccagaaattcacacaagtggcatggctcattgattgtgggagactctggggggctcctagctagtgcattatgggaaccaggctgtggaggttgcagggctcgctggctgggagaagctgaatggataaagaaccctggccactgcagtgcgtgctgatggttggctggcacgtagaggaggtggcagggctgggtgagcagcaggagccaggttagtggggaggcccgagctaagcgcaggggcaaattctgcgggtgggagagccaggagggcatggggtgcatggtgagatgaaaacgatgtgtgcttgtgacaaaaagcccagaagaggcagtaaggagggaggagtctatcccttatggagagcacatggacttctgggtgggtgtcctgcagttcccttcctcttgagtctttttaactgggggtccggtgtgtttgtgatcaatgacatgtatgcgtgtgcatgtgtacctttgcaggtacacatgtgtggtgtgtgtgcatttgcttggtgtgcgtgcatttgtgtgtgtgtttgtgtgtgcatgcatgtgtgtgtgtttgtggtaggtttgtgcacacatcctgcatacctttgtgcctgggagtggcatgtgtgtggtgggtgtcgctgtgcatgatggagttgcagccgtggtgcatttgtgagattacctcggtggcctaaattggggattaggagggcatcctcaggtccttcccactgtctgctcgtctgcccacaggcggctgtgccctaaacaggaggaggccattcacgcctcgcctgagttgtgtccaaggtgtgcgtgtggccaggggtccatccgcttccctctagcccagcccctgaacacagctgcagtgcacggccccactcctcagctctgctccccatcccaactcgaagacgctgccctggccctgtgtgtgcagctcatgtggactgggagggcagggcaggtgcaggtcttggggcaagagctggagctgtcttttccttcctgcacagccgcagagcaggtggatggggctgcttccctgcaagggcccagggccaggccccctggggatttattcgtggcttagaagggtggggccagaagcaggcgtagtggggattagggactcagcacccccagctctcagtccagcagacagacccaccccaggctgactacagaggctgcacctcagcaaacaggtaggccctgttcttggggaggattcccaccaggcaaaggccagctcccgggccctcacctgccacgtgtccaagctaggatcctgtttgcctttcccttgggggctgggagggaggcctccaaccccctctggcattaccagcatcacagataggagtcccaagtcctatgagaagttcctggaataggtgtagattcagtagatctttacaagaccatatctgcagggcaaggtaccagaggacagaggcggggacagggacacttccattccagacctagcagcccagcactcagcaccatgcatgggagcaaatggctggactcctgggtggggtgggggtctcagagcaggctcccagagggcttggaggtgactccaccaggtggggacggcagctcccaggtagggtgtcatcagagtagacagcattgcttgctagggacccctggggaggctgacagggtcagtgggtttcagttggggggctcccctgctgagaacccagtaaagccggccttccattcgtctcccgtgtgcccagagcctggtctgagggccgccctgtgcatgccggcccttccaacgtggcagagctcagggggaagaacacccaggctctcaggagactctcaggccaatgtctccatccctgggtcagccctttcctgccatgaattcaggaaggcagaggcagctcagcagatggggactagaggccgcactgctatccacagcctctcttctcacccccaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaaggtgagtggggtggggccctatggctggagcacccccagtgtgggcagggctgctgggccctgcagctgtgttggctgtgctgcccgtctcctgcccccatcaatccctaatctgtgagatgggtccttgcctccaagggccggtgaactcaatcagggtgtcagcgccacagcgtggtgtcgccttccttgggtacagtgtgagaggccggccaaggcctggggctgtcttcctcccaccttggaggcggccacagtgctgctgtccccagccctgtcctggactcggcacttatcagcacttttgagctgtcttctggagtcctggtaaaaagggctactctgcctgcctgattcaagacaagggacccccttcccaacagcacccccgccccttgccgtgcaacccagtggtctccagtcaccccaccacatcgtcccctctgtaacctgacggtctccagttcccccaccaccttcccccagaacctgttggtctccagtccccaccccatcaccaccaactcccaactccccactggaacccagcagtctcgtatctccatcagtgaggacagtgtgagaaatggtgtctggctcaggcacttggcagcacttgaggggtcctcagatgtctcctgcccagcaaggatctgactaaagcagtcgtgggtgtgggaggggcctgcaggcatgcctgggttgggggcagctggccctgggcaccctggtgcaggtccagtctgccctctggatggcccctcctcttccccagattactactttgtaaccagggaggtgatgcagcgtgacatagcagccggcgacttcatcgagcatgccgagttctcggggaacctgtatggcacgaggtgggccatgcgtgggtgtgggtgggctcccagggttgctgttggcaacagggatccaggtagtgcctgctgcctgcccgccatccacaccacccaccccatggttatgaatgtggccaggttgtggcccagggccaggctcccacgtctgtggcccacagtggctcttttcatgaggctgctgggcccggtcctgccaccgtgcattgtcctggcagggtgaagggtgcacaggacacctcatgctcactacaggcaccttggggagtgggtggcctctgttccctgtaggcggggcagggcgtgggggtagcaggtttgagatgctgtcgggtgctgggtccaggccaggcctaggctcagctgtgggaggagaacgctgggcccgggagggcctgggtgtccctgaagctcctgtaggcctcagagagccctggcacccctgctgacctggcacctctccccagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggtgtgtgctgggcagggttgggggctgggggccagggcatgccaggctctgattgccaccccctttttaggagcagcggctgcggcagcgcaacactgaaaccgaggagagcctggtgaagcggctggctgctgcccaggccgacatggagagcagtgagtgtgccgtgggatcaccagggaatgccaggaggggagtcagggttctgaggtctgtggcaccagggaccctgtgggtccccagacctcctgacacctggagtccctgtgagggtcctcagacctctcaactacctcccaacacctagagtccccgtgagggtccccagaacccacccccagtcaccaagggtctcattgagggtcctcagatttccctctgttacccagagtctccgtgagggcccccagaccccccatcgcccagggtcccatgagatgtccccaaccttctagccccgggggtgtcatgtgcatcctcttacagctgttgcctcttctctgggtctgactgcagcccacaagaagagggcatttaatgttctgctgtgtgtgtagaggatagtgtagcccctaaccagagtcctgatgggtgctggtgtccagacccaagttctggggctccagagagagcaggagtggtgcctgaggactgaggcccagggggcggcccttccctaccctgcacaggcccggctgggctggaaagctgtcccacagccgcagtgaggacagccgcaggccagtgggctgctctgggggtcgtgtgggacctggggtggggctgcatgggctcactgtgccctgaccccaggccccacccacaggcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggttagatgggacagtcctacccaagcactggcatgagacaccgaggtccacggtggagggagagcaggaagcccagcccttcctggataccagccctcccaactccctttcttcctcactggcaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactcca

SEQ ID NO: 35598 - DNA, 3356 bp, Homo sapiens
gacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgctcctgaccggcccgctcggtcacaagccggctgctccggttcctcttttcccagtcgctttgccctcccccacccacagcttgttgggtaaacagcggaacggactgggccggcgggatctggctggagcgcttgctccctcggtcccgcctcggattcgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggtaagggagggcagggggaggattccccttgaagcttcttccctgcagcctctcttcttttctctggtctgagtccctcccccacaccactgcctgcctgggacatggacctttgggaaatacgcggtcagttgttgcctgtagaactggtggtggggttgaagggggtttgaggggttaagattttgtgctccgcttccctgctagagctgaactgctttcttctctgcttccacaacaggttcctgacggagacttcgcccttcatgtggtccaacctgggcattggcctagctatctccctgtctgtggttggggcagcctggtgagtattggggtggtgggactgggggcaggggctgagtcatggcaggtggtgtcactggggtcttaggcatgctgagggcagtgacagcttgggctctgctcatcagttttttatccttccaccaggggcatctatattaccggctcctccatcattggtggaggagtgaaggcccccaggatcaagaccaagaacctggtcaggtaagtgtcagggtccttggacttttgtcagaaccagctgtgttggcgctgcctgtgtgtttgatctgacatactgtttctgacaagccaccttgtgggatgggatgttataggggaaagattgctggggacttactgggcaggaaggacggtttctttctcatttctttctcctttccactccttacccctaatctctaccactaccagcatcatcttctgtgaggctgtggccatctacggcatcatcatggcaattgtcattagcaacatggctgaggtatggaaggccagggtggtggcgggaatccattccagtgtgttctacacattccttagagattggatggggtgcatcaggatggtttctgattacttttcttcttccctcagcctttcagtgccacagaccccaaggccatcggccatcggaactaccatgcaggtgggtggatgggcgtatgaatgcaaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtc

SEQ ID NO: 35599 - DNA, 5648 bp, Homo sapiens
tccgcctcttgccttcggacgccggattttgacgtgctctcgcgagatttgggtctcttcctaagccggcgctcggcaaggtaggttggcggcctgctctccgacagaacttttcttcttgggttgaggaaaacgccttttggagtcaggccctggaggggcgagccttgctcacagggtggggatacagccgattacccgccctgtgctttccgatggcttctgcggggcgagcggggcctggccggggggtgcgggcgggagggcgagccagcggcgcctgcagcccgggccgcgtaacgctgaccgctgtgccttcagttctcccaggagaaagccatgttcagttcgagcgccaagatcgtgaagcccaatggcgagaagccggacgagttcgagtccggcatctcccaggtgagagggtttccctggggtctggggtggggggaggcgccccgcccgggaggggaggcggccgcgcgtgtgttgggcccggggtgctcggacgcgcgctcagggtcggtcctgctgttcgttgcttcttaggctcttctggagctggagatgaactcggacctcaaggctcagctcagggagctgaatattacggcagctaaggtaagctggcgctccctcggctgggagggaggttgcggcgcgtctccccgcgcagtgcctgagagggttggacctgggttacggttgatgatgacttgccgcctggccgcctaacctgaactcaggttcggccgtgttgtttgggagtgataccgcccaggtgcggggagtggggttgcaggtaccctgcggcttaagctgtccacatgcgggcggtggagaaacgtggagtagggagggcctgggcccatttcggaccttatttgcccttacttagttatagatacggcaaagagctgtggggagctcaggatgagattctctctacccttagcccggagttgccgcaagtgggggtgcagaagtggtagtgattggcctcctggcctgaacagtctcccttcctggaataaggaaatgtgaaggttggagagagatgagaacatttccgaaggatgcatttatgattaactcaaaactagtattagtttgtagtgcagctacggtgttagtgataaggtcttcttatcctctaatttgaccacaacgtttactttctgaagcagttaacacagtggatttttgtttttttctttaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcaggtatctgttctactgttgcagcacgtttctgtttgtgaattttgctaaaattgcttgtatttagactgcattggtagttggagtcatgaaaacaatccttttatgaatccaattgggtagaaagataaagtacaggcagagcgccgtggcttaggcctgtaatcccagcacggggaggtggaggcgggtggatcactgtagagaccagcctgggcaacatggtaagaccctgtctacaaaaaatagaaaaaataagttttaaaaagaaagataaagtacgttctttaattaagagtcgaaacaagaagtctgtaaagtgacagactgctgtgttttgagttatgaaaatgatttcccatatttaaatttccacaagtctagtgggttgcttacatagatgatcaaactaagaaacctgttacaggccgggccctgtggctcactcctgtaatcccagcactttgggaggctgaggcaggcggatcacgaggtcaggagatcgagaccatcctggctgacacggtgaaaccccgtctgtactaaaaaatacaaaaaattagctgggcgtggtggtgggcgcctgtagtcccagctactcgggaggctgaggcaggagaatcgcgtgaacccgggaggtggagcttgcagtgagccgagatcccgccactgaacttcagcctgggcgacagagcgagactccatctcaaaaaaagaagaaacctgttacagttcggatgggggattggtgcaaactgaagtctatggggaatgaagtgccaggattgatctggaataaaagtagtattctgggtcataggcatggggaaaggcgtatctgggagattttgtccactggcgtattagtagaggctgtggattctgaatgatttattcaagaatcaggaagtaactccatagaagggtttgctcagtcaattgttcgtctaagttgtttagccttctcgaactttgaacttaccctgccattcttcttgcttttaaagcagtatggcagttacagctttttgtcaatttaaagtcttttttcattttgttacatgataatttttaccttacagaggagaattctgcctaagccaactcgaaaaagccgtacaaaaaataagcaaaagcgtcccaggaggtgagtattttagtagtttcagaaatgtgtgtacccctcttattaacaactcttaatttgtttaagttgtagtttatgaaaacagatgttcaagtgggaatttttgagtagcagcatttggtttcctgtatagttgcacatgatacgttttagaattctagatgtaaaacatacatgtattcatgtagccattgtttgcctactaggtcagtgctgtcacaagatgagatgatttcctccgattatttgtgcacaggataggaatgatgagaaggaaatcattactttaattctgtgatatagcatgctagacacagttgacatgggcttggatttatctttgatttttatttttgctgtggattggaggtaaaaaaatgtaggtggattttggtgataacatcacaggttaaaatatcactgcagttgaagatgctgatggaaaatgatttatgaacttgattgacttacaggttatctggcataaactcaaatattggtagttgtcttcttgaactagatcttttggtattttgttagtctctgattagtatgttgttttacaaatgtgaactattaaatccctgtggactcttccctaaggatgagttgaagaaaaaaaaaatcctagtgttgcctgtgccctctaacatgtttaatttgtattgttactctcagtggatgaggaaactgatccaaggctgggataatttgctgattgcagctagtactagtagtgctaagaatgttttttttttaactcggtcttgttctgaaaaccactagaacacagtgttgggagtctggtaatgtgttattgtgtcgagctgtggtatgtggaaaggtaggtgccagcttttctagaacttgaattctatggcttagtactttgaaaaacttttaaaggcagagtggcataagaatttaggatttttttcccctaaatcatgacacttaaagagggttttggaaactcagttctgagaacctcagttaggaaatgagtataagaacagtcccagaggactgtccctcaaatccatagctttagtttccctcagtacaaacctctgttttccaaattttctcagacaatggcttcagtgtttctagtgggacctagtctgtacattgaaagccttcacactaagcctagctggtaggtcatagtgattctaccacttttccaatccggcttcctgctttcagatttattttccctattcagtagagctatctttatctaactcaggttaaatgctgaaattgatagtttttgggtatagcagggtttttcctctaaagcgctccagtccctgtggtttgtgatgattgagttatggtgccattgctccccattttaaaagattgtagatgacattggaatctaatttccgtatttgggtgctttcctagtattgtaagaatatgcttaattaatgagtcgcaatgaataatccgtttgtcttgatttgctttctgaaaggtgatgagggttttgggaaatggactttgttcaggcttttgccctttgtggctgtgacatattaagatgttggcagtaaaattgagagccaccagaagatgttaactgtgtatatgggcgctgccagataggaaatccaaatgagtagactatagtgttattgttagctactatggggtgagacgtagacagataaccatatgtaaggcagctccctaaatgctgaaacaaagaaccgtctcttgacttactcctgatgtctcatggtacatggtagctgccccaaaagcttgcaattaattgaaacttctcatttgttaggtggcaggtaggtaggttttgaacttggtagtgatattcagacgaggagcaagattccactggcagttctgtgatgctaagtaaatgatgtgatcatatccgtgctttagaaagattatcttgacattggaagggggtggttttggagatgagcaagagtgttaaaggttattgtagtgatttagttgagaaataatacaagtgaaaataaagatgtataaaagtcctctaatctcacattccctagagatggtcactcattgccttggtgagtttgtagtttatcccagagtaacatttaaaattgactgagcttttgaaataaatcagtaagctattaccctattctaggtaggcaaaggctttagtttggtacgtgaaatataacaagcttatttgaaaatgagtgttaatttgacttcaggaacctgggatttgcattttcattttgacttaaagaggtgccctctggagttgcccagagggcaggcgttgctaggttgcttaccttttaaactattcttttagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttagtgtaaccagtctccatgcgccaccatagcaatgactgtagtaaactcaggactagttcttttacccgcacttcagcctgctctcctttggattatgtgtcaggtgttaaatggagatgtttcaagaattgaacacttgaaattctctgtaccttttggaagtagactctttctgtggtcttttagttaggctgtatattcttggtgagttaggggtgggtggtgatgggatcagtgtcttggggggacataaccatgtgggtgactgctggggtcccctgatggcttccccggtgcagtggtgtacagttctgtcccacagcattggagaagagcttgtccccggtcgtgaagactgctgcagacatgttgtgtgtacttagttgctgaggagaaaaacaatacagggcacaatttcacgaaactattaggttttaagctgagtgtgtatttcaaagttctgtgatgaattctttcttttcttgtaggttgaaactttttctggtgtctataagaagctcacgggcaaggatgttaattttgaattcccagagtttcaattgtaaacaaaaatgactaaataaaaagtatatattcacagt

SEQ ID NO: 35600 - DNA, 6053 bp, Homo sapiens
gcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccgggtaggtactgggcaccacctctctcgcctgctgaggtgggtatcgtccgcggatcctcgggtttctcgcggagggagaggaggggtcgcgagtgtagcggcgacgggaggggacctggctgccctggtccagcgggcccccagccagcggacagggcccgggcactccgaggcggcctgccggcgcgtgccggcgctccggttactcgttatctgccccgggcgcgggccaggccgccgggcgccctgagtgccgcaccgcggggcctgggcgcgtgtcggggcgcactggggcccccgcgtggaagcccgccggttccccggctgcctcggaccttgcctgtatcaggaatctcgaaatctcgccagcgctctgcctgacagagagaaacccgatcgcgccctgactcaggcccaatctccgcgatctcccgcgcacagccggcctgccagggcccggcgttcctgggcgctgctcagcaaggcattgtgctcgagggccccaggggcgctgggaggtgcgcgggccgtctgggcctgccggcttcctccgcggggtgcggcttgccaccctcacccctacccctatccctatctccaccccaaggcctaccctgggctagcgaggcgatctcctgagataagaagtgggcccgcgtctgggatttgctttccgttgacctctcccgctgaacattttggacttacaaacagctgaatgattctttttgtattcaacaggaagtaattttatgccaagagactaagactgtagtttttgttgacttcttgtaggtgaaatcccagttgatgtgactttgagatatcttgtgtaaattatttagtggccagttgtatttttgggattggatctcagataaagctgggcagattggctgatttagatagaacaaattttgtaaacagttttgttaaatttaggaaatataaaatctaagaaaaacatttattctactaatgtcggttagattcaaaacgttatcaaaaatttaattaggttcctctaggtaaattaaaaaaaaaaatactttgtctctactcaggggaaattctttggttttagaaaaaatatttctttttaaagttcgcagttgcctttgagaaatggttcttgaaaaatttacatttgaaccaccgaagtccaactgtagaacggcaggaagcattctaaatgaatcagcattttgtagggagtacccagtagaattactcctgagacaaataagtgtggatgggttttattaaaacagctttcacttcagcagtgagcaagagattcgaaaatattcatgtcatatgtgtatttacagacactgttttaaataattagtctaaatgctaaagaatatcatatatatactcttcagctttacacaaaaggataggtatatttcttaaatagttgagtaaagtgagaatagatattaatcaagtatcagacaaatatgtagttacaaaactgattgctatcataaagaaaaaaaaaaaaccaggaaattgcacaactaggactctgacctgggagtaatgggacggggagggcaatcagaggtttttttctgttttttcttttttctcccagaaatcatgtatgtgctgggaatggaatggcggaatgactagcagtttaaattagacggaagttggggtttggagggggagaggatcattgaaaaagctctgagggcagagagctcagaaggccagttccatgtgaagacctgcaggagatctggagaggcaggcaaggattagcatggccaatttttatgcattcattggctcccagtttaaatgtcactgcctcagagttgttcttaaacacttaatctaaatcaggcttttcctgtaatgatcattcatatttttcctttgtaacatgtatgacctttggtgattatacttttaaagttggtcttcccataagacttccatggagtccgggtgcagtagctcacgcctgtaatcccagcactctgggaggccgaggcaggtggatcacctgaggtcaggagttcgagaccagcctggacaacatggtgaaaccccgtctctacaaaaacacaaaaattagctgggcatgatggcacgtgcctgtaatcccagctacttgggaggccgaggcaagagaatcacttgaacccaggaggcggaggttgcagtgagctgagatcatgccattgcactacagcctgggtgacagagtgagattccatctcaaaaaaaaaaagacttccatggaaaggaccacggcaccattcgtaatgtgtacacttctgttttcttagcatctagtgccctccatgtagttactgctcagtaaatacttgttgaaataagttttatcctaccaatatactaaaagtttgatttatttatttatttctcttttccctagtgccttgctttccatgacatttcccctcaagcaccaacacattttctggtgatacccaagaaacatatatcccagatttctgtggcagaagatgatgatgaaagtgtaagtacatttctaacatgatttattttcttgctttttaaattgtgagattaattttgtccttaaagtgctgtcacattttcatcttcctaaggtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccaggctgcagtgcagtggcactcggctcactgcaagctccacctccctggttcacaccattctcctgcctcagcctcccgagtagtgggacaacaggcgcccgccaccaaggctggctaattttttgtatttttagtagagacggctttcaccatgttagtcaggatagtttcgatttcctgacctcgtgatccgcccgcctcggcctcccaaagtgctgggattacacgcgtgagccaccgttcctggcctattatattcttaaagtaagctagagaaaaggttattaagaaaatcataaggaagagaaaatatatttactatttattaagtcgagtgaatcataaaggtcttcatccctgtcatcttcatgttgagtaggctgaggaagacgaggggttggtctagctgtagctgtctcaggggtggcagaggcagaagaaaatttgcatatgagtagacctgcacgggtcaaacccatgttgtgcaagggtcagttgtatttacttggggatacctttttaaagtgagacattatttctgaaacttagaaacttcaaggcattaatttttaattcaatatatttgtacaaatcacagagttcaaagattagagcgagtacttaatggtaaaataccgtcttatatgcaataacattaaaccctcagaatacatttttttcttttttttttttttttgagacggagtttcgttcttgttgcccaggctggagtgcaatggcacgatctcggctcaccgcaacctctgcctcctgggtacaagcgattcccctgccctcctgagtagctgggattacaggcatgccatcacgcctggcttatttgtatttttagtagagatggggtttctccatgttggtcaggttagtctcgaactcccaacctcacgtgatccacccgcctcagccttccaaagtgctgggattacaggtgtcagccaccacgcccagccccagaatacaaatttttaacatttagtataattagacagtcatggcattttaaggtcagagcttcttactcaaatgcagctcttttctgtaaggacaataaaatgttaatttttactcagttaacattctaaattagtgttttaaggtcatctcttttacttagaagacagttgttggccaggaaacgtttactgaaccagctttaaaaccgtgctaattcataattaaatgttgtgaccaatataggtatctgctgtacaaaattttatatagatgctcatcaacttaagatgggcttacatgctgataaacccatcataagttgaaaatattgtatgtctgttgaaaatgcgtgtaagacacctaacttactgaacattatagcctagcctagtctaacttaagcttgctcggaacacttaacgttaacctacagttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaaggtaagcagagtccactgtcctggggcttaataaggtaatgggaatagaaatgtaagactctctcccttccctcttttcttgccaaaggaattaaaggagttccctttcctgagagctttttagaatgttgaagttaaccctcccaacttttttctctcataatgggaaagcataagcagtgaaatgggagttaaagttcttttctcttggcaaccttctcccctttaacttttattagggaagaaagctggcaacatacaaatagactccatgtgtaaatagagacaaattgactgtagatagaaccaaaaaacaaacaggatgacacagagcgagactaggtatttgccacaggatcctgcaagtcccgacaatgcaatagatctggtagtgttcaaaggaaaatccataatggtcataaggaagtcataaagaaagcaagatgtcttgctttattaagaaaacttaaaacagcacttggaatataattaagttttttttttggttgggcatagtgccttgtgcctgtaatcccagcactttggaagttaaggtgggcagattgcccaagcgcaggagttcgagaccagcctggacaacattggagaagccccatctcaacaaaaaaatacaaaaattagccgggtgtggtggcatgtgcttgtagtcccagctccttgggtgggtgaggcaggaggatcacttcaacctgggaggtcgaggctgcagtgagctgagatcgtgccactgcactccagtctgagtgacagagcaagaccccatctcttaaaaaaaaaagtttaattgaacagcagattttatttctaatttgtttcttgaaattagtaatgataaatacctaatcttaatgagtctccagttgtagattatgctctgttgggattaagagtttccaaatatttgctcaaagggttgtgtttcaatgagagttttaagatttgatatttcagcttgacagtttgttatttaatggcaagaagtaataaattgcctgtgcctaagaaactttttttccttttccagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctt

SEQ ID NO: 35601 - DNA, 44042 bp, Homo sapiens
ccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcaggtgagaggcgcccgctggctcctgctcgtgcagcaaacttttactgagcatctgctctgtgcggaaccctgggcttggggacactcgtgtccatcagatactctccctgcctggaggaacgtgaagaaataaagatagctactaccggtagctaacacgtactgagcgtttacggtgggccaggcgctttacatgcattttttttttttgcaagttcatgtctggctccagtatttattagctgagagttagagtctcagatcctgtatcttctttaaaatggggctatacaatagagcgttggagacacagggataagtcatacaggctccctatcctagaggaccgtaataaacagtaaaaatgccataaaaccgggccgggcgcagtggctcacgcctataatctccgcactttgggagggtaaggcgggtggatcacgaggtcaggagttcgagaccagcctgaccaacgtagtgaaaccccgtctctactaaaaacacaaaaaattagctggacgtggtggcgggcacctgtaatttcagctactcgggaggctgaggcaggagaatcgctagaacctgggaagcggaggttgcagtgagccgagatcgcgccactgcactccagcttgggcgacagtgcaagactccgtttcaaaaaaaaaaaaggcataaagccaaggacgagcactgattgaatacttaactgtgtgctaagcactttacttaaaatttgttttaaattattattatttttttgagacagggtctcgctttgtcgcccaggctggagtgcagtagtgtgatcgcggctcactgcagcctcgacctctcaggctcaggtgatcctcccacctcagcctcccaagtagctgggagtacaggcgcgggtcactacgcccagctaatttttttgcattttttgtagagacgggattttgccatgttacccaggctggccgggaactcctggactcaagcaatcctcccgtctggtctcccagagtattgggattacaggagtgagccactgcgcccggccgtcatgtgttatttcattttgcagacacaggtttagctcagataattaagttccttaattcatttgggtctcagttttctctctgtaaaatgggaacaatagtagaaactgttactagcatgtagtaaatgctcaatattactagaattttcattttagtgtgttcacatatggcatataccttcccctatatcagttgtggtttttccatttatattcatggttacgtgagtgatggccttctctcccattagacggtaacctccaccagctcagtacttagtcctgtttttgtttactggtacatccccaaagcctcctagaatgcctgagtagttttttgtaaaatgaatgaaatgcgatagaggtggatgagtgcactcatggagaggattttttttttttttttgagacggagtctcgctccgtcgctcaggccagagtgcagtggcacgatcacggctcactgcaggctccgcctcccgggttcacgccattctcctgcctcagcctccggagtagctgggactataggctcccgccaccacgcccggctaattttttgtatttttagtagagacggggtttcaccgtgttagccgggatggtctcgatctccagacctcgtgatctgtccgcctcggcctcccaaagtgctgggattacaggcatgagccaccgcgcccggcccgaggatttcttacagaaagtgtgaagctgtgccttgatggataagcattgtctgttgagtaacagtgatggcagaaacagatctgggtccctgggcctctatattatgggatcttaaaagataaacctaataaaattagtgtctagagttgcatttatattccttagtatagtttataaaggcttttttaaaaaatttatcacttgtatttgtgggtgaggggcatgggaagaggggagaactgaggacaccatggtcaagagacctacccagttaaataaaagggatgtctttataacttgtggctcccagggctagccacgtctgctattactataaatgcatttccctccattattaaagttataatactaaaattttggtaaataaaaggccgggtgggatcacacctgtaaccccggcactttgggaggctgaggtgggtggatcacttgaggtcaggagttcgagaccagcctggccaacacagtgaaaccccatctctactaaaaatacaaaaaaaaattagccgggcattgtgatgtgcgcctgtagtcccagctactcgggaggctgaggcaggaaatcatttgaacccaggaggtggaggttgcagtgagctgagatcacatcactgcactccagcctgggcatccgtctccaaaaaaaaaaaaaaaatagaaacagtgattctggtctcttaactctcaccttcctgctcatgttgttttttgctgtttggaattctttctggtttttaacctggctaactactatatagttattttatttaattttttatttttaaatttattttttttttaatttttttagagtggtgggatctcactccctcagtcacctgggctggagtgccgtggtgcgatcctagcttaccatagcctccacctcccaggctcaagctgtcctcctacctcagtcttctaagtagctaggactacaggcacctgccaccatgcctggctaatttttaaattttggtagagatgtagtctccctatgttgctcaggctagtcttgaactcctgggctcaagggatccacctgcctcagcttcccaaagtgctggcattacaggcatgagccaccacacctggccccctactgtatagttttaatcaaaatgtatgtagagttcatctagtagcatcccagccagacctcaactcctttactaactgtttgatttcttaaattagttaatttttggcttggtgcctagactttgggaggccaacgtgggaggatcacttgagcctaggagttcaagagcagcctgggcatgggatttcaccatgttgtccaggctggtctcgaactcctgacctcaagtaatctgcctgcttcagcctcccaaggcgctggtattacaggcgtgagccactgcgccaggccccaaatggtctttttaatggctgcattatatttcacagtaagaaaagcaacataattcaactctgtattataaattaagtctttattggacttacaggctcctttcagtttttcttcatttcaaacaatgtatgccaaaataacttccctagaagtgcaattgctgggttatccacatctaaagttggcatatatgcagtcatcttattctctgaaaaagagtctaaatttagttttaaatctcaactagactgtaatcttcttggtagctgaggttgcatactctttattccttgtggtactcttttttttttattggagacggagtcttgctctgtcgcccaggctggagtgcaatggcgtgatcttggctcactgcaacctccacctgccaggttcaagccattctcccgcctcagcctcccaagtagctgggactacaggtgtgtgccaccatgcctggctaatttttgtgtttttagtagagacggggttttgccatgttggccaggctggtcttgaactcctggcttcaggtgatctgcccaccttggcctcccaaaatgttgggattataggcatgagccactgtgcccggcctctcgtcatactctttatagacttcagcacatagtatgtctgcctaccttacaaggtttgggagaagatcaaatgagattgtgtttgtgaaaaatagtatttgtatagtgttttccagtttacaaagcactttgtattatcttatttaatctttgccaaaaacaagggagatattattatctccattttactgatgaaggaaactagaactcagaggtcacaattttgcaatgattacaaagctaagaaggaaggaacagtggatcctcagactataaatcctatgctttttttctattttagaccattccactgactagacaaaaatggtatgcaaatgtgaagtattactttagtgttttaggtagatagaaaaatccttatttgcatgtttggagtgattattaaagcagaggggttgataaatgaatttatgtttgcaattctttatcagtctccagctctttaaaatccatacctccctatctctcctttacacagggcccagatattacactgtcaaaactttacaagttaattgaagagtcttgtccacagctggcaaattcagtgcagatcaggtaaacttcattttcttctttatatatgaaaaggtgtgaaggtagatgaaaatcacaaaagggtatgtggtagttaattcttttaaaaagatacctttattaccctaggttgttttcccaagagcctttacttaattctgttttgttgaaaaatggatagctttttctttggagacagggtctcattctgttgcccaggctggagtacaatggtgcaatcagggctcaacgcagcctggacttcctgagctcaggtgatcttcccacctcagactcccaagtagctgggactacaagcatacaccaccaaacctggctaattttttgtatttttagtagagatgggattttgctttgttgcctaggctggtcttgaactcctgggctcaagcaatccctccgcttccacctcgcaaagtgctgggattacaagtgtgagcaaccgcacctggctgaaaaatgggtaacattaagcatactgttttatagcttttttccccaaattttattattccttatggatccatcttactctttttagtcattgcagataattgaatgtttattggttgatgtgatagtttgacaaattttatgatcaagaaaacaacaatgatacttttcagaaatacgggagtaacattttgaattatgaagtttgttttatgagccaccattttatacaaatctctgaattgcctgtaaaatacattatttgaggtaattgaggaatatgaaacatgagaaattattcaaagggcctttctaaaatatgcacctcgattttctcattcagaatcaaactgatggctgaaggcgagttgaaggatatggaacagttttttgatgacctttcagattctttctctggaactgaaccagaggttcacaaaacaagtgtagtaggtatgaaactcttctaagaagagcagagagtattttcattgaagtgagcagctttctaagtcatgtctatcattgttctgctatatctgtgaacagacacagtggggatgttggaggtgttgcagtttgtatttattgccttactgttttgatctatatttaaatcattaactgtggaaaagcaccttctgttttgtctacaatagtaagagtcagagcctggtcctggggtttttaggggttcccagctctttctcacagtcctctggatcacttgcctgcatggtccatctgtaagtgagggtcaccagcccagacttatgaagagaggtaagtaaaaatacattattgatatagtatgcaaagtgagggcatacgtggtgtttctttgatgcttttctattagctttatcccatgctctatccctctggcttttttgcatggtaatttttatgttattcagcgtgagctatttctctctctcttcctatgtgccaggctctggacgtgtaagatagacatggaatttcctcttatggagattacctctggttgggggagccagttggtaaaagtaaacacataaatatcatttcagatagtgtaacagccatgaagaaagtaaaatggaagccttcaggtggaggtggggtgggtagattgtgccctgtataagaagaaaccagctttgtaaaggactggggaagaacattccaggaggagggaatggcaactgcaagtgtctctttcttactcttctgaaggaagaattccagcagacagtcattgccattgtggagttgccattgcgtagcctggatgtcagttaatgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaaggtaatttggcttttctgacagggatccttttcctgtgaaatagtataatttcaagtgcaataagtccttgttcatttagaattcacgtgctggcttatgccctttttacccttccagatctgggaagttaactgataagggctgcaccagtgggtcccttgccctctgacttgtgattggccaatgggaggcactggcaggaaatcccaagggccagggagaatgacgtggagtgtggattcattggctccctttcttgggggtcctggggggctggctgtagggtcacagcttctgtcaggtcgctctttctgcactccttcagggggttcggtgactaggagcaagtgtttgcaggccccaggtgaaaggtaccccactgttatcagtcctggggactgtattgtgtcttatgacttctctgtcctttcccctacttttgtcaattgatcctttgttaaactcttctcagactactcaatttgaatgtgttctttgttttctgctgggtccctgactggtattgttcatcacatcagagtgaagtaacacttgattaattcagtgaaaatttattgaatgccttctaaggtctagcctctaaggaagctgttgtaaggaagttactcacttagttggtcaagcccaaaatgcagtagtatccttgattcctccctgtccttcaccccagtccctcagcagatccagtcagtccttcctccctgctatgtttggaacttgttcacttatctcatagccactgctacccctggagtctaagcacccaatctctaccaaatctactcaccaaatctgcactagcatcacttttctccttgacttaactcctgtctccctacatctgttcttcaggcagcatctggggaagcccctaagaatattaatcagatcccagcacttttctgcctaaaccctttggaacttagagaggagtttgagcttaccatggcctcagtgcctgtataacctggcccaatgaacttccctgacctctttctctttattttctccttcactctcagcatagtgactgctctgactttatccttcagtttcttgactactccaatcagtttctacctcaggttgcctagaatgctcttccctggcttttcacctcatgtgctccctttcacctttcagatcacagctcaactttcctcagacgggcctccctgaccacgaggtagcgcctatcccaaatactttctttttctttcttttttttttttttttgagatcaagtctcactgtcacccagcctggagtgcaatggcacaatcttgactcactgcaacctccacctcctgggttcaagtgattctcctgcctccacctcccaaccaagtagctgggattacaggtgcccaccagcacacccgctaatatttttgtatttttagtagagatggggtttcactgtgttggccaggctggtctcaaattcctgacctcaggtgatccacccgccttggcctcccaaagtgctgggattacaggcgtgagccaccgcactcggccccaaatactttctatttctttattcctccatacctctcattactaagtaaccttcttaatttacttgcttgcttgcttatctgtttcccctgcctcttcaccccttgagaactgagacccttctctgtcttgtttgatcacatttccccagtgtttagtagagtgcctgactcatagaatgtgttctgtacctgaatgttggatgaatcaatatatagtccatcacccatactggtaactggcccagtaacacactttgtattaactgtccttccttttgctgttttacttctccttccctaactactgttatctgagattgcttccaaataaactacttgtacttgcaggcaaaaagatatgtatgtatttcatattccctgatgtcaaagagcctgtgatctggtgaggaaggctgacaagtaaacagatacactgtccagagctctgagagaattaagccccacctgccctaaggaggtggtcaagggaccttatcatttcctgggagcttattatttactgcattgcaggctgttaggctactgtaatccccagggtggcagggggtgacattgtttataaatggggaatgcttatcgcactttctatgagtagtttttgtactgttaaatgatttgttcagcacatattgagagcaagaggataatagtaccattaactgctccccaaaactcatttccttacaaatgcttcttgtctggtggaaagacaacatagtgtggagttaagagtctggctctgcagtcagatccccaggttggcctgctgctcctctgcctttggtctctgagaccttgggcaagttattcaccctttctgtgctttgagctctttatctgcaaaatggggctcataccccttccccagagggttgtcagaattaaatgataaattcatataaagtattcagaactgtgcctagaaatgttaactattattattctctactttctcttttagttagttgccctcagaaatgcttctaggctacagtgtaatcctttttctagctactttatatgcttaaagtagcaaagtgtcacttctgcagaaatgttaaaattcagacttttcttatttgggttggttttctcttaacttgatttatttaggtctaactccatctttttgtttttatcttattctaagaagtcatttatgtataatccaatatattttctataaaggtatatggtttcagaaaatcatgcatatttagtaaactgaatttcatcgtgaaaattgaagaaatgtattctttatatttaaatctaactaatgattataattctttgtctaaaagaaattactttgttagagaacctttttattttataggatgtacttacatgtatttcttagttcttttttaaaggaaaatttcaattgttttctttttgtgatcttttctttttgagatgaagtctcgctctgccgccaggctggagtgcagtggcgtgatcttggctcgctgcaacctccacctcccgggatcaaacaatttttctgcctcagcctcctgagtagctgggactacaggcacgcactaccacacttggctaattttttgtattttagtagagacaggttttcaccatgttggtcaggatggtcttgatctcttgaccttgtgatccacctgccttggcctcccaaagtgctgggattacaggtgtgagccaccgcgcttggcctcctcgatgttttcttctaagagtttttaattttttttatttaaaaatgtattatttattttttattactagcaggtggaaggaagatcttctaagagttttacggtttttggcctcacattgaggtctttgagtccttggcctcacattgaggtctttgagtccttgtgagttaatttttgaatatggtgttagataaggatccaccttcatgcttttgcatgtggatgtgcagttttcccagcatcattggttggaaaggctgtcctttccctatcaaatggtcttggcactgttgccaaaaaccatttgaccatgcatgccagggcttctttatgggctctgtgcattgatctcaacatcactttttatgtttttctttcctagttctgaggagagagttaaattttttgaactctttcgatacaagaatccatctgattttataaatgttatcatttttacttttgtgtaattctttactatttttgtttttttattttttccagagaagaggaggtatcttgcagtgggcctctgtcccaaaaacaagcagaattttttctttctcaacaggtatgtgaattctgtaatttatcatgaacttctgttctagtcctgtgatgtgtctagtcctgtgatgtgtgttgtggcataggcccgttatgtgcataggtttgttggtcagtctgtgtcagcctttactcttggtcccctctgcctcactaacgaagcacttgtagctctgtgccccttcctattttgtgtgtgattttatttttctattaaagttataatccaggtttcatttagtaatggtatgtgactaacagcctaaaaccctgtgatttaacccttctctcaacattttattatagacatttgcaaacataaagagagcctgaaaagcagtgtatggtaattacccatacctattacctcgattctacaattaatatttttgttctatttattacttatctaaccactctctattcagccaccatttcatcttattttttgatatatatttccagttgcagatattaatacactttgctccaaacacttctctctttttttgttgtttttgagacagagtcttactctgttgcccaggctagagcattgcccaggctggagtgcagtggcatgatctcgggtccctgctacctctgcctcctgggttaaagctattcttatgcatcagactcccaaatagctgggattacaggcgtgcaccaccacacttggctaatttttgtatctttagtagagatggggtttcaccacattggccaggctggtcttgaactctcgatctaaggtgatccacctgccttggcttcccaaagtgctgggattacagacatgaaccagcgtgccccaaacatttcttttttgtttcttttttttgagacggagtctcactctgtcactgaggctggagtgcagtggcataatctcagctcaccgacacctctgcctcccgaagtgctgggattacaggtgtgagccaccacgcccagcccaaacatttcttatggatgcttttcagccatattttttcattttcttggaaacataatctgaacatttttctgtgttattttcagcatagaatttttagtttttgctctatttttctacttttccctaattttgttatgagctttctgcagaaagatgtaatgtttatatctagacaaaagtgatggaggctgggcatggtggctcacgcctgtaatcccagcactttgggaggctgaggcaggcggatcacaaggtcaggtgtttgagagcagcctgaccaacatggtgaaaccctgtttctgctaaaaaaaacacacacacaaaaattagccgggtgtggtgatgcccgtctgtaatcccagctactcgggaggctgaggcaggagaatcgcttgaacccgggaggtggaggttgcggtgagcggaggttgcagtgagccaagattgcgctactgcactctggcctgggtgacaaagtgagactccgtctcaaaaaaaaaaaaaaaaatttacggaattacctctgcagatgaatttcaaacagattagaaaaacctgtctatgtgattggttaactgtaaggaaaaagtacagctggatccttccttaccttaccttgtacctcagtatattacagatggattacagggttaaatgtaaatatttacagctttagttagataattaggctagaatgagctacacattgttggttttttttttttttttgagatggagttttgcttttgttgcccaggctggagtgcggtggtgatctcagctcactgcaacctctgcctcccgggttcaagcgattctcctgcctcagcctcctaagtagctgggattagaggtgcctgccaccacagctgcctaattttttgtgtttttagtagagacgggattttgccatgttgggcaggctggtctcaaacacctgacctcaggtgatctgcccacctcggcgtcccaaagtgctgggattacaggcgtgagccactgcgcctggccagagctttctaacataaaagctatggaatacttcagaggctgaggcaggagaatcgcttgaacctggggagtggaggttacagtgagccgagatcacaccactgcactccagcctgggccacaagaacgacactccatctgggaaaaaaaaaaaaaaaaaaaaaaactggaagaaaacatgtaggagaagataatttgattttcagaataaaaattgaaagcatctccatgtcaggacttgttttaacataattaacaggcaaacaggatgggcgtggcagctcatgcctgtaatcccagcaatctggaaggccaaggcgggtggatcatttgaggtcaggagttcgagaccagcctgaccaacatggtgaaaccccgtctctattaaaacacaaaaactagctgatgtggtggcatgtgcctgtcgtcccagctacttgggaggctgaagcagaagaatcgcttgaacccatgaggcggagtttgcagtgagccaagatttcgccactgtacttcagcttgtgcgacagagcgagactccttctcaaaaagaaataaaattaaaaaattaaaaggcaaataacaaaggtgttcttgggctccaatactttgggaaaaagtatttacaataaatatgacagtgaaagtttagattttggttttggtttagaaatcacattttcaggccgggcacagtggctcatgcctataatcccagcactttgggaggcagaggcaggtggatcacctgaggtcaggagtttgagaccaccctggccaacatggagaagcactgtctctactgaaaatacaaaaaattagccagatgtgatggtggatgcttgtaatcccagctacttgggattcaagaagaatcacttgaacctgagaggtggaggttgcagtgagccaagattgtgccactgcactccagccttggcgacagagcaagactctgtctcaaaaaaaaaaaaaaaaaagaaaaaaaagtcatatttgatgatgagacaaagtttacaatataaaatgaaaagaacaggaaataaagttacatatcatattctgattttgttaaaaatataatgtgtatatacacattatataaatttggaatacaccctgtattataaacatatattgtgattttgttaaaaatgtaatgtatacacaatatatgtttacaatacagggtatattgtaaatttatataatatgtatacacatatttttaacaaaatcagaatatgatatgtaacatatatacacacatacagaacaaagactaggataatatacactaaagtattaatagcgttatttctgggtagtgagattgcagaagatttttgttttcttctgtaggttttctatatttttggaataatttttccccatactacacctacataataatttgttttttgttttgttttgttttgtttttttgagactgagtcttgccctgtcacccaggctggagtgcagtggcgtgatttcggctcactgtaatctctgcctcccgagttcaagtgattctcctgcctcagcctcccgagtagctaggattacaggtgtgcgccaccacacccggctaatgttttgtatctttagtagagacagggtttcactatgttggccaggctggtctccaactcctgacctcatgatctgccctcctcggcctcccaaagtgctgggattacaggtgtgagccaccacgcctggccaataattttctataatgacataaattaacaatggaattagaaattatttttactttaaaaaaattttttttaaagaaattattatttttaaatagagatgaggtctcagtatattgcccaggttgttcttgaactcctgggctcaagcgatactcatgcctcagcctctgcctcccaaagtgctgggattacaggcatcaaccaccacaccctgcccttagaaattattttacttatagaaaaactcatctaggtaaaattggagttaagtgtctataacccagttaaatgtaaacatttaatttgtagctaactttctacatattttatataattgttgctgatatcgtccatatgaaacaaataagtagagctggggcaagccacctggctcccataaggccccatacaggcactggaaatacaagaagcaaacacattacctgcctggaaggagcttacagtctggggtggggtcagattggcaattttactatagtttgatagtgccacagggggggtaagtgcagagggcttatgggagcatggaggggcttataggatctcaccttcatctagaaggtgacagaagcaggtggcccagaggatgagctaggcatgggcgtcggtttgctcagctttgggtagtatatggctggggagcgatgggtgggaggcttggtgtttctggaagaggaaacagtgttgtagatggtcaagaggagagcatgtggcagggtccaccttcagtgttacctagagtgagggaaggccagccaaggctggcgagatgaggggccagagcctgaagggacccctgtagaaaagaaaataatcaggtgatgctagttagtatatcttttcatatgtttattgaccctttctttctactgagttaccatttttaaatttcaggcttctttgctaaagaatgatgagactaaggccctcactccagcttccttgcagaaggaattaaacaatttgttgaaatttaatcctgattttgctgaagcggtaagtctttcccagaatttgttgctgtgttggaaaggaatgacaaggcaactttttttgtttgtttgtttttggaaacagagtcttactctgttgccaggctggagtgcagtggcacgaccttggctcactgcaacctccgactccctggttcaagtgattctcctgcctcagcctcccaggtagctgggattacaggcacgtgccaccacgcccagctaatttttgtatttttagtagagatggggtttcaccatgttggccaggatggtcttgatctcctgacctcatgatctgcccgcgtcggcctcccaaagtgttgggattacaggcgtgagccactgcgcctggccaaggctactttttatattgagtagctgtgcaaatgagaatcagcccattggcccaggttcttgaaggaaatcgtgttcttggtaggcaaacaactcggtataggttgcaaagctcctccctccctcctcgggccataggcgatttcttcttactcttgatgttctctttcagtcatcatcctcctgatgttgtaaagtttggactggagataatatactagactgatgcaaaaaacagtgtttgtttgtttgttttggagactgagtttcgctcttgttgcccaggctggcgtgcagtggtgcgatcttggctcactgcaacctctgcctcccgggttctcagtgattctcctgcctcagcctctcgagtagctgggagtacaggcacacgccacaatgctcagctaattttttgtatttttagtagagacggggtttcaccatgttggccaggctggtctcgaactcctgacctcaggtgatccaccctcctcggcctcccaaagtgctgggattacaggcatgagccatcacgcccagcctaaatgacagttttgaggctgaaaaactcttttcctttctcttcttttgtcagtgtttatttttaaagttctaataattccattccttaatggattttttactcggaaaattttcttaaatagtatttggattttccatctgactttgggtgcagaaatatatctattttgcttcctagtaactgagatctgcctgttagggaagtttcagtgattaaaaaaaaaatgaaaataattaacttagtaaactagtaagtctcagtgtgttttaacttgtacattaataaaacttaattttataatttgtatatgaattcaggttttaggatctttaattctgaacactcagttttcctcaatatttgaactaggtaaggcccagtattctcatctatcactcatgtaaccagtggcatagtggagtatatttgagataaaactgacacaaatactaatggaactcccatttttaatttgtggactccctctagggggaatgtgtcttgaagctgttttattctgcctctagggagaagattaagctaaactatgaccatcttattagaagggtatgggatacactagtgtttgtagacagtggaactctctgcagttgtcttacaccagagatatttacagcgtttaaaatacattgattatttcttgttttagcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactagtaagtttatagacctttgtccttgcgcaaattgaaggaaccgatgacaataaaaagtctgctgtttggcctggtgcggtggctcacgcctatagtcccagcactttgggaggccaaggcgggtggatcacgtgaggtcaggagttcaagaccagcctggccaaaatggtgaaaccccatctctactaaaaatacaaaaattagccaggtgtggtggcaggcacctgtagtcccagctactcaggagactgaggcaggagaatcgcttgaacccgggaggtggaggttgcagtgagccgagagcacgccattgcactccagcctgggcaacaagagtgaaactccgtctcaaaaaaaaagaaaaaataaataaagatttgctattttgggagaaaagaaaagggaaaagaaatggaagaaatgaattctcaaatgttaattgtgatgcatttttaaaaaatgtattttttaaaaagaagataggaaagcagctcatcaacctggactagtcagtaacttccatagagggaaccttattggcactggaacagtttatgaaaaccttctgcctaaatagtctgccccctagtgtcactatgtaacattgccgtcttagtgcctagcctctttcattacttctaagaacaacaggccgttcagtgaaaaagaaattaggtcattaggccagagagtccctaaaggattttttggaggtaaaaatggggatgcagaagctatttttagtatttcaaaaagccagaaggcagttgtacctttactggatgaaagactacataggcttactgaaagtcaggtttgctttcaggtagaattcaggctgctcagtcaggtgacactggtttatactgttgcctcagtgtgcctctgtttttaatgaatagaaataggaaaatcgatcaattatgttttagtaaatagaattaagtagataaaacaactttcaaaacatggaggctatcttggaaataatgaaataatgtaaataatggtgaaaggtgggaaattactaattcaaagatcccttcacccccccacctgccctgtggctttttaccagttgagagaagtgtggtctttgctacaggcatccttctatacagactatagcgtgtattaatgggagcatagtgttcacagttcaataatggagacatctatccctttctctgtgtcaggcagcacctagggaattctttttatctctggttgtcaggtttttgtttttgtttttaagagacaaggtctcactcagtcacccaggctggagtgcagtagtatgatcatagctaactgtaacctcaaactcatgggctcaagcaagcagtccatctcagcctcctagctgtgactacaggcatgcaccacaatgcccagctaatttttttaaaaattattttttgtagaggtaggatcttgctttgttacccaggctggtttcaaactcctggcttccagcaatcctcccaccttggccttccaaagtgctgggattacaagcatgagccactgggccaacccagttgtgaggctttaaaagggatgtagacaagctgaagcttgtgtggggagggaacagtctcagggtgttgagacattcaaagccatatcatataagtaatgtgggagggatgtgagacatgtttagcctggaaaaaaatgacttatccaagcatgtgtttgacatcttcatgtagtgaaaagtcatgtgaaaagagcttagattgattgagggtatggctacgggagaagattgagagctggtaagtaagtgtaggttaaaggacaaaatatttctgctcattataaggaaacagtttccccttattgaaccctctgaggaaggtgtcagtgaggtgctgaggcctagaccaaagatgttattaagggtattcaaacatcagattgatagttgtacccaaaaatatttaaggctcctcaaaactccatgatttttgcaacattccatgatatcttgtaataactaacttcttttggtcttcccacatttaataacctctcgatcagagcctttctttttttatgtactcaaaaataatagaaatgccatttttaatatttaccaataacctatttaacttagtaaggaactgcttcccctgggggttagaaatttgtacacagccttctggatacaaataatctttatttaattaattaatttatttgttttttgagatggagtcttgctctgttgcccaggctggagtgcagtggctcgatctcgactcactgccatctcgccacctgggttcaggtaaaaaattctcctgtctcagcttcccgagtagctgggactacaggtgcatgccaccatgcccaactaatttttgtatttttagtagagatgggatttcaccatatcggtcaggatggtctcgaactcctgacctcaggtgatccacctgcctcggcctcccaaagtgctgggattacaggcgtgagccactgcgcccggccacaaataatattttgatgaacagaatttcttctttttatttttaaaaatatagagacaaggttttgctatgttgcccaggttgttcttgaacgcctggtctcaagtgatcctcccaccttggcctcccaaagtgctgggattataggcataagctactgcacccatctcagaatttgtctatgtttacaatattatcaatgggtagacagctaattgcacagaatataaatgaggagaggtagatttttattaatgtgtacattttccttaattcctgatttactcaggcccaggcttctttgtttctggtcttggatctatgggcctgtgtaaatctttgtcacttagctaaaaggatttcttgaaaatccttgtagttgtttattgagcatttactgtgtactaggcactattgtaggtactagggatacagcagtgaaaaagaaaaaaaaaaacttgttatagagcttatatcaggggaaatagggaataaacaacgctaagcatagttgtaatatctcagatagtgatagaccaggataagaggttagaaagtgaaggtgaagtgctcttgttttcctgagtaacactcttactccagatacatatacaggtcactcaactccttcaatttgtaaatctctggttaaatagaaaggtagcagatcagccctccttgatctctgccaacttaatatttgaacagagatttaaaggaaaaaatattacagaagtgggaatcctcaaaatactttctaaaactagctttgggctgggcaccatagctcatgcctataatcccagcactttgggaggccaaagaaggaggatcgcttgaggccaggagttggagaccagcctggggaacacagtgagactttatctccttaaaaaaattagctgggcatggtggtatgagcctgtagtcccagttacttgggaggctgaggcaggaggatcgcctgaggccagaagtttaccagcctggggaacatagtgagactctatatctatttttaaaaaaattagccgaccaagcatggtggtgagtgccttagtcccagctactcaggaggctgaggtccatcgcctgagtccaggaattcaaggctgcagtgagctaggattgtgccactgtactccaacctgggtgacagagggagaccctgtctctaaaaaacaaacaaacaaacataaaagtgattttgaaaaaatgataaaagtaacaaatgcacatagtaagaaaaaaggtcaaataatgtaggagagaatgccatgaaaagtaaaatattatatcctctccttgcccttcccctcagcagtggacctttaaaataaacatcttagaagcggagataaaagcctttgctttatgcccttttcgtagcaattccccttagaagagacatgtcctatatttccactgtcagtgttttctgctgctagggttggggcacgcctctgagagaataagcccagaaatagttacagcttccaacccagagacctgcatttggatgactgtgtacagatgacttcctgctatggttgcttatgcatgtttgtgattattaatgggatattaatgtttagtctgtcattagtcaacaggcagagctcgccctgcaggaggcaattaggattgcccaggagtccaacgatcacgtgtgtctccagcactgtttggtgaggccatcctctggtcttgggagttttgttcacgggttgaattggccttcacaaggccccgttgaattgggttgttttgcagttggagcagagatcttcagcagcaaaaggaaacaagttaggtggtcatgggaattcagaaagggcaacttatctttacttacctttcttaattcatgacatctgttttgcttttggcatatatctgctctacaaagtttaatgcaacttgccatgaaagaagagaaacctttatcacatttagcactggcattaacaaaagatgtatactacacttagtaactgggtgagatgttgtcctgtaatagcaaaatcaccagggcagtggaacacagaagctacttgacaagcacctgagaatcttatttctcaattgaaggccatatgggagcttcatgctttttttctgaaacacctgccactcagtggctgtcaggtgaagcagaacaatgactcatttatttcagcctggttttaatgatgttgatatgtttgacaggtctcattgagattcttgatatttcttgaaagagtatttgagaggattcattttgtcccttttaaattctttcttatgaccacattgatatttcactagaacatcagccattgccactgttatgatatattttgatgatttctcttgccagagctggctttatgtgctggggcagaagagatccgatagctatgttctgctggagcattctgtgaagaaggcagtacattttgggttaccggtaaggctcatctttctgtgagattgtttccataaatggtcgagcctttgtctctttttctgcccacctctgtcattaaccagcgatagatttagaatgggtttcaaagtgtggttttattcttggcagtttcatatgactttaattattaatcagaccactaaattctgtgtggtaggtttctctctgttccctgtatcctaataacatctgtggaaattccctttaccaatttgataagagatcattgtttagtttattgagcaacattaatttagcacatagtcacttagaaaaattttagcaaaggcttatttttaaaccagggattggtgaactttcccgcccttgggccaaatctggctttctgcctacttaggggcttcaggctgagtggattttacatttttaagtgattgcagaaaaaaaaaatcaacaacagagaagaaatacgtgacagaaaccaagtgtggcctgaaaaatcgaaattatttactctctggccctttacacaacaagtttgctgatccttgttttaaacaataaacaaagccaggaaccagtaaacctgacaggcagatttgtcctttctcgttttgagtgatagggaaggccgtgaattatagtcctcaatgacatacacagaggggcattgaaaaggcttatctggctgggcgtggtggctcacacctgtaatcccagcactttgggaggccggggtgggtggatcacctgaggtcaggagttcgtgactagcctggccaacatggtgaaaccctctctctactaaaaatacaaaattagctgggtgtggtgggacatgcctgtgatcccagctacttaggaggctgaggcaggagagtcgcttgaacctgggaggtggagattgcagtgagccgagattgtgccattgcactccagcctgggcaacaagaatgaaattccatctcaaaaaaaaaaaaaaaggaagcacaagcttggagaaccttattctctctcagaaacacccattgaaaactagaccataggcagtgggattgcttaagcattctgtcttatgaagtttgtgacagacttcagtaaaatggaaagtaattacaggtagtaatttaatgtatacactttaaaatcggcctggcgtggtggctcacacctataatcccagcactttgggaggccaaggcgggtggatcgtgaggtcaggagtttgagaccagcctgaccgttatggtaaaagctcgtctctactaaaaatacaaacattagccgggcgtggtggtgggcgcctgtagtcccagctactctggaggctgaggcagaagaattgcttgaacctgggaggcggagtttgcagtgagccgagattgctgcactgcactccagcctgggcgacagagcaagactccgtctcaaaaacaaccctaaaaccaaaaaacaaatctgtagcttgtccattgattcacacctgggaaagaaactcatacgtacagaattgattataatgacaaaagtggctccttgaagtaagcgcaggcttaactacaatttttgccatgaatttaagctggcattttttagttgagctttcatccttgaagatgacaccaaaagctaatgacaagataattttgttgctcatgataggcatccttttttgatctcctattacatatgtgcgcagcactgtttgacatctattatttcattgtaatccttacgataattctttatgataggtttgatgcccattttacagatgaggaagctgaggcttagctaagaagctaagtgactggccctaagtcacacagtaagtagcagaggcagtgtttaagtccaggtccatctaatgctaaagccctgctggctctttcccgtgtaccctctgcctctctcccagacccagtttttcaggaacacatctcgtatggctcagggttaaggccaggttataggtactttccttttaaatagtgctgtcactgtgcatgtgctgaaatgtgaaatccaccacatttctgaagagcaaaacaaattctgtcatgtaatctctatcttgggtcgtgggtatatctgtccccttagtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcaggtaggtctcccaaggccctgggggtgtgaattctttagagagaagcaggagctagcaagctggttctgtgaaaggccatacatacaagatttacctgccttggatagatgttgttcctgcaggggactatgttttagactataaaacattttgtattttgcacagactgaaaacttttttcccatgcatgttccttcttactcctcccaaccactttgtgaggtaatgggtgggtgatctccatgctgggagagtaaaccagggttcacacatctgatctacccgcgatcgcaaacgcagttaacaagtgacagagaaaggactcaaacccacgtcatctgactccaagcaccgggctcctctgctctgtgacaggaaccttcctgtttataggaggcatgatccatggttgctctagttgagtgtcacctgaaccccaaaactattgtgtaaaagaaagttgcttttctgttaactgaggtgttttctgtggaatattttcatcttattgtgtactttcacatttagccacttttagcctggaagtaaactttgttgccgcattttaatcctggagttctgtcgctacctcacccctcacttagacagtctgtttctaggaattcagtaatgaaaggaagtgccttttttaccagtcttgtttttgtatttcagataattttttggcacggtgtgctctgaaacagctgcagacactggccactgcttacattgccagagcagtctgtgccaggatggcatcgggtctgaattcacccgtgaaaactaattaacatactatgactgcagggaacatggggtgggggcggggggatctgggagcgtgtactcccagctgtgccctaaccactacgtgtctcctcgcgctgcacatccaggatgcttttctgcctttcttatcctgagggcaaggttgctggcactgggaggcatctgctcccaagaaagccagagcctgtgaggtgtatgactttacgcctccactcaagatagctgacgggcatggccaaagcgcagccaggtctgctgctgaaaggaaatcctgttccctctccccacccagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcaggtaggcaggtggccgggcccacgtgcttctggagcaatggaggctctaccatttctttcctctaatgcttgaggaaagcactggacacgtgttggacagttctgctcgacactgtggctgaaagagtgaaatcccaccagtggaaggggaccaagggtggagtctgcaaagttggttgaatttgaggtctttttttggcatcaatgaagggaattctaagaggtcagccagtttcatgtaactaaggaaataaataggattctttgacatttaaggtagcagaggtttgtgtgttttaggagagaggagagtataatagaagtatatctgaaatcataataactaatgttggttgtaaatttgttctgtgccagtccctgtgcctattttatgggtactgtctcatagaatccacttcatgggctcaggtttgttgttatccctatttcacagaactaaagactgaggtcctgggagctaaatcctgtatccaacacctgtaaatgtcagaggcaggtctccaaccgaaacctggttgactccaaagaagagcagtgggaatgggacataatcttgatgacttacagctcaagtaatttgacgagattctctttataagggatcaattaaagtatctcttctgctactgtaggctttatcttccctttattcaaaatatcttctttcatgggaaagagtcagggaaaactattttatctaaagccctccatctcagtaaacactgctgtggcaatccagatgtttccttgatcatatttttctcttcctctttgtgatacctgttactgttagattgcatcataacactcaacattccctaattgcagcctaaagatttttgggtggtttccactcctttcagaagtctagacatacttccctatagcaaacatgttagcattttacagtctcttacatggctgtgtaaactgaggggtggatgggccctgactgatgggttccacggcgcctttgccagctggtttcttcccatgtctgggaagcactgcccatgttttctgaggtcgaaagggctagctggttgcttcccctgggaatgttgcaagtctgtctctcgcttgtttcttccctcttcgtggcactggcacctccttaacatcacttctcttcctttcctggtgccttggataagagaagcatctggtaatgaatgagtcggtgaacatattgaagtatttagtttttttgaaacggagtgtcgctctgtcgcccagtctggagtgcagtggcacgatctcagctcactgcaacctctgcctctggggttcaagcaattcttgtttctcagcctcccgaatagctgggactataggtgtccaccaccatgcccagctaatttttgtatttttagtagagatgaggtttcaccatgttggccaggatagtcttgaactcctggcctcaggtgatccgcctgcctcagcctcccaaagtgctaggattatagatgtgagccaccatgcctggcgaaattatttttttttactattagaatagaaaactacttttcaaaaaccttagtcttggttcaattcttttttttttttaatttttaatttttaatttatttttaatttaattttatttttttgagagggagtctcactctgtcacccaggctggagtgcaatggtgtgatctcagctcactgcaacctctgcctcctgggttcaagcgattctcctacctcagcctcccaggtagctgggattacaggtgtgtgccactactcccagctaatttttatgttttttgtagagatggggtcttaccatgttggccaagctggtctgaaactcctgacctcaaatgatccacctgccttggcctcccagagtgttgggattataggcgttagccaccgcgcccagccagtttttaattttttttgagacagggtctcgctgtatcaccagggctggaatgtagtggtgcaatcacagcaaactgcagcctcaaccttctgggctcaagtgatcctcccacctcagcctcctgagtagctgagactataggagcgtgctaccacacagctaattaaaatatctttttgtagagatggaatctcactctgttgcccaggctagtctcaaatttctgggctcaagcagtcctcccacttcagtgtcacagtgttgggattaccacacccagcgtattttttatttttttaagagatggggtctcactgttgcccaggatggagtgcggtggcacaatcatagctcactgcagccttgaactccacctcaacctgcctagtagctgggactacaggtgcacaccacctcatccagctaattattttaattcttgtttcttagagatggaatctttctatgttgtgttgcccaggctgatcttgaactcctggcctcaagtgatcttcctgccttggcctcccaaagtgttggaattacaggtgtgagtcacagtgccttgtggctcaattctttagccttgtaactttgttcaaggccatttgttagaattttgtgtcttttttttctgggagtaagaccctaaaaagtaaccatgctctttgggtctatattaataattccatcttcatctccctttcacctctgggcttatgtgaaaaacctgctgacccaatcattgtttggcttcaacagccaggctgtgttaggaagccttttagtacacaactagaaggtagctgccttttttttttaagtcagtcctttacccctttcttcatcttgccttagatctttctagttttagaacatcaaccgtgtggatatatatatacttactgggctgatgactgtcacatttttaattagacaagttagactcatacttgtgaaattaagtttggccagctgcagagaaggcagctttatcatgagtctccagttactcttttctttctcttgtatctgcttctgaaactttccttcaagtaaattggatggtgcacgttgttttgtggtatgagagtgattggggtttcggtaagcccataaataagttatggggctcagaactgctttctgagcttcctcttgcaacccagaggaggtagagtgaattctttttctaatataaccattctcctttgctctttccatgtaattctagctcatcttatatcactcctctctcagtctcaggaattgcaggccacgatgggaatatttttgggggatactgcaggatctatatccccatgcccgactccctgtggcggtcatgaaaataattggtgagactggccagttaaaatcacaggaataatgatcttttattgtaattctatgtaatttctgcttattcacttcaaataaaagtccacatgtggcctgagcgtctatgtagacaaaaagtgcattacctcatgaaaggattgagacaaattgaaagtatttcgggatcaataagataaacctcccagttgggtgctgtttatctttatacttgtaatcccagcactttgggaggctgaagcaggcgtatcacttgagctcaggagtttgagaccagcctatgcaacatggtgaaaccccgtctctacaaaatatacaaaaattagctgggtgtggtgtgtggtggcacatgcctgtagttccagctactagggaggctgaggtgggaggattgcttgaacctaggaggtagaggttgcaatgagctgagattgcaccactacactccagcctgggcagtagagcaaaaccttgtctcaaaaaaaaaagataaacatcccgacaatataagagtataaaaaagtcatgaatgtacattcacagaaagcatggcccaaaaacatgaaaacatttcaatctagtcattgaaattaaatttaaagcagttaaggtactactttcaccaattatataagcaaagatacttcagtgttagaggaagaaaagcacagagttctggtatgaaagtacttggtacatttatatagggtaatttagtaatatatctcaaagaacttaaaagtgcctgtcatttccacttctaaggttttttgtttgtttgtttgtttttgtttttgagatggagttttgctctggggccaaggctggagtgcagtggtgtgatctcagctcactgcaacctctgcctcctgggttcaagcgattctcctgcctttgcctcctgagtagctgggattacaggcacctgccactgcgcccggcttatttttttgtacttttagtcgagatggggtttcaccatgttggccaggctggtctcaaacttctagcctcaagtgatctgccctccttggcctcccagagtgctgggattacaggcgtgagctaccgcacccagcctacttctaaggttttatgctaaggaaataattggaccagtatgcaaagctctatgcaccaagatattcattgtagcattttttaaatggaaaatattagaaataaccaaaatatcaaaaaccagattattttcatgtaccataattgattttcccgataaaatactacgatgatataaatttgtatttattgacattgaaagatttattcattcaacaaatattcattggatgcctaccatgtggtaaacagtgttataagtaatttataaaaatatatgtaagctggacacggtggctcatgcctgtaatcccagcaatttggggggctgaggtgggcagatcacctgaggtcaggagttggagaccagactgaccaacatggtgaaaccctgtctctactaaaaatacaaaaactagctgggtgtggtggtgtctgcctgtaatcccagctacttgggaggctgaggcaagagaattgcttgaacctgggaggtggaggttgcagtgagcctagaccacaccactgcactccagcctgggtgacacagtgagactccctctcaaaaaaaaaaacaggccaggtgcggtggctcacgcctgtaatcccagcactttgggagaccgaggcaggcggatcacgaggtcatgagatcgagagcagcctgaccaacatggtgaaaccctgtctctcctaaaaatacaaatattagctgggcgtggtggcatgcacctgtaatcccagctactcaggaggctgaggcaggagaatcgcttgaacgcgggaggcagaggttgcagtgagctgagatcatgccactgcactccagcctggtgacagagtgagactctgtctcagaaaaaaaaaagcaacaacaacagcaaaacccaaaagtaatttgtcagccgggcacattggctcatgcctgtaatcccagcacttgaggaggttgaggtgggtggattgcttgaggccaggagtttgagaccagcctggccaacatggcaaaacactgcctctactaaaaatacaaaaattagctgagcatggtggcgcgcacctgtaattccagctactcgggaggtgggggctaagacatcagaattgctagaacccaggaggaggaggttgcagtgagtcaagatcatgccactgcactccagcctgggtgacagagcaagactctgtctcaaaaaaaaaaaaaaaaaggattttgtatagccaggtgtgtggtggcatgcacctgtattccctgctactcgggaggctgagatgagaggattgattgagcctaggaagttgaggctgcattgagctgagatcaaaccattgctgcattccagcctgggaaacagagcaagaccctgtctcataaaaaaaaaaaaaaaaaaaaaaaagtaatttgtttgttcttgtttacatgtattttgtaagtgtttttctagaatggatatgtcttacgtgtgtaattaaaaaaaaatttttttttttgagacggaattttgttcttgttgcctaggctggagtgcaatggcacgatctcagtgcaccacaacctctgcctcctgggttcaagcgattctcctgcctcagcctcccaagtagctgggattacaggcatgagccaccacgcccagctaattttgtattattagcaaagatggggtttctccatgttggtcaggctggtctcgaactcccaacctcaggtgatccacccgtcttggcctcccaaagtgctgggattacaggcgttagccaccatgcctggtcttaaaatatttttaaaataaattgtattagcctttaaataatggcccttagaaatttgagtctctggccaggcatggtggctcacgcctgtaattccagcactttgggaggctgaggcgggcagatcacgaggtcaggagatcgagaccatcctggctaacacagtgaaaccccgtctctactaaaaatacaaaaaaattagccggacatggtggcaggcacctgtggtcccagctactcaggaggctgaggcaggagaatggcgtgaacccgggaagcggagcttgcaatgagccgagatcgcgccactgcactccagcagggctacagagcgagactctgtcccaaaaaaaaaaaagaaagaaaagaaatttgagtctctgaccagtatctctcaggttgctgcatcaagaacgggaacaggtgaatctgtcaccatctgtgcatggtacagcaggtgtggattcaacacaggttatgctgatcaaattgtgtgtttctactttagggctgttttgctgcagcttctgaagtgttaaagcacttgaaggaacgatttccgcctaatagtcagcacgcccaggtaatctgccttttgcatggcaatagatttatttctgataaaaatagcttttattataatataaagtgggacataatctcccctcagaaaaataatattgagctaaaaaggaacttgtcaaaggatgcttacaagtatgatattatttatataaagtttaaaaacacaggctcatactctatgttgtttagagacaagggtatatgttgtaaaagtataaaaaacctgaatgagaatgataaataccaaattgagtgcctactttgaaaaaagagaaagagacgtagaatttgcaaaggacttcattggtatctaatagtatatgaagcagataaagcaaaatgtgagttgacaaagttgatgattggcacacatgtatctgctattttattctctgtgctttttcacatacttgagatattttaaaaaaattttaaatccccccaaaaaagaatatgtgtgaattattgtaaggatatttgctaagcaatccaaaatactttcatatactcattaagatgaacattcgccattttgtacttaattgtgtttttttttcttactagttatggatgctatgtgatcaaaaaatacagtttgacagagcaatgaatgatggcaaatatcatttggctgattcacttgttacaggaatcacagctctcaatagcatagagggtgtttataggtaagaaaccttgaaaactctaaccccagaataaaataattgttaaatggttttgtttttgttttatatgtgcattaatttattttagcttagaaaaaaactttattttcttaataaataagaaaatacaggtaagcagctgggcatggtgacttacacctgtaactgggcatggtgacttacacctgtaatcccagcactttgggaggctgaggcgggcgcatcacttgaagtcaggagtttgagaccagcctggccaacatggtgaaaccctctctctactaaaagtacaaaaaattagccaggcatggtggtgggtgcctgtaatcccagctacttgggaggctgagggaggagaattgcttgaacccatgaggcggaggttgcagtgagccaagatcgcaccattgcctccagcccaggcaacagagtgagactccatctccaaaaaaaaaaaaagaaaatacagataagcaaaatgaagaaaataagtatctcccagagataatcattaacatgctgttatctataattccagaatttttcctgcatgcgtgtgtgtgtgtgtgtgtgtgtgtgtgtttgtgtatacacagcatgctcacatacatgctcacacacacattcatacacacatacaatttattctttcaacaacaaaaacattttttttttttgaggcagagtctcactctgtcgcccaggctggagtgcagtggcacgatctcagctcactgcaatctctgcctcctgggttcaagcgattctcctgcctcagccttctgagtagctgggattacaggtgcccaccactacgcccagctaattttttgtatttttagtagaggcagggtttccccatgttggccaggctggtctcgagctcctaaccttgtgattcgcccgcctcggcctcccaaagtgctgggattacaggtgtgagccaccgcgctcagcctctttcaacaaaaattaaatcaggcacagttttttcccttgggaggtttatagcgcaattgaataaattgagattcttaccctcaaagtgactagttaaaacacttgtgttcattttgattctgtttcaggaaagcggttgtattacaagctcagaaccaaatgtcagaggcacataagcttttacaaaaattgttggttcattgtcagaaactgaagaacacagaaatggtgatcaggtaaggggtctcttgtacatctcacggagatgtggtggtggatcttctcatcctgtgttttcctctttacggtcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcaggtaagccgatctctgtttttatagcacatatttgtgctcaagagctggtgagtctgtgactacgtttgagtattgaaaggataataatgagttttcatttgttcatattgacgtctggaaaggtagtcttcctgtgcaagccctccaaggaggcctgtggaggtgtgaacctggtgacaaactgacactttccagtggcactggctttcctgagctgtgtattcagtaaggaggactcgcctcttcagtgagaacacctgcatcatattaatgattagctgacacagagtgatgcttgatttagcaacaaggggatgtgaataaagaaatgaggaacacagatgttcattgaaagcttttggaaatcaaattgtattttatgtttgttttctttctcccccagtaaaggccatgaaggaattgactcttcattttcatctatattccctagtaccttataggccctacacatagaaggctttcaataaatattaatcaatgaatgagtgaaggtcaaatgcactggaagaatttattaattaaagtggaggttctccaaactggctgtacattagaattattgcggagatttaaaaaatatcttcgtacctgaggccttgcctcagacctacggagtcagaatctctaggggtggagctaaggaatctgtttcttactaccttcctcagtgattctttttttttttcttgagataaaatgtacatggccaggtgtggtggctcatgcctataatcccagcactttgggaggctgaggtgggcagatcacaaggtcaggagttcaagaccagcctggccagcatggtgaaaccccatctctattaaaaatacaaaaattagccgggcgtggtggcacgtgcctgtaatcccagccactcgggaggctgaggcaggagaatcgcttgaccctgggaggcggaggttgcagtgagccaggatcgtgacaccgtactcccagcctgggcaacagagcgagactccatctcaaaaaaaaaaaaaaaaagtatgtaacacaagatttaccactttaaccattttaaagtgtacatttcagtggttttgagaatattgacaacattgtgcaaccattactgctatctaatttcagagtattttcattacatagaaaaggaaactgtacccattaagcagtcattccccagtcctcccttcccccagcctctggtaacctctcaccggtttctgtctctatgagtttgcctattctgaacagtttgcataactggactcatataaatgtggccttttttgattggcttcttttacttagcttgatgttttcaggttttatccatgtagcaataggtatcagtgcttcattgtttttcatggctgaagaatatttcactgtatggttagatcacattttgcttatccattcatcagctgatgggcatttgagtcgtttccaccttttggctgttatgaatagcggctctttacatttctgtacagcttttgtttgaacacctgttttctttttttttttttttttttttttttgagacagagtctcgctctgtcacccaggctggagtgcagtggtgcaatctcggctcactgcaagctccgcctcccgggttcatgccattctcctgcctcagccttccgagtaggtgggactacaggcgcccgccaccacgcccagctatttttttgtatttttagtagagatggggtttcactgtgttagccagggtggtctcgatctcctgacctcgtgatccgcccacctcggcctcccaaagtgctgggattacaggcgtgagccaccgcgcccggggttgaatacctgttttcatttgatgcctacgaacggaattgctgagtcatgataattttgtgtttaacttcttaaggaaatgccacagtggctgcaccattttgtttcaacctgcaatgtatgagggttccaatttctccacaatcttgcccacccttgttattttccatttttaattattacatccttcctagtgggtatgaaggggtgtctcattgtggttttgatatgcacttctctaatgactaatgatgttgagtatcttttcatgtgcttattggccatttgcatatgttctttggagaaacgtctattccgatcctttacctgttttttaactaagttgtttatctttttgatgttcacttgtaaaaattatttatatattgtggatactagacccttatcagatatataatttacaaatattttctcctgttctgtgtttggtcttttcactttcttgttagtgtcttttgatatacaaaagtttaaaatttttatgaagtccaatttatttttcttttgttgcttgtgcttttagtatcatgtctaagatactgacaaatctaatgtcatgaagattttcttctatgttttcttctcacagtattatagttttaatgcttatgtttaagtctgaataattttgagttaatttttgtatatactatgagatagggctccactcttattcttctgcatacggatataggttattctagcaccatttgttgaagactcctctttccccatttaatggttttggtacccctgttaaaaaccagttgatcaaagaaaaaaaagaaaacaactgatcgtagatatataggtttattttcggactctcaattctattcccttgatctatatgttacccttatgccagtactactttgttttgattactatagctttgtagtaagttttgaaatcaggaagtgggagtctttgttctttttcaggattgttttggctattcagcatcccttgcaattatatgttgattttagaattagcttgttcatttctgcaaaaacagtagttgtaattttgatagggattgtatttgaatctgtaggtcagtttggagaacattgccatcttaatgctattctcttccaacccatgaacacaggatgtctttccttttatttggatctttaacttacttcaacaatgttttgtagctttctgtatataaatctttcacttctttggttaaatttatccctaagtattttattctttttgatggtaatttaaatgaaatttttttaaacatttatttttgggttgctagtttatattgatcttatatcctgcaactttgccaaacttattacctgtaacaggttttggggattttttttttatggttttgtatgtataagatcatgtcatctgcaaatagagatagttttacctcttccattcccacttagatgccctgtatttctttttcttgcttaaatgctttgagtaaaacttccaatacatgttgaataaatgtgacaaaagtgtgtgtcttggctcggtgtctcacacctgtaatcccagcactttttgaggccaaggcagattacttaaggccaggagttcgagaccagcctggacaacatggtgaaaccccgtctctactaaaaatagaaaaattagctgagtgtagtggtggtggtgcatgcctgtaatcccagctactaggtaggctgaggactgagaatcacttgaactcagtcctcaggagctggaggttgtagtgaaccgagatcatgccactgcactacaggttgggcaacagcaagactccctctcaaaaaaaaaaaaagtgtatgtccttattttgttcctgtagggggaaagcgttcagtctttcatcatcaaatatcatgctagctgtgggttttttatagaggttgaggaagttccctctattcctagtttatttagtgtttttttcatgaaaaggtattggattttgtcaaattttttttttctgcattgattgatttgatcatatgggtttttgtttgtttgtttttgagatagagtgtcactctgttgcccaggctggaatgcagtggtgcagtcttggctcactgcaacttctgtctcccaggctgtctcccaggttcaagcagttcttgtgcctcagcttcccaagtagctgggatcacaggtgtgcaccaccatgcccaagtaatttttgtattttagtagagacagggttttgccatgttggtcaggctggtctctaactcctggcctcatgatccacccacctctgcctcccaaggtactgggattacaggcgtgagccactgcgcccagccccgattttttctttcattttatttatatatttgtgtattgaactaccttgcattcctggagtaaatttcacatggtcatagtgtatgttccttttaacgtgctattggatttggtttgcaagtattttgttgagaatttttgcatctgtattcataaaggatgttgatctgtggttttcttgtgatatctttctttggctttagtattagggtaatagtggccccacaaaatgagttagaaagtattctctcttctcctttttctgggaagaatttgagaaggattggtgttaattgttttaaagtttggtaaaattcaccagtgaagcagtctggccctgggcttttctttgttggaagtttttttggttactaattcagtctctttagttgttataggtctattcagatttcctgtttcttgagtcaattttagtagtttggtctttctaggaatttgttcattttaccttttatctaatttcttgcatagaattgttcatggtattcttgtataatccattttacttttgtaaggttgttagtaaagtccccagtgtcatccctgacttcggttatttgagtcttgtctcttttttcttggtcagtctaacagtttatcaattttgtcgatctcttcaaagaaccaacttttggttttattgattctctctgttgttctcttagtctccattttgtttatctccactttaatccttattttttccttggttctgttagttagctttaggtctagtttgcttttcgttttctagtttctttctttttttttgagatggagtttagctcttgtcaccgaggctggagtgcaatggtgcaatcttggctctctgcaacctccgcctcccaggttcaagcaattctcctacctcagcctcccgagtagctgggattacaggcgcatgctaccacgcctggctaatttttgtaattttaatagagacggggtttcgccatgttggccaggctggcctcgaacgcctgacctcaggtgattcatccgccttggcctcccaaagtgctgggattacaggcgtgaaccaccgcgcccggcctcttttctagtttcttaaggtggaagattcgcttattgatttgagatcttctttcttttgtaatgtaggcctttacagttataaatttccttgagaactatatttcataaatttgtagtttatcccacaaatttcataaatgagagtctgtgtattttttttttgagacagagccttgctctgtcacccaggttggagtgcagtggcacagtcttggctcactgcaacctccgcctcctgggttcaaacaattctcctgcctcagcctcccaagtagctgggattacagacgtgcaccaccacactagggtaattttttttttttttttttttttttgtgacagagtctcgctctgtcgcctaggctggagtgcggtggtgcgatctcagctcactgcatcctctgcctcccaggctcaagtgattcttctgcctcagcctccttagtagctggaactacaggcatgtgccaccacaccaggctaatttttttttttgtatttttagtagagctggggtttcatcgtgttaggatggtctcgatctcctgacctcatgatctgcctgcctcggcctcccaaagtgctgggattacaggtgtgagccgctgtgcctggctacctgggtaatatttgtatttttagtagagatggggtttcatcatgttggccaggctggtctcgaactcctgccctcaggtgatccacccgcctcagcctcacagagtgctgggattacaggcatgagccactgcgcccagccagagtctgtggtatttttatacacctcattgcattttctaatttcccttgtgatttattctttgacacattggttacttaagagtatgttaatttccacatatttgtgaattttctggtttccttctgttactgatttttgatttaatgtgatcagaggagattctttgtatgatttcattcctcttaaatttattgagtgttattttgtggcccaaacacagtctatcctggaaagtgttccatatgcacttgagaataatttgtattctgatgtatcattgggtggcatgctttatatatatatgttagggccagttcatttgtagtgtcattcaagtcttctctttccttgctgatcttctgtctaatttttctatctgcgattgaaaggtgggatattgagctccccaactattattgtggtttttgttttgttttattttgtctgagacagagtctcactctgttgcccaggctagaataccatggcacaatcatggctcactgcaccctcaactgcctgagctcaagtgatcctcccacctcacttttctgagcatctgggattactggtgtgccttaccataaccagctaattttttatatttttgtagagatgggtttttgccatgttacccaggctggtctcaaactcctggtctcaagagatccacctgcctcagcttcccaaagtgcagggattacaggcatgagatactgtgcctggcctattattgttgaattgtctatttctcccttcaaatctgtcagtttttgcttcatatgctttggaacactgttgtttggcttgtttataattgttatatcttgatgaatcgactgtttcatgagtatataatgtcctcctttttccttgtctcttgtaacggtttttaacttaaactctatattgtatgatactcatataggcactccagctttcttttggttattgtttgcatggaatatttttctatccttttactttcagctgatttgtgtctttattttatttttttagagacagggtctcactcagtcgtccaggctggagtgcattgctgcaatcgtagctcactgtaaccttgaactcctgggctgatgggatcctcccaactcagtctcccaagtagctaggactacaggagagcaccatcatgcctgactaatttttaaagtactatttgtgtcttttaatctacagtgagtctcttgtagacagcatacagtggatactttaaaaaaaaaaagtttgttctcacaatttctgccttttaattagagagtttaactcatttacctttaatgtcattatttctaatttgattttttttttttttttttttgagatggagtctcactctgtcacccaggctggagtgcagtggtgtgatctctgctcactgcatccattacctcctgggttcaagtgattctcctgtctcagccaccaaagtaactgagattacaggtgcgtgccactatgcccagctaatttttgtatttttaggaaagacagggtttcaccatgttggccaggctggtctcgaacccctgacctcaagtgatctgcccgcctgcacctcccaaagtgctgggattacagatgtgagccactgcgcctgccttgttttctatatgtcatatcttttttgtccctcagttcctccattactgctttcttgtgtgttaagtagatgttttctagttttattttgagacaaagtcttgctctgttgcccaggctggagtgcagtggcacgattgtggctcactgcaaccttgacctcctgggctcaagtgattctcctgcctcagcctcctgagtaactgggactgcaggcatgtgcaaccatgctcagctaattgttttaaatttgttttttgagacagggtcttgctgtgttgcccaggctggtcttgaactcatggcctcaagtgatcttcctgcctcatgctcccaaagtgttgggattataggcatgagccactgtgcccagctctagtgtaccattttaattctctcttttttttttaaacatactaacaccaaccggaatctcttgtttcttttgctttattcttttgagttattttctggattgttacctttctcccacctagttcaacccctcagaatcaccaagctaaaggatattaatgctggatctttttgtaaagacaagaaccttttcatagtgtgaataaccgccccctgctatatttgtcatagtctgaaatcagattgtcacatgttgtgttttctaggaatgtggttcctgttttaacgtagtacatgtcaggtaaaaggtaagccagagatagccattcaggagagaactgccagaaatgaaacgcttcctggtgaagggcagtgggtttgggtatgtacagtgccatgatgtttctttttcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaaggtaggaagctgtacgaagactgttaggcaatgctattccagaaagcattgaaagtttaggacccagaagaagaaaagacattaaatttgggacagcatttaagttctgagtgttcacaaatatatattaaaatttcatgcagcatttaaagtgctttcacatgcatgcttggcagaaagattgaggacaagtgaatggctattttaaccctatagagccaagtaccaggctagaagtcaggagttaaagacttttttttttttgagacaaagtctcactctgtagctcaggctggagtgcagtggcgtgatctcggctcactgcaacctccgccttccaggttcaagcaattctcctgcctcagcctcctgaatatgtaaaggcgcacaccaccaagactggctaatttttgtatttttagtagggctttctccatgttggtcaggctgatcttgaactcctgaccttgtgatctgcccacctcagcctcccaaagtgctgggattataggtgtgagccactgcgcccggccttttttttttttttttttttttgagatggagtcactctgtcgcccaggctggagtgcagcggcgtgatctcagctcactgcaacctctgcctcccgggttcaagtgactctcctgcctcagcctcccaagtagctgggattacaggtgcctgccaccacacctggctaatttttgtatttttagtagagacaaggtttcaccatgttggccaggctggcgtcgaactcctgacctcaggtgatccacccgcctcggcctcccaaagtgctaggattacaggcatgagccacttcgcccagtcttaaagacctttttgaaaacctcaccctagtggtttgttttttctctctcaaagaatggagaatataaaagaatcttctggtagttgttgaacaaataaaactaaataccacgttttgaaaactatacgtgaagggttgagttaaatgtgtgtgttattttcccctttccgtcagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatt

SEQ ID NO: 35602 - DNA, 17515 bp, Homo sapiens
gtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcggtgagtgattctggaggagcagacgtcccccctccacacacgcggccgcttctcgaaggtcctgggggcgttgaacgtgggaggggggatcccggggcctgcggtgggccaagggacgtcaccattcctcgaaagagggcaagggaattacgtttattctcttcttcctctggaaataaaaaaagagagcaacatcatctaactgccctacagatctaatagtatctcgcccggaggtctcagcgacctcggggtggggcctctctgaggctctggctcccccgggagctgtgcgagtccctcccccctccccgcccggaggactttttcggccaccgcaaccttcggccatcccagctttcccgtcccctaattccccagactccgactcctcgcaagcccgtgtcccttcttagatgctggcctcgggagcgtgaggcctggggccagcggaatggcagtgtcagcgtgtttgattcagttttgctggagttcggttcttaacatttctcccccttctcatgcctctgggctcaatttcagttcccctcgccagaggttgcataaatcctatttgcattctgacctgtgctaacgaaggccgaagttttggcttgatcagttgggaggccttggctcggcctgcgcgcaacacgtgtgggtgtagaagaggcctggtatcagtctgcttaacgttatttataaatgatcggagacacactgtttagaagtggtgactgcctccgtatttcaggatctactggagacttcagcatctgaacttaaatagatgttctgtcttggctttacctttggtatttaaaccagggaatgcactctttcatccccacctcccttagttaccaactgaattttgcaacccctacccttccctatttgatcatcctccttggagaagtgtgatgttgaagagtttgcccgtgttaaatcttcagggtcggtcagagctgacgatgaagttgatgtggatggtacagtagaagaggatctgggtaaaagtagagaaggatcaaggacggatgatgaagtagtacagaggtttgtgttcatttgaacttacgtatacagataagccgtgtgaaccttgtgagttacggtcacttcttatgtatctcttctccaaaggtccagataaagtctaacaccctgtatttaaatacccggtgagttgtgtgcatacatacctcctaacttgtccctaggagtgatgaaaactgagtgaattcctttgaaaactatattgcagaatactagcaccataaactttgtaagactttatagaagatactttcagttggatttgtattcattaactgtgtacaccgagtaagtttaaaaatgggatttctgtcagttgaacaatattttaaaatttggcctcttgggacttattgacagttttgaagtcctcactgtggagcataaatgagtatgactttgctttttagtagaggaaagttgggatttttttttttctggcaattttaagaaccgagtatttccagtgtaatgttaaaggtagcctactgctgtgctaacataatgagacggtatatcagttatattttataaaggtttccattttaacccccaagacaatattcagaggcccctgtgctttcatcataattcctctagttttgaagggaactatgccatgcaatatttgcttacctaactgatttccttagagaggaagaagctattcagttggatggattaaatgcatcacaaataagagaacttagagagaagtcggaaaagtttgccttccaagccgaagttaacagaatgatgaaacttatcatcaattcattgtataaaaataaagaggtaagcaacatgtggttagaatattttatctctgtatggtggcatacttgtttacttaaatttgcttaatttactgcaaaagtaatgtagtatccaagtaagtaggtaacaacctttaaatacctaatatgtccaagaattgctaccagatatctgggaagaaagggagtgtcagacattttccttttcctttacctctaaataggttcacggcctgataatagttgtgagtctaagggcagtcacataaactaaacttcttgcattgcatacctgaagatcactgttaggtgaataagagtgcttttataaggtacagagaagaaataaatgggtttggcataaaatcgaatatcttaatgcatcttgaggatagtctaagtgtattccctctggcttccatttagattttcctgagagaactgatttcaaatgcttctgatgctttagataagataaggctaatatcactgactgatgaaaatgctctttctggaaatgaggaactaacagtcaaaattaaggtaagtgtaaggcagtttttctttcttttaaaggaaaaggaatccttaaaggtagaggatccctatcagtcaagataggctagattattttgcagtggcaaaaaaaccccaagtctcagtggcttgaaagtcatcaaactatggccaaatctaacttgacttgtttttctaagtagttttattggaatgcagccatgcccatttgtttattatctgtgactgcttctgtgcttcaacagcagagtcaagttgttttaacagagaacataaatctcccaaagcctaaaatatttactgtgtggccctttacagaaaaagtttgccagcccctggcttaaatcattgatcacaggctgcctgtggtctttgctctgcctcatcctcaggctgggacagaggcgtgggcagccacctggagtgtgtagccggttgccatggtgcagagcaagcttagagggtctcatactattataattaaaggctcagcctgaaaacagagctctcctttacaactcattggccatttataactcattggccaaaactagtcacatggccttagccattcttaaatggaaagtagagtactcctaagtttctggaaggcagacagccaggaatattgagtgaagaatattaatgatccatcacagattccaaatagaggaatcattcaagttgttttgtattctagtaaagaaataggcaagacataaaattttatttttcttgaattgttttccttcaaaggtaacttgttttatttaggtcagcctctaacctttgacatttaggccagtctgcccatttgatattaatactttctcaaatacataaattactttaagatgtacactttcagaaaaggccataaaaaactatgtggaggaaaatatctcagtttagttttctgtattggaattgatgggacccaaagctggttagttcctcaatatttgtttggcataatgtaaatattaaatacaactatctggttcttgtcttgcatttagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacgtgagtatgaccaattccttataagaattaatagtcatggtgaggatcttgactctccagttctattctctgagcaaatgacttattctgggccttaattttcctgccttataaaatgaggaaacagaactgttgtcacttgaagaaatgtttgaggacctgcaaagggccaggcacaaaggtttgtgattgctgttgtacatggagggtataaagtaggaaatagcagcagcttccccaagggagaaggcttcttgggtacccacagaggaggcactgcttggtcagtttcccaggttagaagagtaatttgtctgtggagcatcctgaataaaggcatggaggcatagcatgctcactagatgaacagagttcttttcggtggcagttatggatagaatgtgatgaacttttatttatttatttattttgagacggagtctcactcttgttgcccaggctggagtgcaatggcacaatcttggctcaccacaacctccgcttcctgggttcaagcaattctcctgcctcagcctcccaagtagctgggattacaggcatgtgccaccacgcccagctaattttgtatttttagtagagatggggtgtctccatgttggccaggctggtctcgaactcccgacctcacgtgatccacccacctcggcctcccaaagtgctgggattacaagcatgagctaccgtgcccagccagaatgtgatgaactttttaagattctcaaggtggtgtggaggatgtgaggagtggacaaggggagactctttgggggaaatattcctcttgaaaatattcaagatgagtggtagcaaccagggctggggctggcttgtagagataaagggcttaaagaaagttcatgaaagttgtgaaagctgtggaataaaatacgtcatttaaggatagttacaagtttttaaatttgaattaagatccctcttaagccagtaactgttgtttgtatgggtgagacagagccagtgccctacagtagctctcgttgcttatagcactgtgacgtagacagggcagctttttgcctttttaaaattttaccatcttggagatgaggaaattctatttcagaggtcagttggcttgccaactcctgctaagtgagtaacagaatgtgcccacagcttcaatttttttttcttaattcagttttaagttttcttaacattaagggaaagaagcacatacttatcattgtgaccaactttcttcatcctagaaagtaacatttcctgtttttactgcagcagatgttcttttaatgaagactaattagatgactgcattttagtacttttttaacttgtgttcccaatttaccttcccctgccttcgtcactaacattgatgtctccaggtttcatttggaggcatcactaagagttatgccccagtgccctctctttttaagcactgggctagatgttggagaaggatagggcaatcattcccaaggaaagatagaaagtgatgtcccaagagatgttaatgtcaggttgctaagaagcaggtgaaattatctggatataagctccatgaaggcaaacattttgttggaagctccattcccaaagcttaacacttaattggcagccatttgtatgaataagtgaggttaaacaggacagttccatgcagggaacgatggctgctaacacctatccaggacctagtttccatgaccatgcatatctttttaaaaatttcctttgcccacttcttaaatgttaacatacattttctccaagttaagtttcagcccttttctcattgtccatgtgatctttatgtagtcttatccactgccacggcctcaggttccatctctagttctcaaatttatattcttagcctagatcaggagttagcaaactttttcttaaaagagccagctagtagaaaaaaagataaaagaaaacaacaagaaagaaagagccagctagtaaatatttttagcttgtgagctatatggtctgtcacatgtcccaactctgtttagcttgaaagcaggcatagacaatacataaggatgtgtcccagccaagtgtggtggctcatccctataatcccagcacctcgggaggctgaggtgggaggatcacttgaacccaggagtttgaggtcagcctggacaacataatgggatcccatctccacaaaaataaaaaataaaaaattagcttggcacagtggtgcatgcctgtagtcccagctactcaggaggctgaggtaggaggattgcttgagcctggcaggtcaaggctgcagtgagccatcatcacgcctgggtgacagaggtccaaaaaaaaaaaaaaaaaaaaaagtgtcccaataaaatttctaatgggtgccagctgtacagctatagcttgccagccccttgtctaggtctcactactgggctctgtgttcatgtgtttaattgccttttaaatgcttctacctaagatatctaaccagcagcttctacttgcatccaaaactgaactcttaatccccaaatcactagaacatgtgctctgagaccaggggcctagtcactcactaggctttgtcatatcatggctacttattggccaggtaccactaaactaatgagccttttgagacagggagggaaccatagatagaccatttcccatacttaattgggaacacaagtatcaagatatggactacctactgtgcttaagagtaggttctaggccgggcacagtggctcacacctgtaatccccgcactgcccggtagaattttatataatagtagaaatgttctatatctgcacttttccattttggcgatcaccagccacatgtgactgttgagtacttggaatgtggcagcataactggaactgaactgtacattttatttaaataagtcacatgtgcccagtggctgccattttggatagtgcagatataaatataaaccagattaattttctagcttttttaaggaaaatgttttcattaattaggaatagttatctacaataatcattaggtttctggaataacagtaagagctatgagagtgcatgattccatttctctccagaatatttcagtgctttctcaccttgaaaaatgaaaacaatctattcagacggttgggaatattttaattttctacttaaaactaaggttattctccacttgaggtaatgtagaggagattcttctctttactgtatctacatgtgttacattttagctcacaaacccttgttggtgatggagagttaacatgaataattaggacatcttggattatactgaactgctggctattaccatggtatttaaatgaatttataatcagatcttctaaatgttaggtgtctctaaacatcgaatttttcttgcagccttgtcttaaaagaagaagcatctgattaccttgaattggatacaattaaaaatctcgtcaaaaaatattcacagttcataaactttcctatttatgtatggagcagcaaggtaaatctatattgattaaaaacttatatgtattaccttggcacgtatttaaatattcaacactaaaagaatgaaggcaggccggcgcggtggctcatgcttgtaatccccgcactttgggaggccgagacaggtggatcacctgaggtcaggagttcgagaccagcctggccaacatggcgaaaccctgtctctactaaaaatacaaaaatgttagctgggtgtgtggtagcacacgcctgtaatcccagctactcgggaggctgaagcaggagaattgcttgaacccgggagacggaggttgcagtgagccaagatcgccccactgcactccagcctaggtgacaaagcaagactctgtctcaaaaaaaaaaaaaaagaatgaaggcaaaatgtggtctattagttaaggatactctcagggttttcttacaaaaacctattttttgacctgtaatgttatatcatattctgtagacaaaatcagaattgttaaacaaatgagtttaaccataattctcttatttcaacagactgaaactgttgaggagcccatggaggaagaagaagcagccaaagaagagaaagaagaatctgatgatgaagctgcagtagaggaagaagaagaagaaaagaaaccaaagactaaaaaagtaagtctggtttatctccctgcataagatattgtttaacatgtataggcaaaaccaggaaaacctaagtatgcactggctgatttgaagtcagcttcagttcaggtgctaagtccatggagccagcttttaaaataaggcctttgtttgtatgttgaatacattgtcctgtagaaagttttaagtatcaaacccaggtcatttttatgaagagttttctaacttttatatattgcctaggactggtggcttatatgtttggaattttaaaatcttaaaaagccttctgagtcctcttttgtctttttatcatgcagagattaaccataaaaatggttctctggcttgcttaggtagcagactaagaagtattgatcatggtggttgagaaatatttttgtaaaatgttggatttctttaagtcatgaaatgggaatatataatatgtatttccttctaacctcaaaacaaatattttcaagaaacatttttgctagttaaaaaataacaatgaagaaaaacttaagtggcttttcatcagttaacaattgtctttttgaattaaatattgagaaaaatactttgcttttgatacagttggcagaaaccttactagataacaggtatcctttggtgccctttttttttttttctttaatttggagacagagtctctgccacccaggctggagtgtggtagcacgatcatagctcccttcatccttgaactcctaggcttaagcagtcctttcacctcagcctcccaagtagctaggaccacagacacacgccaccatgactggctaagttttaaaaattttttgtatagttggaggtcttgctatgttgcctggactggtcttgaactcctaggctcaaacagttctcctaccctaacctcccaaagtgctaggattacaggcgtgagccaccacaccagtcctctgggtctttacatagtcttttgaaatctactgaagccatggttactgctaggataaccttggtgagtgctgagagagactaatcaaatactataataacttcaggttgaaaaaactgtctgggactgggaacttatgaatgatatcaaaccaatatggcagagaccatcaaaagaagtagaagaagatgaatacaaagctttctacaaatcattttcaaaggtaaatatttataattccctagtttctggttattaatgaatagacaaaatatcaccctcttagtttaattgtatatggtatgtgaccatgaatatgagatggtccattcccattttttcccagtgagaaaattcaaaaaaagacctttaggccaactataatatgtctacttctggtttattgacctagtcacaattaaaatcacatttatgaacctttgagattgacacctcagtagagatggtctttgagagtaattggtttccagaacacaccatttttacttaagttgaattattatactcatcactacttcaaaattgcagcagttattaaaattagtcctagctcttagtgaatagtgaaactacaaaatcaagaatgtttgaaacagttttatggctgtttaaacacaattggtttcctttttattcctgtgtattttgtaatatgtgatttttttaaaaaaattattttgagaaggcatctgtagccttcaccagcttgccaagggttttgtgtgacaaaaaaagattaagaaccacctacataggtagatgtgtgatttccaccacaaaacccgtaaaacatgaaatcatgttgttaagtggcttttaatataatctttaaagagcttgcttatgacatcaaacacttattgtgagatcctatgcctgggaataattactaaatttatgtttccttgcctgtttttttttttcttcttcttttattgatcccttcttgtaactcttaaggatgcaaaactagcattgataaagtttgtttaaagttaatgtttccccagcagcatttagtacaagcagtagaatgctctagtggacttaaccatagctaaataaaacttaatattctgtgtctgtatttgttcttttctctattccatatcctttaaatttcaactcttaaaacactgttggttctgccttcacttttatttccataaactctaaagtcctagtgtctataaacttacttcatataaagcagctgtattagaaatataattaatgtgagccacacatgatttgaaattttttagaagccatacaaaaaaaggaaccatgaaatgttaatagtataatttatttaacccagcataccccaaatagtattatttcaacataatcaatataaaaactaataatgagacattttatatcctttttaaaatttgtactgtgccttcaaaatgtattttacactttaatagcacatctgaatttgaactagctacatttcagtgcttaacagccatatacagtaatagataatgcagatcaagagaatttccaactttgttttacaggtatttacatacatctttgtagccactcttagagctaagttccatggaagaaacatgttcttgagtacttactgtagttcaagggcacactgaagtgttgtatgtaattttgtcatttaggcagggtggtggttttcctattcacttctctcatacgtaagaagtataaactcatccttccttctgagagtttaggaaataatgttattgacaatcatcatcaaaacaaccatgtctagtgaattagaattgcaattctagatatttcttcactccacccttttctttctcttccccccacccttttctttctcttccccacctcccgccagtaaaggaaaattttttgttagttaattgctaaactgaatatgtaccacatagtacattgcttagttcttgcactgcttttctcctgtgtcgtttgaatgactaagataccaactttccacaggaaagtgatgaccccatggcttatattcactttactgctgaaggggaagttaccttcaaatcaattttatttgtacccacatctgctccacgtggtctgtttgacgaatatggatctaaaaagagcgattacattaaggtgagtttttaagtagtacatgctgcgtttaaaatttgaaagtttaatttccagaaagtgacttttttttggtctctttagctctatgtgcgccgtgtattcatcacagacgacttccatgatatgatgcctaaatacctcaattttgtcaagggtgtggtaagtatctgaagtttgggagaaggggtgattgttgtgggggtctggcagtgtagagtgtttgtttggctttgctttcttccagtggttttattgctcactgaactttcttttgccatctgaaggtggactcagatgatctccccttgaatgtttcccgcgagactcttcagcaacataaactgcttaaggtaagtgtctctgggaagaaactctccactttgctgtttgattggggttcagaggacaggctccatttgtggagtaaaaccagattttgggtctggtccatgattcttcagatgaatttcctttctttctggagttatcagatcctaagaatctgattctttttctcccaacatttaataatgaagtttcaaacatctagaaaaaaattaaagaattgtacaggtccaggattaacattttgtcatctagacacatagccacctttttatcaagcctttcattaaacctttcccctccaatacttccataattagaagactctttagtttttgaatttaaaagtatttgaaagtagcatatttgttcacttcatttagatgctagagagagagtatcactgagtcctaaggttagaatataaacattaaggcaatcttgtggctatttgcacggacagctgaatttcagcccaatctgaatgaattggagtgcttcaccatttcctgcccctcaataaatggcaataacgatatcgtctttgtgtttttcacactcctgcctgggtaccttacattctcaaaagttggagattaacttctctaatcagttattctttcattgtgtttaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggtgagatgaactcataagtgttgtcagccattctggaaggtagctagggatttatagccaactcttgagggggagaaaaggaaaacttaattgtgtaactggagtagttataaggcctggtcagtcactgacaggaaggtcatttatattctctgaacctcttaattcttcacctgtaaaatggagtttttaataatgtataaacatagcagctgctaggataaacaaatacaccagggccagacttggaaaactttgtgacttcttaattttgtaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaaggtactgtggaaattacaaattgtggaaatattagtatcagcatttaagagaaagttattttgtgaacaaattaagctgcagctggttactttgtaaccattagaatggtaaaaatttaattaatgtaattaaattattgggagaaagcttaaaactttcgacaatactgctttgttaataacttgttacaaattaaattttatgtttttaaaaggtggtatttaaacttctgactagaaaattcagattatcaagtaagtgcccctacaaattctcctaaaccttaagaaaagctatttttatgacctgcttctgtgtttatgatcttaagtgataaagtcttagacagttgaaagacaattgctcaatgaccttacctgttgatattaatttatatgacttgatttctttccctaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaagtaagcatcctcgggaaagtccctgccagggcgttgccccttacccaatctttgttttggagataataccagcttcaatacaaagagtaaaattgccttaaatgtctaccactgtctactataaggtagacaacaagtttacgaagggatttctcctacatttgattgagaaagaaaaggtctttgactcatgattttctgattttattgtatttgatatgtaaatgggaattttcttaatgtgttatgcatagtctttacttttgcattggattatatgcttagcctaatatctgaatttattttacatttttaaatgtaatagctgcacgaggttaatgacaacattcctcaagtgagttaagtccatttcaaatcacgtcccccacacccccaagcattaaattatgggtatccagatagaatgtctcataaagtagacggtacaggacctgtgaattaacagtatttgaactcaagggcctatacctggaggtatagtgagtctttggtactctttattttcaagaaatatagtatttcaagtttatgttttaatgtcacagcaatgatcttgaaaatgacttctcccctacttttattctctcttctttcacctggagtatgtttctgatatgctatctagtcatcatccttttttcccaaggcctagcttaaggattctttttttttttcccccgagacagagtcttgctctgtcacccaggctggagtacagtggcgcaatctctgctcactgcaacctccgcctcctgggttcaagtaattctcctgtcttagcctcctgagtagctgggattacaggcacctgtcagcacacccgctaatttttgtatttttagtagagacggtgtttcaccatgttggccaggctggtctcgaactcctgacctcatgatccgccctctgcggcctcccaaagtgctgggattacaggcgtgggccactgcgcctggccaggattattattcttaaagccttttctcacaaatgtagtctccattgttgtcacaattctaaaattccatatatgtcttttaactataaatttcatgcagagaatagtgttctgtttatctgatatcccattgcaatagtacaagggccatttaaaacatgtccacctattaatttcaggaaatgattaataggaagttaccttgcatccaacaaacatgaagacttactatgtccatgcactgatggtcacaggtagacataactcctgtcttttctaacatttagactagtgaaaatgacaaatcaaagccaggcatggtgactcactcctgttgtcactcaggaggctgatgcaggagtatcagttgattccaagagttcgaggctgtagtgtgctgtaatggcattgcactctagctctagcctgggtaacatagccagactccgtctcttttttatttaaaaaagaggaaaaaaagcaagtcataatccgagccctacatagataatgggtacaccaggatagggaaggatgtggttcctccctgtcctcagagctttaaactagagaagagagaataatcacaaccaacagtaaaaagctaaggattttgaaggtatattcaaaatgcatttggaactgagctcagataaagttaatttttcttggaatcattggcgaaggcatcgtggagaaggtattattattggagcacaatccagaggctacatagatttttctgaacttggggaggcagagctacaattacggtagtaagaataaactaagagggaacaaacaggacattaaatcagttcgtctgttcagcagtgctccaggtacttgggactcatcagtaaataaaatagttcccttcatttcatttttcatctaaccgtgtccacttgctccccaccccacctccccgttaaaagggagcaatacaggctgggcacatggctcacgtgtgtaatctcaacactttgggaggctgaggtgagaggatcacttgaggccaagagttcaagactagcctgtgcaatatagtgataccctgtctctataaaaactaaataaggaaacagtgcagtcatccctttttgtccatggggtgttggttccagaacatcccatggataccaaaatccacacatagtcaagtcccttaggtaaagtcgtgccgtatttgcatataacctatgcacatcttcccatgtactttaaataatctatagattacttttaatacctaatgcaatttaagtgctatgtaaatagctattatactgtattgggttttttatttttttcttgttttgccctttctaatattttcaatccgaggttgattgactctgcagataaagtagactggaaaagtacagtcgtccttaggtgtatgagggagattggttctaggacccctgccaaaatccacaaatattctagtcccccagtctgccctgtggaacccgtgtatatgaagagtgggagctctgtgtgtgtggattccacatcccaagaatacggtattttctatctgagtttggttgctgaacctgcacatacggagggcggactgtatttattggaaaaaaaatagcatataagttcaaacctgtggtgttcaagtgtcaatagtacattttgattttttttttttaccaagagttgttctgtgtaattatgaaagaataagggaaacgtatgaaccctaaaattggatatgttttgttaatgttcatttttatctcttaacagttactatgcgagtcagaagaaaacatttgaaattaatcccagacacccgctgatcagagacatgcttcgacgaattaaggtagtattaaagcagtcctcttgcttgtcttttaatttgagtactttgtatcttttaatattaatctagtgcatcttcttgcatttcaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtttgtatccccaaccttcccgcaaaggctggctggctttctttgtttctgttctttcagaataggcctctcatgattgagggatgtagctttgcgacatttgcctaatttctaccttttgaaagaattttattgaatgtttgaatccctgtagtgtcaggcactgcactagaaactaagtcctccttttacgtcctctttcctttttgcctgcctccttttgttagcttggctgttcattctagttaagaggatttagtctgtggttctgaataaacagaagtgacattaattatgattttatacatataaatgagcaaagtggaaataaatccaaggcattaatgggcccataaatgttgtgtttaggtggaagaagagcccgaagaagaacctgaagagacagcagaagacacaacagaagacacagagcaagacgaagatgaagaaatggatgtgggaacagatgaagaagaagaaacagcaaaggtatggcaaatcaagaatgtgacttgcattttcagttctggcaaagttaggacagagttttagttctggcaaagttaagactgtgtaacttacagaagtcagactgagcatttaaattgtttatttcatgcacaaacctgtgagctaggttttttttctgctaacttttaataccttctgggttttttttatttatttacaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaat

SEQ ID NO: 35603 - DNA, 74282 bp, Homo sapiens
cgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacggtgagtgccggaggtgggcgctgtcgaccccaatggctctggctgagcctcatagccctttgctgatggctgagggcttggccagccaccggcccgcctgggacgccgcgccctccgccatagccaagggtagggaggggaccggagtgggatcctggtctggtgcgccctcaggggttgagggggtgtccaggctggaagtttggacggggcgaggcctgcctctttctcaggttccagttccctgtgtctgagatgcaacagtcaggacggcttcgttggggcctggggtttccccttttccctgatgggccatgggcacagaggagaggattctggtccagaagacaacactttccccaacccaggaattggcacctttctggggcaaggctgccaatgtccaagaggggacatgggaacagagaagcagggagaaaggagggagccgctcggggcggatccggcacccccactcatctttcccacagcctcaccgggtggctccagctgttttccactaggaggtgaggagagagatgtgaggaaatcgtcatcgaggctgcacccgagagcaccaacacttatttaggcaccagtctgaggagaggcctaccccatctcctgggagagaggaccggtttctccctcctctccacctccaaatccctgcccctcctattgcttaatgcctctctatctcctcctatcccctccggactattttgtgtggtgtgggttttctcgtggggccacacctttctagagtggtggttgatttggggatgcgtctccaccccactggctgttacgagaggaacagaagcctcctgggagtggggataggggggccggatgcccaggagggagaggggaggaggggtgtgcctgactaatgagctctgcttgcttttgtgcaagtcatgccaaatggctgctgaggcccttcccttgctcagaaaggcctggtgaccaccctggcttgagtcccttaggccaaacagcttgttgagctggcctaggcaatgcagtgctcccaaacatgtctccccaggactgcttgagccttgtagaggtgagatagtgactagtagccttgaaaagggctgaaggtcccctgggatgagaggaggagagttgggggcccagccttttgggtttgtgatgagctttggttgccacgttactgtataccagcctcactgccaagtcgttcttgcctttccagaaccttgtccttcagaaacaccaagttttcaaaaagtatgtgctttcactgtctatctcctttaaattgcttgtggttttaggacatgaggcttttacacactttgttccctagtccccgcccccaaagagagagagtaatggttttggagagaggggaaaatatcccattgtctgccaaaacaagattataaagatcctgtcaggagcggctctttgggtctctctctgtggttgactcctgactcctcttaaggtgcggctttgcctgaacagttgggtggatctctgggaatagacattgctccacggtctttcttctgtagtggcatatctcatcctcagttctgagatagcccactttgaaacacagcttcatgggcctggaagttgcttcaaacttgcattaaccgtctcatctgagtcaaagtggcaaagaagacaagacagcgtgtttattgttttcctgggaatggagagagaatggagtataagctgtttgtagtcaggcctggagtaatgagggtacctaaatactgaaggcatttttatgcagattgactgaaacctgaatcaaattggaaggagagggctgaattttgatagactggaagtattagagaattttctatactttgactcaaggaatggtcaacttttaggaaaagcaactatattatgtctgttaagatcatagaatcttaacctgaaagggaccttggagactatttagtacaactctcttaaaaaaaaaaactaaaactaaaacaaaaatctaatgaggctattgagacctacagggaaagacctacctaagggcacatggtgactgagccaagattggggtccaggctttctgatgctcatctcattgaccctttattctgacccaatgattgagttcttgacatttgagttccctttcttgctccaaacaaattgcccactgttctcagacctttatggtcctcagataaaaggaaatgagtaatttgagcaaagtggccaaggttgacatttgtgtggtctcctggtaaggttcggtagtgtcaccaggtgccttctgttacttttcttattcctcataccaaggccaaggtgttcaggggcacaccctagttcactgaataccaaccagtaattttaattaaaaggggaaaaaatttccctttctctgctccattttcatttatgtgctttaggctatttctagcgtgtgacagatggagaaaggtagtggaaaatcaaactcgttcattcatattgcagcatgtctacaacctatctagggtcggtttcacttttatagctaattgtccctcctagtcagcccaacctcccctacatttgttaaaacacgccagccgggcgtggtggctccagccagtaatcccagcactttgggaggccgaggcaggcagatcatgaagtcaggagttcgagaccagcctgaccaacatggtgaaaccctgtctctactaaaattacaaaaattagctgggcgtggtggtgtgcgcctgtaatcccagctactcgggaagctgaggcaggagaatcgcttgaacctgggaggcggaggttgcagtgagccgagatcacgccactgcactccagcctgggtgacagagtgagactccatctcaaaaacaaaaaaagcaaaaaaacaaaaaaacatgcctcactacccaccgccacccttgccttcttgccattccttggactctgcttctggttgccagtttcctgagtctgctttagtagccagaatggaaaagcttattaattgccatctacattttttggtgatgatgacagttatatatatatatatatatatatatatatatatatatatatatatatatatatttaaaaaggcctttccccctccctaccttctttaatttttttcttttaggatcacaaaggctttgaggctttcttggatttcctaaaaaaagagtgttttgaattttcgagatgttcttgagtttctggtttccttccttgggatttattagatgttagtattgaaaaggctctccacaactataaagtccaattcctctcattgtatagatgatgaaactgaaactcatgttagggggagactaacctagagtgatgcagtatgccagttgcaaaactaggacttgaatctaggtcttagttagagggtcagtcttggtgaaacacctctttgatctgctggggttttagccatagatcaacagatcaggggaaaggcaatcgagtggtcatttgatgggaccatcaatgtgagcagacatagagcctagatccttgaagtatttgaaggtgtttgggtcggcattcagctaaactttaacagggactatgtggactgtttattctcctgccattcctagcattacttgagccactcgagtggcactaaagtggtacttggtaaataggagccagattcttagtcttttaacccttgaaccagccctgcctacagacttaagtggggggaaaaggatcaggaagagaggtcatatgagagaggatcctgcatctctccacttgggttcttcagttcacttggccctttgtgaaagtgtagatgatagagacagagcaggaaccatcttgggaatttcctttacgcttttcttttaacagccctctgggtagggagggggctggtggggcaggaaggcctttgtgggacccacaccaactaatctatgctctctcgtgttaggcttggagagggaaaggttgctctgtgagtcagtgatagaagtagtattgatcactaatcttctaactttccattctctagctgcctgcaacagtagcttgttttagggtgttgttcttacttttctcttacctcctcctcccatgaaactactttaccgaatgatggagctggaaaggacatttggaagtcatctagtctatttcccctgcctccaaatctaattctctctggatgagataatatgacagctacaattattctgaactctgttctagtgttgcatggcaacagcctgtcttaggtccctttgtatctttctgggagtttcccccactggaatttctagactcagggtccccagaggggagaatatctggctaccaacactaccagagttaggcctttcataaccatagctgctggaaatttggcattgttacagattgctaatagtctgtctctaatctttcaaagatagaattgaatttatcatgtgcctctttcctaactcagaatcttctttccctgccacctgctctattactttgcttgcaaaaaggaaaaaacagggtacagatgtggtctcctttgggatagtctgttggttcaagtgaagggggtggtcttttcatgactgactggctttgctgtccatccctccttccatttcatgcttgagagagctgaaaaacttttcaattccaggttctaatctgtggtatagaagttgtcactttggaggattagctcaggattccatgaatttggaaggtgggtgctgggaaatggaaagcatcactgaactgagaatttttcttctctttccatataagaagaacttctctcctgtcctcagtaaagtgagccaaatgaagtgggactttaggcaagtcctttcttcaggccctctgtctctccagcttgtcatgagggagctgtaccagtgatgggtaaactctaggaatccctccagtactgatgtttttgagaatcttgatggtataagagcattgagtctcttatatgtatgttcattccttcagacattctttcttcaacatttgggtaccttctatgtgccaggcagtattggaaatacaaaattgaacagcgcttattaaaatgtatcctcttgtcccattatacttcttgagtgctgtttcttcttaagtgctgagttcagaatggactgtttctcacatgggagttggtttgtttcattagtagatccaagaagaatactggcttgagtactcttggccatttcttcccgagtcatgggagagaaagggctgtgtctttccttactgtggaaagaaataaaccaagtgagagtatattatgaagactgtgggttgactgaaaagctttggacaaacactaaaagcctcatagattttcctgccattcttcccacatttttcagtgaccgcctgcctgatagtagaatagtcctttttatttctgctgaaaggaaggcccggaagctactagattatgtttcagattttcttctaacatggtgagtgtggtagttagatatattggtagatattgaggccttcctaagggctcctaaacaaacctcataaagtatctaccaccagtgagctgaggactggctattgtggggtacagctttttttttttttttgatacggagttttgctgttgttcaggctggagtgcaatggcacgatctcagctcactgcaacctccacctcccgggttcaagcgattctcctgcctcaggctcccgagtagctgggattacaggcatgcgccaccatgcccagctaattttgtatggggtacagcattttaaaggcatttgcatctagggcaacccagagcttccctagccttaagctttcctttagctggttgttctggatgggcagggtttctcacaggagtgttttgaaccatggaacaactgagctggccttaaatcttctgcctcagcctttatcttcttgatgggggcactaaagtccagaaaagggaaaggatttgagtgaactggtgatagtgccaggactaaaacctaacttgcttggctccagtgtaggggagggatggtgaatgcctaccttctaaatggcactcactgtgaggtgctcagtgtcttctccctctgtgctggtggtgacatgaccgtggagttatggccatgggaagagcaagttcctctgagtgtgtagagctgatctcatgggtttctttatttggaaatggctcaggctctgaccttgtctcaggaactctttgtagcacttcccaggaaggtaagtgttttgctttggcttgtgacgggtggtggaaggcatatgtgtaggctgaagggaggtagagagaggacactagtcacattttcctgcttgagactaggccttgctgtcctaagaaactttagagagtaatttcttcatcgtattcatagccagaggggttaggcagcttgttcgaggtcacatatagttggtaacagtattgaaaggagaacttggatttcctaattcccaagttagtggtctcccactggacttggctgtcttagaaggatgactccacccagagagcacagacttccagagaactggctctgtggtgattacattaacaagatgggtacaatggagttcccctaaaatggttttgctatagcaagtttttctgggatctccgatgactgtcttctcttcctgtctacccctcaccccagttccctgctttctctttgccctgtttaattttgagctctgacctttttgaattctgaattctgactcagcgctccagcttgatctgtcccttgagttaggagaacagtatggcactttttcaatttagtgacagtatttgctgctgtagcaaattgtttgaatgcagactagaatctcctggcctcaaagttcaccactcacctctaggtgcttataggccaagcctggggcaggaagctaaaaaaagacctttcaagcctccgtggaaaggaagcatagagtagtgttgaaaaacagactctggaactagactgcctggactcaaatctagctctgcgaccaactagttatatagccttggacaagttatttaacttctgcacctcattttccttaaccataaataataatagtacttacagagttgctgtgaggattacatgaggtaatttatgtaaagggcttagaactgtgcctagaatctaacaagtgatatacaaatgttatgattatttactgaattttactatatgcctaactttgtgctagatgggatggataagaaagaagacaggtagttgaattcttaccatttaatgagtggttactatgtactatttaccataagggatagaaataaatgaagggatgatacaactgctgccttcaaagatctcctatctcctatttaattggggatttagggctaattcacttaaaaacggcttgagaaaaatatatactttgcattgcattttctacaactttttgaggagaaagggtttactgggacatgaacagggccttaaagggtgtgtacacttgggagcagtggccgttctgggtgggaaagtgatgtgtttttggtatgtgggtgtaaaccaatggccctagaccaatgctctcttgaaagttactttatctgaagtgaagggaggcttgagctgctgactgattcaaggggagccacagatataagcatagatgaagctactctttctagggtaatttggatccaacaatcctttcttaattggcaaacaagggcctgtgggggagaccatacctttggttttccagaattgggcaaattaatttttttttttttgagatggagtctagctctgttgcccaggctggagtgcaatggtgcaatcttggctcactgcaacctccgcctcctgggttcaagcgattctcgttcctcagcctcccaaatagctgggattacaggcatgcgccaccacgcccagccaatttttgtatttttagtagagatggggtttcaccatgttggccaggctggtcttgaacttctgacctcaggtgatccacccgcctcagcctcccaaagtggtgggattacaggtgtgagccaccacgcccagcctgggcaaattaatttttaaaaatgttgcttttgttgcctaagtaggtatgtgagagggtcttttcttcatgcttacacatgaactaaaccaaagaatagagcttggcaataactttatgtcagcagcctagaaacagcttttaattctctcattgactttgctataaaatcaggtatttgggaaagggtggagatggcagggaggatttctcagtgtgtggttgttagaggtggaggagtatgacgttttctggccagggcacagctgcagcatctgggtcttgaatttggagaaaaggccttttgggcgactttcaaagcacagccctttgtctgtgcctaatgacacagataccagatctgatgctcctttcaatcggcttgttgtggcataaggtaagtgttgacatagctcttaggccactaatatggcaaatggctctgtgcttgcttagtagaactgttttgccagttatcttctgtgattggtgacttcgaatattgaagtttcttcccattcctggcaacccttctaccttgtgggaatttgatagatactttgtgcatccagggtagtgatcagggcctaatgagagaagagttgagatatgacaatttggttgtacaaaacaagatataatcctgaaaatttttttcctgggtatatatttgggaagtgactggggccaaggcctaggagggggaacaaggcatacctgtcaggcttgatcagtatttctttccctctctttagccttggcctccattaaatacctgagaaggatcaagtcttatttttctcaagttgtgtgtttagataaggttcctgatcttactttcgtgatctaatctgccttccctccaacccatgatccatttccttttttttcttttcttttttttttgagacggagtcttgctctgttgcccaggctggagtgcagtggcatgactttggctcactgcaacctccatctcctgggttcaagagattctcctgcctcagccacccaagtagctgggactacaggtgtgcgccgccacgcccggctaatttttatattttttttagtagagatgaggtttcaccatgttggccaggctggtcttgaactcctgacctcgggtgatctgcctgcttcagcctcccaaagtgctgggattacaagcgtgaggcactgcgcctggctgatccatttattttttcagattctcagcctggatgtttgatgaagctcaccaagagcctcttttatctgttgtaatttttaactgaggttgactaatctatggtatagagttggagggtgagggtcaaggtaacagtcaatctgggcatcattagttaagtcgtacaaatctttgctattttcaagggttttaagtgagctaaactcctctccaaacatccttgtagatacttgtgggagactgactaattcctttacaaagaagaaaagtcacataacttctttgccttttaattttctttttctccaacatgaaaatatcagcaatattagaaagaggcacatggagtttgcgtgtggtggctcatgcctgtaatcccagcactttgagaggctgaggcaggtggatcatttgaggtcaggaatttgagaccagcctggccaatatggtgaaaccttgtctctactaaaaatagaaaaaatagccgggcgtgttggcgggagcctgtaatcccagctacttgggaggctgaggcaggagaatcacttgaacctgggaggtggaggttacagtgagctgagatcacgccattgcactccagcctgggtgacaaagcaagactctgtctaaaaaaaaagaaaaaaaaaaagaaatatgtaaatggaaaagaacaaacccccctcccaggttccttattccccttggtgcctgggccattgtagatctagcatatgcttggtggggacatctgccatttgctttagggttacactacatctttctactttgagtgcttgaagagttgctccagcagggcctgatgtgggcctggtgaaaatctagcctagttgcctttctgtctgccatagcctgggcattttcctaaggttgggagtttttttccttctggtcttaggccagttgccagaggaaaccgatgactaaaggcttcctccctgcaacgtcaacttctggaacctttcctgatgattcctaccagtcaagtctgccttatttggctattttctcccccctcaagttactccctctccttgccaccccacctcaactagtcctctgttctcctttagtacagggaatgccttcttcaagtttatacaataccacctgcaaacttcttttcttcttgtttagagtcctaatataggggaggagtggggaaggagagaggaagatgggagagctctggaatgactgtgatttctccaccctgctttcttatctccctttatcctcttggcactgcctggtcactcctctacagcttcttacctagatctctgacagcctaggagtggtctcgattggcctaaagaggttcagagtgtgggggtgggatggggctagggctttcagcatttgaaactatttctttggagcaggtaaagccttccagttggtaagtctagttctttaagtatgcctgttgtatgcctagccttctcacttggctttcctgggtgggctgagtctaagttccctctacctccccttcccagtcctgagctgtctaactttaggttagaagagctgagcttttgacacttacagcttggggcacttgtctgggtgtctttaaaaataccttttagtaaaaaatggtacaatggaaagaagagtgagatatttggtttttaatctctgcctgtgtgaccttgggcaagtcacttttatgaggcttaattttcttatctacaaaatagagacattggctttttctgacattctgattatttgtgcccagtctttaagaggctaggaaaggggtcttggaaagcgtgtagcagagcagagtggtgacttttcggagaagcttccttttcccatttagaatggcattgagtgtgtcattttctcctctggctatcaacatgtaagcagccccctctatttcagtgagctctgctctgggatatactgaatctacctaccagagagctcactgtggagattctggcttggagagacaactgttgactacatgccttgggtggggtcttggagtccagcctgcagactacagttgctggctatttttggtcatctgtgactcaggaagaatagaagacccttggattggtcattgttccatcagggaaagggaagacaaagaaacaagctaaaactgaggacatatgagatttcacttcctttactccctcccccacaacatccctttttgtagggctatgaaattgcttttgactgagtcttaaattgctaagctccctttccccttcctctatctgaatcattgttgactatgttgcccttggacggggagagctaggtgatatgggcttgggtggagcaaaagggagaatttctagtcaggaagattgccacacacctagtgttgggctttcaactgatcctgtattttgtaaatatggtttcctttggtattagtcctggagatcaaaggagagggacttctgaattttctgtgagggcctacaaggctgatagggaataagcaagtttatgggaaaggtgtacccttcactggatctgtttttacccatcctctacttcttcctccttttcgtccttctcactgacactttatccagtgcttgcttgtgaaacaaggatcccacattggatctcagccacctaagagttggccatgaacataaaccttacctgctctgagccccctggagaaagcacaagaagtcttggcatctgttttccttcctttagaaacaagttccttgggcatccttgggcagtttaaccagagaagccttagttgggtagtgctgggcagtgctgttagggggaagattcttctccagcattgagctggaatggcctgtgggctatgcaggagcttgctgctggaagcagctgccttgctggaagcttctcattcttcctaggtacctcacatgggttgttagcgatgccagttgtaggtggtggatcaaaatggctgttggtttgggaaggtaggcaagcaggtggaggaagaaggaatgtagagtcaaatggaagaagagtggttctttttttatatttcccctttttttaaaactcagcatggcatatgacaaagtttagcaaatagagagagaaattgtgtataaattcatcattttaacatggcaataattatttgtatttcttgtcgtatctcatatatgtaccttagtttttggtggtgcaatcatagtgtacataaaaaagttctccttctttccccctacttaacacatcactaaaaacttagataaatgctatttaattttaagaaatgaacattctaatggccatgtaaaattctattcaaaggctatgccataatttaaaaccattctcctttgggggagcatttagattactcccagcatttgctagtatagatacattcccatgaatgtgaaaagagaaaattgaaacctcttagcatagcatatagggaggtccctttggtacctcaccccattctagcttcctctcccaactcagctcccatttattcccacatgtatgctatgtggtagctttgtgggcccaaggtttcccaagtccaagtaagctatacccgtcctttttctttttttcatccagctttttcaggttgaatttgttttgttttgttttgtttttttgagacagagtctcactctgttgcccaggctggagtgcagtggtccaatcttggctcactgcaacctccacctcctgggttcaagcgattcttgtgcctcagcctccctagcagctgggattacagggatgtgccaccaaacctggctaatttttgtatttttttagtagagacagggttttaccatgttggccaggctggtcttgaactcctggcctaaagtgatccacccacctcagcctcccaaagtgctgggattacaggtatgagccactgcacctggccatgattttttttttaactgtggaaagcaatgccatacctcttctttctgctttagcctatgttctttccttcagcttgaaatttcaggtgcctcttcttcatctcccccccactccatgtcacttccattggaaactttctttattactcccagatagtattgtactatcttctatgtgcccactgtactttgtaagaacttctgttatgttatttaccatgcagaattgcagccatctgggctcctaggcttgctctttcattaaacgtgtgcatttggaagcttctagctcttcctgtctcaagaaggggccattctccaggtggaggtggttaggaatggacaaacctttgaggagcatttggtcagtaatatacatggtgagggagaagcagtagcaatgaatgcaggggatccaacagtgttggatgagcacctggtagggcatactaaccactagtaatagagaaaatacaccttggagaagggacaggtgtattagcacctatggggaagagaggcctgagtgtaagtacagagaaagcctagctggccttgagtcaccagtgcaaattctgaaaccattccagattttagttccccatctgtggaatggaaagagtaatagcaacctactttttagggttatgctgaggattcattcagtgcactaatgcatctgcaagtggtctgtgaggtgtgaggcacaaaggaaggaaggtaggcccaggacactccagtatgtttgttccagttggccttttaaagttctgtgctatatgtgattccaatcaagcctctgaacccagaatgccagatgctacagtttctctgaaccccacataggtgcccctacagccagttttttattttttttttaagtaggaagtatgcagggaagtaccatctcctcactcatttgagcagcctgactccaactggccctagcacagccctactcaagaatgaccacaagtgcctggggagggaggggccaccatcaccttagctctttagtataaaataagtggtttagagtagagggtttcttaacatccctttagctataggtagaagtgtagaagctgcagtgaaactgagcacctttcaggtcttctggtctgaagcctgccatgtactgtgggaaggacagatcttcatgtctgtcactaactgtatactctttagaggcctgcccatctcatctgtcttaggaaaacagttcatgaagaaccatctaagccaaattcaaggtctttgagtggagaatctcaattaattgctttttgttttcaccacatactacccatggcttcttttgttgtttttattgttgttgttgggacccttggcttcttgctgctgccttggccatttgcatacccccattccaccccaggactttatgttttgtaaggaagcaaattacctgagccagtggaagatctactggtcacctataaatcaacacgaagaagggacttgctcaaggtcatgtattgaggcagaagcagaaactggtattgaaggcaagactctcaggagtgtgttctttccattatgtcagtctagcccactagtgtgtaagcttcatgagaacagagatggtttctcaccacccattatatccccggtacccaacacaatgatgcctggcataaagtagattctcaacaaatatttattgaatagatatgttaatagctactattttcatgttggaactgtcttctttagattcctttagctagatctaccagatagccaaacaacaattccattgatccactggaaactacctaatgtggacccagctgggccctggcagaatggaacagggtagcaccggggaatgggaaggcattgtctctcttgtgcaccttggagagactgtttatctgtgagtggccagcatgttcatagccatttctgctcccttttcccatatcttcacataatacagtagtgttcgtgtcaagtgggaatattcaaatcaaaactttttgtggattctaacaggcagccatgcaaacatttctgtccacctttgtgaagtagcccaaagtttggctgtacagtacatatttgagacattactcaatttttaatttttttgtgtttgtgctgctcattatggcatggccagcaggcagggctgcattgcataatttaatcctgagaggtttgtgcacctgaggtttagggatttggttggcccctgtgctgaggcctaggaagagacaggcatagaccagggaggatagcaaggaagtcctggcgatcataatgttggggcatccagtggatatccactcttgctattgctactgttgccgccgccgccaccaccaccaccaccaccaccaccaccaccaccaccaccaccaccacccaggctgctttagggcccagagctgcttatctttgcagacttggtattttttggccaaggtagactaattttgggggcagtaggagatattttcctcccatccactcctgagaaaagggtagggccagcatttgagaggtgtaggtttatgcttactaggtaaggttgactgtcctaaaatagagagagcttctgaagttcacctagtctttaaaggacttttcccatctgtttttttagtcctgagccatataaggaaagttaacagacacaatctctgctgtgtggtggaacagatttaaataaatacagactttgttttacaattttggattaatttttcattatgaaactaaacatgtttgttgtaagaaatgaaacagcattgaaaaatataaagcctcctgtcttctgcccctgactgtattctccagagacaaccatcattaaccagttagttatgtgaacataaactcttttttttctttctttctttttcttttttttttttttttgagatggagtcttgctctgttgcccaggctggagtgcagtgatgcgatcttggctcactgcaacctccgcctcccaggttcaagtgattctcatgcctcagtctcccgagtagctggggttataggtgcctgccaccatgtccagctaattttttctatttttagtagaaatgtggtcttgccatgttggccagcctggtcttgaactcctgacctcaggtgatccacctgcctcggcctcccaaagtgcggggattacaggcatgagccactgcgcccagcccatagactcttttttcatgcatttgtatatatatgcctttaaatgcacagatagtacaaatccgtattgttctgcttttttaacttagtatgtgctggccatcttttaatgtcaaatccgattttaaagtctacaggggctcattaataagcaaatcagcaaataggtagaacactttttaaacattaaaatcttttttttcttttttttttttgaggcagagttttgctctttttgcccaggctggagtgcaatggcgcgatctcggctcactgcaacctctgcctcccgggttcaagctattctcctgcctcggcctcccgagtaactgggattacaggcacatgccaccacgccagactaattttgtatttttagtagagatggggtttcatcatgttggtcaggctggtctcgaactcctgacctccagtaatccacccgcctcggcctcccaaagtgctgggattataagcgtaagccactgtgcctggccaaaaaagcttttttatatagagacagcgtctcactctgttacccaggccggagtgcagtggtgtgatcatagcacactgtaacctccaactcttgggcttaagcagtcctcctgtctcagccccctgagtggctaagactacaggtgcattctaccatgcccagttatttttctattttttgtatggacagggtactagctatgttgcccaggctagtcttgagctcctgggctcaagcaatcctatcacctcagcctcccaaagtgttgggattaaaggcgtgagccaccaatgcctggatgaattggtggaacacttaaaatctacacaaataaaggggccatactcttcattaagtggaaaataaagaagttgtaatgaggatttgtctgtctgagagggaaggttttctgaagatgtgatatgtgaacccttctgttgcgatgaaagatgatggtagctgctcccctttctatgctcagtaggccccacctatagagattgctttagatcctgtgtctaaatgagctcagtggagtgattagtggtaggataaacttattttctatgcttagcatggtccccttcctgttttgtggttttgccagcttggggtggtttgattccagacagtacctgactgagaatcctgcacctcagaagacctctggctgttggagctgtctgaggtgaaggaaagaaactttgtgagtgtacatatgtgtgtgtttgtgataggcacatgcttttccaatgttctccacagaagagcagtggaggctggtccgatggtagtgggttaccgatggtactgggttgtcagaacttgttaacattagcatcactgaagtttttgtttttgtttttgtttttttgagacagagtcttgctctgtcacccaggttggagtgcagtggtatgatcttggctcacggtagcctccaccttccaggttcaagcagttctcatgcctcagcctcccaagtataggcgtgcaccactgtgcctggccaattttaatatttttagtagagacaggtttttgccgtgttggccaggctggtcttgaactgttggcttcaagcaatcttcctgccttgacctcccaaagtgttgggattgcaggcgtgagccaccacgcctcagccactgaagtgggtgtacaaccccccactgctaaatttgactggcttaaaaacaaacaaacaaacaaacaaagaagagctgtggaagggcctgtcaattatcagagaagctagattagaatccccttcctaacaacatacacatcaggaatcttgtccaggtggtaggaaagtggaattttgcagagcactcagctgtaggtgagccaccagttgaataattgaggaagatagtgatttgtgaaatacaaatattttgaaagaaaaattctagcctagtggtcactggtcctggtcttagaagctttctaacttgagagtattgattatgttgaaggaaccaggccactagaggagaagcagaattaccagaaatgctggctctattctgcccactcatggcaggccccacctttctcttgcctttttattcccagacttccacagttggtggggcagagttctgcttgcccagcctttaatcctggaacctctgctaccagaggttgaccctgactgggctaggcccacaggccactgcaggcattattcccttccccttcagacaaacaggaagctgcctgcacactcttagtgattggcactttcaggagctttgtgaggcagggagtttgagatcaggttccaaaaggaaaaggaaatgacattttaaataattttttgggctacttgagaaggtgtggatccaaagtatctccaggcatttattgtaggccaggcttgcaggaatatctgtgtttccatacttacttgctgtttgaccttggagaaatcccttaacctccctgagcctccacttctcccgttggtaaagtgggaatgattatgtgttaacctcagaattggtgggaaacttggataagttagcagtggaaggctctgaaatgttagctcgtagaaaatcaagtgttcaggattcaggtgctcagagaagtttaaatcatgttttaatagtctctgttgacaaaagcagtagagtatatcagtagatgaaagactttcagctcaccactaagaatagttatgatccttaaacgggtgagcctcagttatcagaaaatgttcacttctgtgatacagctcatttatagaccatttaggaccaatgaggcattgccatataatcatctctcaaccatccataataaaactctcttctcggccaggcgtggtggctcatgcctataatcccagcactttgggaggctgaggcgggtggatcacgaggtcaggagtttgagaccagcctgaccaacatggtgaaaccccgtctctactaaaaatactaaaaaaattagctgggtgtggtggcgagtgcttataatcccagctactcaggaggctgaggcaggagaatcgcttgaatctgggaggcagaggttgcagtgagctgagattgagccactgcactccagcctgggtgacagagcgagactctctcaaaaaacaaacaaacacacaaacaaacaaacaaaaaaatcccctctcttctcagctacctgtggactgcctgttctaaataatgtgagctcagggaatacaggctcttctgataatccaaataacacataattagttatgcaaacgtgtcctaaaagtttccagggtgaagtggttaggttgctgttgctgagtaatccatagagtattactcttatgttgatgtgggtaactgaccttaactataaggaaaatggtgaactttgcactctggagcaaggaaagtgataggcttctacttctcaggtcatttgtgccttcactgaccatccctccagctgtgaactcaggtagaggcagcatatttatgagaatcggattagaaaggaggcaatccttcaaagatcggaggttgagaagacatgtttgagtgtgccctgcatggacttttattccagggagagtcgagtagttctcccttcatcacactctactgagattgtcctttggcaagaagaaccaagcttaaagaaaatcttaaaagagccattaggaacctcttggggcaagttcttctggaacctctagctgcttaacatcccagaaaaagaaattctagggttaggaagctggaaaggatttataattttaggggatagctgcccattttccaaatagttttctgtttaaaatagccaagtcagatgcgaattgaaggaatctcttgacaggttggctggcattgccctgtaatttttttccagtgtccaagtaatgataattctctatatttgtaacaagtttcatagttgtaaaactcttttttattgttattactatgtcatttgatattcatcaactctctacagttggcaggttaggaattattatcttttttaaaattattttttaaaatagagacagggtttcactgtgttggccagcctagtcgcgaactcctgggctcaagagatccgcccacttcggcctctcaaagtgctgggattacaggtgtgagccaacacacccagccaggaattattatctttacttttacataagggaaaactggggctcatagactttaagtggctgcaaaaattactcagctaatgagtaatggagacaaggcttgattgggagacagaagactttggttttcgactatgcacggggtggagtgtgggaagggaaggcagtgttgtttcataaaggcctggacttaagctctggtcatggttaggtcagagttctgaagctagaaaggaagtttcagctttaaacatttggcccttcccccgttccagtggttgcccaacctcttttcagtctctcttctaaatattgtaagtcaagactaatgtttagagagagagcacttgggggctgtgtggggatggccacctgttatatttgtgtcctgcctacttggggcctggcctgactctggttttgcaactggcttcctgtgtaacccattcttggtagtgtcagaccactgccttcaaggctaattgtgctttccacctggttgagccaataacttattttgttttgccatgctcctggacatatgggagttgcttattagtaggtgagaattgtttgggggctgcttagacctagctaatgtagagtcttgtttgtaccttggtgggagcaagagcatcaatccaactttttgttgagaggaagaggtattggagaatcatggaaaaggcactcttttttagttgaagagctgttgtttatgctgggccttgctgttagctttccagagcaatcttgaccaagtccttgctcgtttttgggccatagcctgttccacaagaggttggtttggctaacctctgagggctatttcctgctctgaaactctgatttattcagaaatgttatactcccctaacaatggaggctggtctgccctcccatgggtacgggaatggtggcacacatctcagaaatggttttgttctgtgcggaactgagccaaatggacaactctaccagctccaaaaagttggaagtggtcagctgtgtctgaattttgtaagggagcataactgggtggaggggtgaacaggcatcattagaggccggatgtggatgaggagggaagaagtgccctggagaggtagttcatagagaacccaccagaaacaggtgataagctgacatcatgaggtagatggtttatcccagtctgtggccaggtagttcctggtcacaagcagttggtacgccctcaggaatgtgataccatcacatgggaatgtgtcactagagcagccaaaaggctgtggatgcaggaagagcagctctctcttgtcaccattccctctgtgaagggtgggagattcttaaaattgggccatagagaccatatgtggcaaatgaaaaaaacaattcacaatggcagataggactggtcctttagagaaaggaaaagttgtaatgcttgcctgatgtcaaagcatgtggggttggatttgctagttccaatacattttaattttttttcttgtggacttgaagcaaggtttggaaaaagggggaaatttgaactcatgacctttggaaaccagaatgaagcttaatgttgactgttagagctgcccttcttatagtagggggctgagttttgcatggagccatctaggctccctgccttctgatctaccttggccagggtgtacctggggaagtccagcttgcctgtgtaattgatcttgaccagtttgtaggagcacgtgtagactctgattaattggtttgggttaaggctttgggaatcaatattttctgagcactcccacagggaattctaacattgggcaaaggttgattactgcatctctaatagaagcctctccttgctacatgtgacaaaactgaaccagagaaaggggagggaggcctgtgcccatgtcaatatggcatggatacagctgatctgagcactgagctaatgctttttccagggctctttggactcttctaacagttcaattggacatcctctaaacttggtcagaggtccagaaggagatagtagttatggcccccaacccaaaagtgctggaggaaggggtggggttaactaattgcacccaagggaggtgagcagccctttttagagagtgagttcaccgtctgggcgtgagcagaccagtggttgggggaaaggggaaggatagaacaggataggaggtgagtaatgctgtgggcatcaagacattcagttagtgggaacattatagggagctggtgagctcaaggacctggtgacttcactcctcagatccatgtggacttgcagggctggagccctgtctcagtgtccaagacgtgtgtcttgtgcctgggaactgaggactgcttgttctctgcttcctgcttcagctggatggcctttacgcttgattagggagtgagcccagccatagagcagcctctccttggccccagcccctactgctactatcctttcagagtggatcaagctctcgcgcatattggggcacactgtatcacagtgtggtctttgattatttttccactgttttacatgtagtatcccgagtagagaataagctccttctatggtaggaaagggggctttgttccaagtccttcctaggggcatgggaaggtgcttaatggagagaagcaagcagcatgagtaggacactttgggtttcttttctctcgccagtatcaaaaggaacttttcttaggagagaaaggtaactgggagctttagggtggatatagtacacacttcattctctggggtccaagaattatgtctttttcctactaggtggggaaccccttgaagtagtacttggcatagtctctgtattcccagtgcagagtaaaataccccacactttgcaggggttcaatagctgctgaattggtttaagggcattttttgtcttatcctctcccttgagtcagattagattccccagaagccccctatctcctggctgaagactatggaagctaacaggggaggaaaggaagggctgcatccacagttggctgtctggcacctcttggatccagaaatccacctataattcttagcagtagttaacttttcaggtgtatatactttcacatgtagatgttttttatttctttttgtttcttttcctttttttttgagatggagttttgctcttgttgcccaggctggagtgcaatggtgcaatctcgacttactgcaactttcgcctcctgggttcaagtgattatgctgcctcagcctcccgagtagctgggattccaggtgcccgcctccacgcctggttaattttttgtatttttagtagagatggggtttcaccatgttggccaggctggtcttgaacacctggccttaggtaatccacccacctcagcctcccaaagtgttgggattacaggcgtgagccactgttcccggctcttttctttttctagaggaggaacaattgtgaagagccagggtgggaggttagaaggtaggcactcctgaatggttgtttcttcccaccacttttgagagaagggccaagcagatcatgaacatcctagacttagtccagaggagaaaggccttagtgtagtgttggccactaatggaggtcattagccgtggagctctgtggtggccttctttcattcttagcctctcactcccattgagtttggcatccttagcttgatttccttttattctccaaaccttttctgagggaatagggagagaagcaaggcacacatgttcctttgcttcttgagcccttaattggccagctgggagggatccccttcttgcttctttcttcttcatgcatgcctgttgctctctaaggtcagggatttgagccagaggcctgggagtcaggtactttatggctcagcccctggcctggggcctcctattgtggggatcagcttggcccagggccttcctagtatgagaatggaatgagcttttgtggaagatggttagtggtctaagcttattatctattttttctgccagtgcctttgcataggaagggagtaggctgctatgtatgatcaattggtatgtgggccagttatctttggctaactttcagataaaacctttgctgtccatcttttttggaaagtagaatgtgaaaagagatatttatccaggtttgaggccttgcagatagtcagtggagttatcagtatttggttaagtctaggaattggtgaacttgcctgttggaccagtttttgtatgtatcataaaaataagttttaccattttaaaaacattttttgtttgtttgttggtttttgtttgttttgttttgttttcagacggagttttgctcttgttgcccaggctggagtgcagtggcatgatctcggctcactgcaacttctgcctcccaggttcaagcgattctcctgcctcagcctcctgaatagctgggattacaggcgcccaccaccactcctagctaatttttgtatttttagtagatacgaggtttcgccatattggctaggctggtctcgaactcctggcctcaggtgatcctcccacctcggccagcgttgtttttttaaaaaagaaaaaagaatatgtaaccaagactataagtggcttacagagacagtttgccaatctctgctagtctgtgctttagactgccaatttattgtatacctatttcttatatactcatggcttctttatagtcacctctttcctgatccagacacactgcaggcctttgaatcctgcttcttgtagccaatcataaataccttccatgttggttactaactaaccaaaccattgtgtctccttccatgtatacatggggtctgtggtcacctagggttagaattaaaattgtacttttcaaaaaatcagctcctgggttcattgattttttgaagggttttttgtgtctctatctccttcagttctgcactgatcttagttatttcttgccttctgctagcttttgatgtgtttgctcttgcttctctagttcttttaattgtgatgttagggtgtcaattttagatctttcctgctttctcttgtgggcatttagtgctataaatttccctttagggactaaagaatatttatgagtagtcaatgagtgaggttggcttaaatggttttcaggtgataattaatggtgagcatcctaagtagagttgcctcaggtcttcctgcgatttttttggggggcctagagtctcatcaacattgctcaagttgattcaagagaaaggagggtggtagttataagataaatgacagaccaaatattagaatcattttaaccattatttattgctgcatgactttgggtaatgtatttaatgtctctcaaccttagtttccccatctttaaaatggaggatagtgggccgggcgcagtggctcacgcctgtaatcccagcactttgggaggccgaggcgggcagatcacgaggtcaggagatccagaccatcctggctaacacggtgaaaccccgtctctactaaaaatacaaaaaattagccgggcatggtggcatgtgcctgtattcccagctattcgggaggctgaggcaggagaatcgcttgaacccaggaggcggaggttgcagtgagccaagatcgcaccactgcactacagcctgggtgacagagcaagactccatctcaaacaaacacacaaacaaaaaacaaaaaaaaaaaacaaaacggaggatagtactgatacctacttcactgagatttatgagagttaaaagagctcaagagtatgagtatatctaggagagtacctggcatattgaaagtgcttgataaatggctgagttccctaagtcttttccatcatactttgccctctttaaggatttgagatcaaataattttagaaccctgaagtctgcttttaatttgtgagtgtgcctcctatactacattatctctttaagatttttttttttttttgagacggagtctctgtctgtcgcccaggctggaatgcagtggcacgatctccgctcactgcagcctttgcctcccaggttccagcgattccctgtctcagcctcccgaggagctgggactagaggcatgcaccaccacgcccggctaatttttgtattttagtagagatggggtttcaccatgttgtccaggctagttctggaactcctggcctcaagtaatccacccgcctcagcctccaaaagtgctgggattacaggcgtgagccaccacgcccggcactctttacggttttgttttaatagatgaggaaactgatacttcaaacagtgatgccaatgactggcctagtttgtggtgaaacccatcgtgccttctgctgcaatctgttggagggaacggttgtctgagaatccatgtgggtgtatctatcactttgtaaagaggaactccagctctgggaagccttaaaagtcccaggatgagggagtagtagaaaaggagaagagggacatgagacccagggtagaaaggatggttatggggtgtgaagaatggaggatgtaggaaggagaaaatgattagaggaatccttacttaagaaggcaaaacagtttgtgaaatcaatggatctccacccctttgcagaagccaggcagccttggctggggcccacctcaggcccttgttatgctggtagctttcacttcttctttgtgtgtgtgtgtgtctgcgtgtgtgtgtgtgtgtgtgtgtgtgtgtggtggtggtggtggtggagtatagatgcagagggatcttagtttggttgcctttccaggtctatctgtaggtaggcaggttatccatgtgtattgaaagtatgttgtcgggccgggcgtgttggctcacgcctgtaatcccagcactttgggaggctgaggtgggtggataacctgaggtcaggagttcgagaccagcctgatcaacatggtgaaaccccgtctctactaaaaatacaaaattagccatgcgtggtggcacatgcctgtgatcccagctacttgggttgctgaggcatgagaatagcttgaacctgggaggtggaagttgcagttagccgagatcatgagatcgtgccattgcactccaggctgggctacaagacaaaactctgtctcaaaaaaaaaaaaaaaaaaaaaaaaaaacaaagaaagaaagtatgttgtcatgggctccctcaagtcctgaagagtgattcctctgaggtctgtgtgagctagggtggggagtgctcattaagctaagctggtgcctcagtggggctgtgggaacataatcagcttcttatctttattttatacattagtctatcttgcctggctttgtcttcagggatttctgtctctgattgtggcccatctcccccaaatctatgagctggcacctaatgccaaagtggtgggaagatctttaattcattttcttctgataaattctgggaagagggtcaggaagctgggaaaggagacactgatatttaacttcatgcctttgagagaaaggcatactttgtgtttcttacctctgtatccctgtacatgctgtctctctacccagaataccatgaggttccttttccctttaatctttttcttgtgacagtctcctttgtccttcaggagaggtcagctctatctcaagcaaccttctgccttctcacctccccttgtctcctcaccttccccattatggcctggatgcctcttgcttgtgtttccacagtccactttaattacctctatctctgcccttgctgtatagaatggtaatttctcatccatttatctgcatatttcctccatctgacaaaaaaatgccctcacgtgcttgctcattcacacacacacacacacacacacacacgaattatttcaaagcctgatccgatccatattgggtgtctgataaagtggtggtatgtagaacctgtatgtgtatacatatgtctgtgtcaatgatgtgggttctttctgaaacacctgaggtaggtaagaggtagccttacttgtttttccagatcttgctagaatagtagatttttagggtttgctttggattatggaacaatgtatgttgccttgaccattagggaggcttctgggtaatttccatagagattctggttggcctctttactgttgtctgaaaaaactagaccaaacattcggggctgggggtaggattcttattctctccaaagaactgatatgaatatgtgtgtggggggctagataggttcatgctcgctcacctcagcattgaggggtgtgaaggttatatgtttgtggtggtaggggtgctaaaaacccttgtattattgcaggataggttaaatagtttttactagtctcagtaaattgttagctgagcttgtggtttggagggaaagatgtggctttatcaactcgaaaaaacaaagccagcttttagagaagttacctcaagctacatagggaccaaaactaataagctggatgccatgtggtctcttatcttatccttgccaccaagagactcttccaaaacaatcatagatccatacagcccaagagcattctttgggctctctgaacctctgcttccaggaaggcggtcatacaaaaatgaaggctgtgagctaatggctgtaaacaaatacacttgcagcaggttatgaggccacctttcaaccttcagcacatccactggaggtaggtatttttgagactactctcaaaaaattttttcttaaggcctacgtgataaaccttgttccctaatggggatgagaattggattaggctgtaagattagcctaggggaacagcaggctgggtggggggttggggacatcctgcttaggggtagccagccaaagtcccccatacaagcccaaccaaggatcatgccacattgaaggtctgcacagtagtgaggcagtgctgtggaatgacatctgccttccaacttcttacgtgagtaaggaggctctccctgaatattcagatggatgttcagccacattctttgctatatttatagggtggggagggaagacaagggggagccagggagtccgagctgtttagagaggagagaaggaagtttcaacaatgggtaggttcaggctgtggttcctcctcactgccccttcctctttgagtttgtcaggggaccttcctatggcctgagatcattttctttttcaaagtggccaaagccactgtaggcacatttaaatcagggtgctttagcagaaataccaatgctggcatctaaaacccatgtgtagtgagacttgattgacatttgggacctttttaaaactgtaattttattgtatttttgcatttcctggtttgttaatcaaggaagaacattggcatgtcatcttccagtctccaaatgtaagttaaattgtcaatttgtgtttttccagaaaatttctttttccagaagtgctttgaatcatgatcatctatctgtaggcatggatcctccaatttagaagttgctcctagtgttacctagttacccttcctgttccattctgtgaaactgggagatttactgtagattattcagtctggtcagacagaaaactgcagctccctccccagtcaaccaaagcctcctctatggaggggaggtatggtaatgacattatctttccttaggcagccgcgtgttctctgagaacaggatgtggggagggctgggccccagtcacagggtatgggggtgggcaccggaaaatgggctggtggtaaggccatgaggattagtgcttgccttcttggctttgagaggcatgaagagctcctgtattcttgattgttcactcatgtgtacaccccaccctcgcacatggcatgtctgtgttcttaccctaagaaagactgtacctgagaaacaccttgtgtaagagccccagctgtttggcttgcagaaactcagtgaggtggagtgagtgggcccaggctgctcactgtaccaacccatgccttgtgattctttatgacagcctgtggcttcaggccacttttgctaagctttattggggagctgggccccagtagataatgggcagctttgctgctctttctcagggccccagttgtttccctccccacaaatggctccttagctgaggtgatttgcatgttcaacttcctttcaggccccatccttctcttctccctgccccccactgcttctgctggggacctgtggtgatgttctgcctggggtggggaaaagaggatgtagctagcttcctgtgcaaaagagggtggggcgccggccttcctgcctgtctgcccacccacccagtgcttgaggaattgcctgaagagttcagttcagagtcaccagagcctgaagggctttcttcagagtagagattgacctttgctcatgctggtctctctccacagttttctactgtgggaatagctggacacttttttcctgaaatcgcaatgctgaaaggacctttagaggccaactagaccaaccacttcacattacagatggggaaactgaagcccagaaagtcatataagtcctataaggaatcagtggcaaagctaggatgagtagaattctagaaggtcagacctagggctctctccctcccgtcaagctgctaatccagtgggttacaaactgtttggctgggctacctggtgagctacagcctcccttcaaccagaacagctctacttttacgtacttcatattttgaagttttgtgtgattttctgtttgggagattgaggaggcaggaagctgttagaaatgtaataaagtcaaaaccactgagcaaaacccagccattacagttgggaacactcagacctacagggggaagtaaatatccgaagtttactgggattggactcagagacccaatctctgaaccaccattcatggctggttgctccgagctaaagatgtggctccttctaccacaagggctgttcccaccctgtgttaccaatgctattctcctttcccaaagacagcctcttttgtagcatcctaagacagacctgaagtccagaggctgctcaatttcttggatgaaacaaatgataagccaggagcggtggctcacgcctgtaatcccagcactttgggaggccgaggcgggtggatcacgaggtcgggagatcgagaccatcctggctaacacagtgaaacaccgtctctactaaaaataaaaaaaaatagctgggtgtggtggtgggcgcctgtagtcccagctactcggaaggctgaggcaggagaatggcgtgaacccaggaggcggagcttgcagtgagccgagatggtgccactgcactccagcctgggcaacagagcgagaatctgtttcaaaaaaaaaaaaaaaaaaaaaaagacaaatgataataggcaagcctttggaaggacctttgtgtagccttaaataagataaacttggaaaggtaaagaacagaatactagtagttggggagatcagggttctagttctatttctttcacacttgagcatgttgctttttaccttactgaacctccatttctcccttctttaaaatggtacttgtctcgggcttgtctttttcttacagggtttaattcagtgagagaatgcatatgggcaagtatcttttaaattgtagagcactgtgcgcatggggctaggattattgttgtatacaagtgagccagagaccctggaagaatctgggttggataatggcattgcaggagaaaggaactaaaatttatgaaacatctactacatgccaggtaccaagccaggtgcttttctgtttgtaaaggataaaatgtcagccttgcaacactccggtgaggtaggcattattactcccattttacctgtaggaaaactgaggctttaagaggtctagggacttgtaatgttccagagactacctctagagcccagggtttctgtcaggtatttgtgaagagatcttaagaatgtcctatggtttctattggggttttctagcccactccctgcctcactccagcctctctcctctggtggggatgagactgtctcttgttggcttcatgtctcagtcctgaactctttatcctcagatttccttggagtgcactgggcacaattaggtgcccttgtttggcctttagctgatggggagccctttgggtcagccaccttttggctgatagtaaggatgtcctgctaccctggggtgctggtaaggagagccagggatttatagctagccagacagacttggctcttggtcaaggtcatgcagctagaaaatagcagttggttcctttctttgagactcagtttcctcattcataaaatgggtttaataatgcttaacttgcatgtgtctcttgtccagtgtgctggtaaatgtttaacaatcaactcttcggcaaatccatgatttttactgtttgccaattcccatggtataaatactcccaccatggctgatttcaggttaccaatatgcagtccttgatggaggagttgggaagagatgtgcatgatcagctctagtgcaagctggttctagtgcaccattgctagtcacacctattttagactcctaccctcaccctccaacatactcacatctgtatgcaaatgcagcatcctctcaaccatgcctcttcttttcctcaagttccaagagcatcaaggaaagagagagcttcatttaaggtctgctccttgcctgaaagttcttccaggaaagagtgaatgtggagtgtttaagacgcagagaactcaagagggctttgagtggggccctaattatagcattgtgatcatcatgctttggctgctgaagtatctgaactgtctgttttctcccactgtttgattcttagctagatgggaggatggttgaagatcctggacaatggtctgagggtctggtgcacttagcgttctgattgtaatttcaaagtctcctcctcttcctgcctgcagaccttactttgctgggtgctaacctcaaggttcctgtcatggggatctctgggccagaaagcattttggatgaccagagatccctggtcctgttctctcatttcaacagcatcaaggccatgtgttgtttctttgaacttttcagatggaaagaatcacctgaggcatttgttaaaatgctaattccccagcgtcttctctggagagtccatttcagtaagcttggggtggtgtccagaagtctggactttttgaccagtgccaaattcttatggtaagctaagtttgggatatacctcattaagcactgcacaacactcctgccatggtggcatcattatgcccacgttacaagttgaaatttaagagttcatggtttattattggtagacctggatcttgagatcaggttttcagaatacaaagctatgttcctcttactacagagacattactttagtgcacagtggtgtatgtgatggtgtgtagtgatgattttaggtagggaggagcagggataatccctgcactactttacaaatagggaggccaaggtgcagagggatttgagggcagtagcagaactgactgcatccttgcatccttgatcttttgtggatgtggaccgtattcaattggcttttttttttttttttgagacggagtcttcctctgtcgcctgtcgcccatgctgcaggacagtggtgcaatctcggctcactgcaacctctgcctcccgggttcaagcgattctccttcctcagcctcccaagtagctgggactacaagaatgcaccgctacacctggctaatttttgtatttttagtagagacggggtttcaccatgttggccaggctggtcttgaactcctggcctcaagtgatctgcccgccttggcctcccaaagtgttgggattacaggcgtgagccaccgcacccggcctttcagttgctctttacttgctgtgtttcccttctatcagacatccctctagtcatattaacaccatcccaggccaggcgtggtggctcacgcctgtaatcgcagcactttgggaggcaaaggcggtcgaatcacttaaggccaggagttcaagaccagcctggacaacagggtgaaaccccttctctactaaaaatacaaaaattagccagacatagtggtgggtgcctgtaattgcagctacttgggaggctgaagcaggggaattgcttgaacccgggagacgggggttgcagtgagccaagatcacgccattgcactccagcctgggtgacagagtgagactctgtctaaaacaaaacaaaacaaaacaaaacaaaaacagtttgtgatcttctggataccatctgagggagtttggaggtcccagtgggttgtgttgagggttgcagacttgtgtgtgttaatgggacataactggagaaaatggcaaggcagagtccagaataaggaaggaagatcaggcagcctttgaaaataataaggcagcataggtgctgtgttgtgctctgcctttccataggattctgcttcttggggaggaaatccccatctctctcaagagataaaatatttaaaataatgctggaatacatgtgtatttaactgttgtgcatggtttcacattgtcttgccaactagaaatgtaatcaccttttagttttccctgaaagtgagagtcctttatgctagaagggctctttagaggtcttcttgggcagcccctagccctctgtagtgaaacaggtttttgttttaaattattcctgacaggtaggatattcgtcataatatggctaaaaggggagggattagtaatcatcacattctacttatgatgtgtcaagtactttcatgtctattattattattatttttatttttattactgttcaattattttcttcctccagtgtcaaacatgtctgttatgttaacttaaatctcccaataaccctgtactgaggtcgatattattagacccgttttatagattaggaaactgaattttagaaagaggaaggtcaaaaaggctccaaagctcaaaatgctgagaccattatttccaggacaagggctcctgggttttctgtgggtttcccagatactagatttggttcttagcttaccagcaaggtaggtaggaagccaaccttagcctacccctggggttgaaaacagaggttttttgttttttgtttttttttgacaggatctctctctgttgcacaggatagagtgcagtggcaagattttggctcactgcaacctctgcctcctgtgttgaagcaagcgattctcatgcctcagcctcctaagtaagtattagtagctgggactacaggcgtgcgccaccatgcccagctaatttttgtactttttgtagagacagaatttcgccattttgcccaggctggtctttaactgggctcaagcggtctgcttgcctcaccctcccaaagtgctgggattacaggcatgagccaccacgctcagctggaaacagagctttttgattagggccagaagcgtccccctgcaactgcatatttgactaatcctggcttcagcagttttaacattcccatgagcaatagatggaacccaagtttgggtttggatcagctccagtgtgcttcagaagtatgatgctggaggttgctggagtctgttcctaagcagagggaatagagccctcttctggcaccctgggcagagctggcatattcaggcagccaaaaatggtcagtttccagtctacaaatacttcctgtaaaacttgctggcaggaagctgggtcaagcaggaaagtgacgctaaagagtgaagcccagctaggtgtggccccggataggggctttgcccatctggagacttactttattaatgatgggtctgcacttcttttatttcagcagctttgaagttttatgggagttgaaggaatctgttgttcttggctgcctggatatgaacccattactcaaattcccttcctctttctctgctctgtgccctcctcaatccccagcttgagtcttggctatgcctattactgggggccttcccaaccagttgctattcaagtttttccaaagaaaacagttctggaaacagggctctctgagttctccttccatggtgttataaaatatttagtctccctagaatgggtggtggtgattgtctcagatcctgaaagttaggcctgccctctgttgaaagctaaacttccaagcagtgccagcttggagtttttcacggaaacaaattgatccagcctcctccacatagttttttttttagatcaataatagtatgcttgaagtatctactgttttctaaatgtcaggctggcactatggcttactaaataggctagtggatcaaaagccaggttttttttttttttttgagatggagtcttgctccgtcacccaggctggagtgcagtggcgcaatcttggctcactgcaatctccgcttcccgggttcaagcaattttcctgtctcagccgccctagtagctgggacaacaggcacacaacaccatgcctggctaattttttgtatttttaggagaaacaggatgtcaccatattggtcaggctggtctcgaactcctgacctcaggtgatcctcccaccttggcctcccaaagtgctgggattacaagtgtgagccaccgcgcccagcctcaaaagccaggtttttagcccctcctcccacactgcctagcagctgtgtggctctgggccagtgcctacctttctttggacctcagtttccccagctgtatgttgcaaggttcgaatcgagtgatctctgacgtctttttcaggtctgacagtttgggattctggactgtttattttcttagaggacaagttgaagttcagaagggagaagccatatgagattctaggatgcatgggttgaaataatgagaaaatgtaaaaagaggaatggccatgctaaggagctggtgtgtcagcccatgtgcctaagaaggagagatgagttggggctggagagtatttgccctgggggtatggtttggctaaggtgattttgaaagtaagaactgaagttaggttcagacactaagcagatggttttcttcctgactttcacgtgtggagagaaaaacaagaggggtttacctgggcctgaggttgaacaaaaggccatgcaattacggctggattaacgaagaaactaacttgctaaagtgacatcactgtttctgatttttttctttcaattttcacctctgacctgaactctgctcccacagggacaaggtggttatatttccattgctaaccctcacacatatggtaattggaggagtaactctcagtttccagtgtgcccttgtcttccagttgaaatgcttcttgaggagcttcggatgacagggctgggtcaaaacaaatgaaaggggacccttgtctctgacgccctctggagcagttggagtggttgaagaaatactgctaacccattaaggtgtgagtgaggttgggtgttgttctcctttctagaagctactgggaaaaggcacaggcataggaaaggttaaccccagtcaggttttatgggctgtattgagagtctggaagaggtcctagcagataactgtaccagttaccacttccaagtcaacagggaagaggctgacttgctgagaagtgagttagtcagtgaaggaagaggaggaggagcagaatggcccctaggctaaagattcaaagcaaaccttgttttccctcttatggaaaaaagctagttgagacagtgctgtcatccagagaggcaaaacagaccaggacctgccctgccctgccttggccccactcttagtagcaggaaatggtgggaactggagcctaaacaatggagtttagcttccgacctgatgaaggcagtgtgagtgacgctgtgatgactattctctggccaaggaagatactagaactctgggattgcgttggtagggcacatccttcttctggctcccctgccccacttatacttgccttcttctctacaccagcagccccactgaaagcccagcaggggtggccccctggggaggtggcaggtggaaatgaggtcattgagctcagacccaactgggctgactcacaacctctgccccagtgagacaaggggaccttcccaagcagtgcttcccagatgtgcccaggcttcctatgccagaatgtttgagtcttagccaaaatagttgccaagccagtgtctgaagacaacatgacaggagaggtgggtggagttgtggaaggagctccaggaatgtccagaagacccgcctccactacttgttggctgagtaaatgtgacctcagtgatgttaagtgagactgtgtgtgatgaggccgacacattgttggcattcagtaagtgttcatttccatccttctgtcacctgcctctatgcacttcagttttctcatctatgaagtggggatggtaatgttcatcccctcagctcggaggtccatgctccaggcaagttacttgtaattatttgacttactctctgcttttctctctgactcttccaaacttctctccaggaaagagccatcttatagttcagtgacatggggtaggtgaggggaaaccattgctaatcccttttgctgtagctgggctacagctcacctgggtgcttctgatgataggcaaagagagggttgcttatttgaaactggcaggcccagacaccaaagtacctctcagctgctggtgccaagacagaggtagcatctggcctggttacttttgtgtctcagcccagctaactggagacatgagagagaacccagtttgttgaaggctttggacagtgtaccaccgagatgagtttgtttgtgcttagtgaagtgcttggtgtgggaagcgtctatgttgaattgctcagtaaataacagtgggcttattgttcttgggcaacaggtgggagggccagtgcatgtgagaggatgacactcctccttccccaaacacacatgcagacattttgttattgttccttcaaaccttaatgttcttctgagacacagtctttaacctcatgctgtgcctagatcctcagggcctggcttaggcagggatctaggcatataaacagttctcttctggggactacatcttgaaatgctaccccatccgggtcagctcctgtattcctgtcaaactgaaggactggctgggaattttctgccaactttggaaacttcatttttaggttctttcctcccaaacaagaccactgtcttctctttagggagagagcagcgtctaggcccgaaaagaagaccatgggtgcctactaagggtgagcatccagtgggccctctgtggcagtgggtctgggcctgcagcccatcttgcactcttgaatccctgattaatctaagagagaacaaagggaccttctttgatcaggacttctatcctatctatcactttcaggccccagctgttactacccttactccctgctacctctgacacgtacacagaaaacaggagagcatagaccaatggccttgtcctcatgacttagtttttttctaatttttaattttaaaatttttattattttttaacttgatttttttttttaaatagagatggtcttgctatattgcccaggatgatctctagcttctggcttcaagctgtcctcccaccttggtctcccaaagtgttgggatttacaggtgtgagctgctgtacccagcctaattttgatttttttaacctgacacatcataataaatgcatacataaattgtacatatttatggggtacatagcagtgttttgatatatacaatatatagtgatcagatcagagtaattagcatactcaccatctcaaacatttatcatttctttttgtgagacagggtctcactatgttgcccaggctggagtgcagtggcatgatcttggctcactgcaacctctgcctcccaggtttaagcgattctcctgcttcagcctcccgagtagctgggattacaggtgtgtgccaccatgcccagctaatttttgtatttttagtagagatggggttttgccatgttggccaagctggtcttgaactcctgacctcaggtgatccgcccacattggcctctcaaagtgcggggattacaggtgtgagccaccgtgcttggcggggtgtttaactttctgtgcctggcttatttcacttaacataatgtccttcaggctcatccatgttgctgcaaatgacaggatttttatttatttatttatttattttgagacggagtcttgctctgttgcccaggctggagtgcagtggcatgatcttggctcactgcaacctccgcctctcgggttcaagagattctcctgcctcagcctcctgagtagctgggattacaggcacacgccatcacacctggctaatttttgtagttttagtagagacggggttttgctgtgttggccaggctggtcttgaactcctgacttcaggtgatctgcccatctcagccacccaaagtgttgggattacaggcatgagccactgtgcctggccaggatttcattttttatggctgaataatattccattatgtatatatgccacattttccttatccattcatctggttttggacacttgggttgattccatatcttggctattgtgatgtagtgatgcagtaaacacgagggtgcagatatctcttggatatactgattttttttcctttggataaataaatggctagtagtgggattgctggatcatatggtagtcctatttttagttttctgagaaacctccatactgttgtccacagtggttgtactggtttacagtgctgctaacaggactcacatttgcttctgagttaagtggagacaggaatgggaattcttttgtgtttgtttttctttccaactttttaaaaacccaaaattatttatctccacattgaagttcaggaaacctcaggctgctatccctggggaagaagccatagtggaatggcagaaaccctgagtagagattcagaaaaaacaggttctggttgggtttcagctcacaccttctgattttagtagagcccttttaccagggtgatcctctacgagggaggaagcatggccaaccctagcctctctgacatgcttattcatcactcaggatgggcccttctttaccaattgatttatttaataaatatttgtttaacgaatatttgattacgtactttgggccagcactgggcttcacccttgatcagtgccctgaagacgctggattggcatgacctacaattgacatgatctgttcgagacactggcttgcttcctttgaaaattatttccaatattgtgaattaaagggaactcctaggctttaggatatgtccctggaatcccacccccccttagtttccttcctgggtgttttcttccaaaaagcctggttctgattgtgccccaccctgcccagaacctctagactggctggccactgccaacaggattaaggcccaaccttctagcatagccttcaatgccctccacttatcttcctagactctgccctctcttcactttgcaggcctcattcaccctggagtaggactgacttctaaagggaccatctgcatccttgcctccttctgggccatcatacatgttgttttctctacctgggacatttgagtgctcttgtgcctaccctcacagtctttcttttccacaatccagcttattctttggaaatcagtgcaaacactactttgaactgtggttcctaatttccacgaaaggttttctctgttcttctattatggcacttttcagggtctcccttgtacattttagtttttgtgtttttcagtaagtgccttgagatcagggaccggttctactggtctgttccaaccatagttccttaaacattgtgttccattaatattgggtgaattgaaatgaatttataggaagctccttaacctggggtcctcagacctctatggggtccatggacagaatttgaagtgggaaggatatatgaacttggatggaggaaaattacttatttgttttttaccaacctctcctttgtaatttagccatttgttcaattataatgtaggcaaataaaaataaaaataaaaataaaataaaggcagcaataatagcagtacccatgaccttgttaccaactcttaggctgtggagtgttttcctggattctaccctttttttaaggtttcttaataatagaagtttatacagaaactatctaatgtacttttttttttagatgaagtcttgctctgtcacccaggctggagtgcagtgacgtgatctcggctcactgcagcctctgcctcctgggttcaagcgattctcctgcctcagcctccagagtagctgggactacaggcgtgcaccaccatgcctggctaatttttgtattattattatttttttgagatggagttttgctctttttgcccaggctggagtgcagtgacgtgatcttggctcactgcagcctctgcctcctgggttcaagcgattctcctgcctcagcctccagagtagctgggactacaggcgtgcaccaccatgcccggctaatttttgtattattattatttttttgagatggagttttgctctttttgcccaggctggagtgcaatgacgcgatgtcaacttgctgcaacctccgcctcccaggttcaagggattctccgacctcagcctcccaagtagctgggattataggcatgctccaccacgcccagctaatttttttgtatttttagtagaggtggggtttcaccatgttggtcagctggtcttgaactccagacatcaggtgatccacctgcctcggcctcccaaagtgctgggattacaggcgtgagccaccgcgcctggcctaatttttgtatttttagtagagatggggtttcaccatgttggccaggctggtctcgaactcctgacctcaagtaattcgcccgccttggcctcccaaagtgctgggattacaggcgtgagacaccatacccggcccctaacatacatatttttatatcacaattagttattgtatatttctcaaaatattatttatgctcaatacacgtttgaaattacagtggcaataactaactaataagacctagtgctcggtaattacttaatatgataataagcacatattattaaattttgatttatatttcaaatatttcgatataattttgttatattgtatctactttatttcatgcatttacaaatattctaagaaggggtccataggcttcactagacaggcaagaatgattcgtggcacaaaaaagtcaagatgtcaaatttccccatctttgtatgtgtatattatgctgtatctatctccaatatcccttgtttggtacccattcatttagccaacatcttgcatgagtacccattgaatcttgagtactggaaaggtaattctaagtaagacgtaaactttgagttgagaatgaagtctattattctaaaaagcccactgccccctttctattctctcctgtcccttcagtcattggtgttttgaggtcacccttgacccagctcaagggtgatttgaggctggatatagtatggtgcccctcaaattccagtccaatggccccatcctactttatgacggcccattctgtaggggtcactgacttggcaggaagcctagggtaggaccaaatcaaagtggctaaccttgccttactcccactggggtacttgccttacttgttcctgccttcagggcctttcctgtcccattgtcaatcctaaaatagatttcctccttggctccctagcgagatttatttacaaagttgttttctgggcctgatcctcatcgtaattgtttatctggcaaaatagctgcctggccccctcttccctgctcctgacccgtgtgttcaggaaagtcctagaggttcaaagactgataaggtttaatgtcttactcactccatggaaatttgcatctttggcaatactatatctagtgctttccctcaatactataagcagtatgtgaccaacttagaaaatgtagattagattttttttttttttttttagtttaaagaaaggagaaagcacccataagatcaccaccccaaaaccaagcctgactaatacttggacaagattccaatcatccttctatgtatacattttacaaagttgagctcacggactctatgaaatactgtttacatttcctcaatattactaaagtgtcttccgtgagcatgaaatagtcttcataaagattttgtatgaccatataagaagccattttgtggctgtactatatacattatttaagcaaaatatctaacaactaaaaatcaatcttttttttcttttaatgggagacttttgtactctgtaagaggaatttagcatattggtttacattgtgaggtttggatttagacctggattcaaaccctgtctcccctgcttaatagcaatgtgactttagacaaatacctatttctttatctccaatgtggagataatactctacttcacagggtgattattgatattaaatgaggtagtacatatgaagtgcctggtgagtagcaagtcttgatacaggaaagctgctgcctgttactattactactgctaccattactactgagttttcagccaaaggactaaatctctaattatgaaatttcagctatcattgacctagcttcgaggatctatttgtaaaggtggtattttttctagtgcccgtgaaatcatgtgtgtggctgtctcttattttggtctgggcctgtttctgcacctttgtcctcccactgagttggctttggtagcccctctatgccacccatacccacctctactgaggcccccttcccctcttgagcctaaggaagccaatgagacataaatataggaagcattagcaatgcaaggcagtatatagaaccaccgacatcagcactgaaatggtctttggaccatttatctagtttaattggctgccctccatcccattcctgcctttgcacaggtaagggaaactaaggcccaggaaaaggacaggagttatccaaggttgtagatttgaccagctacatgctaggcttggaatccagtgttcttctttgtttttaatttttattttaagttcaggggtacatgtgcaggtttgtcataaggtaaactcatgtcatgggggttcattgtacagatcattttatcacccaggtattaagcctagtacccattagttattaaaatattttttcctgatcatctccctcctcccaccctccaccttctatgtgtctgtgtgttctcatcatttaattcccacttataagtgagaacatgtggtattctacaacctctgcctcccgggttaaagcgattctcgtgcctcagccaccaaagtagctgggattacaggtgtgcaccaccttgcctggctaatttttgtgtttttagtagagatggggtttcgctatattgtccaggctggtcttgaactcctggcctcaagggatgcgtccatcttggcctcccaaagtgctgggattacaggtgtgagctaccatgcccagtctggcatttgattttctgttcctgcattagtttgctaaggataatgacctccactccattcatgttcctgcaaaggacatgatcttgttgttttttatggctgcatactaacatacattttctttatccagtctaccattgactggcatttaggttgattccatgtcattgctattgtgaatagtgcttcaatgcacatgcgcgtttatgtatttttatgatagaatgatttatattcctttggatatataccccataatgatattgctgggttgaatggtagttttgttttcaggtctttgagaaattgccacactgttttctaccatggttgaactaatttacactcccaccaacagtgtataaaggttcccttttctttgcaatctcactagcatctgttattatttttttttgattttttaataatagctattctgacttgtgtgagatggtatctcattgtggttttgatttgcatttctctaatgatgtaaattttttatatatgcttcttggccacatgtatgtcttcttttgaaaagtgtctcttcatatcctttgctcacattttaatggggttgttttttttcttgtaaatttgttaaagttccttatagatgctggatattagacctttgtaagttgcatagtttgcaaatattttctctggttccgtaggttgcctgttaactcgatagtttcttttgctgtgcagaagctctttagtttagttagatctcatttgtcaatttttgcttttgttgcaattgcttttggcgtctttgttatgaaatctttgtccattcctatgttcagaatggtattacgtaggttttctttgagggtttttataattttgagttttacattacttttacatttaagtctttaatacatatagagttgatttttatatgtgagataaggatggggtccagtttcaatcttctacatatggctaaccagttatcccagcactgtttattgaattgggagtcctttttccattgcttgtttttgtcgactttgtcaaagatcagatggttgtaggtgtgtggccttatttctgggctctctattctgctccattggtctctgtgtctgtttttgtaccagtacaatgctgttttggttactggagccctctagtatcatttgaagttgggtagcatgatgcctccagctttgttctttttgcttaggattgccatggttattcaggctgtttttttgtttccatatgaattttaaaatagtttttcctagttctgtgaagaatgtcattggtagtttgataggaatagcattgagtctattctatgaattgctttgggcagtatcaccattttaacaatattgattcttcctattcatgagcatggactgtttctccatttgtttgtgtcatatctgatttctttgagcagtgatttgtagttcttcttgtagagatctttcgcttccctagttaacagtattcctagatatttattcttttgtggcagttctgaatgggattgccttcctgatttggctcttggcttgactgttgttggtgtatacgaatgctagtgacttttgtatgttgatttttgtacactgagactttgctgaagttatttatcagattaaggagcttttgggccgagactattggattttctagatataggatcatgtcatctgcaaacaaggatagtttgacttcctctcctcttgcttggttgccctctatttctttctctggtctgattgctctggccaggacttctaatactatgttgaatatgagtggtgagagagggcattcttgtcttgtgtcggttttaaaagggaatgcttccagctttggcgcattcagtatgatgttggttgtggctttatcagatggctcttattattttgaggtatgctccttcaatacctagtttattgagaacttttaacatgaaggggtgttagattttattgaaagctttttctgccctttagattatcatgtggaacccagtgctctttgtcctgatattaatttgcctctgcaattgtttaccagtgctatagataatccaggtagatcagaggtgagaagagaaccctgtgagatgaagctgtctagtatagatggaaaggccttcctggaagaagtacagttatcatttgcctgctcttagttgtaggctgatctgcattcttttttaaaaatttttttgagacaaagtctcgctctgttgcccaggttggagtgcagtggtgtgatctcggctcactgcaacctctaccttctgggttccagtgattctcataccccagcctcccaagtagcttgaactacaggtgtgcaccaccatgcccggataatttttgtatttttagtagagatggggttttgccatgttacccaggctggtctcgaactcctggcctcaagcaatccacccacctcggcctcccaaagtgctgggattacaggcatgaggcattgcacccggccttcatgcttgtctgttctttggtaagtattgctctgtggctgtgttgtttgtcttcaataagctgcttgggagcaggggttgtgtttgggtcaatattctcccttcatccccatcagtatctaagttgcccaggctcttagcatcctaactccttcctctgtggttgagcagagacacttgtctcaggctctgttgaacacagagccagatgactaacctgcttcctttgatctcatcctagatcagtgtgcgtgtgaccaccatggatgcagagctggagtttgccatccagcccaacaccaccgggaagcagctatttgaccaggtaaggcggagactccttagcctcctctccttctctgaatagcttccaccacaatgccaacaatccatgacttttgcctcttgtcaaagaatctctcttcctgttcactccaagatagatcaaaatgaaggctgattccagacttaatatgaaaggaggcaaagttaaactttggcagcctgcaccctatggtcctgattaattttatctttggtcctgaataagggagaaaagaaaatggtgtatattctatgctagatgctttaaaaatcttagcatatggagccttccttttaactctgaaacatgtaagtgatgtcttctccattttaatgatgaggctcagaagttaaataacttaattgcacccaaatgatatttggctgggatttgcactccacattgttgccactgcaccacactgcctctgtcccatgtttttgcttcctagtagaaggaaactaacttactctccctgaggtagtaagctctatgcacatttctctcaaaagaatgttgggacttaggacaacatgggagttgatggatgcagtaggaggctgcttcatctcctacaggcatgccatgaagataattgcttactcgccatagtgaagaggtcattcccatctccaacccaaggggtgtcccttcattgtgaatcattattgtcagaaaggatgtactgtatactataataaacagatggcagctacagacatttttagcattcaagggaatgtgccgtctgtggccagacttctaggagcaaaaatgaggctcccatttccagaggctgggacctcaccagacaggccattatcctatttctccaccagactccgatgaagtggaggtctgagttattgtccaggatgttaggctgcatatcaccctgatggattctccaggccctcttgcttccctttcttccttgctctctgtgtccttctaccatatgagaacttccccagggttggagagaggaagaaaaaaagaaggaggtagtgttcaaataagctaattctattcctgtgaatacttctgactggtgagagaaaagacaagagtagaatggagacaggggtaggagagggctagaaatttgaggacagcttgggtacaccttctgagttcttattacatagagtgggaaaattattgtctgtggctaatacagatgagagttaacatttatccaggactcagtgtatgctaagtattatgataagcatttgactatcacaaagctctgtgagtgcatgaattagtatgggcatgttttacagatgaggacacaaaatcctcattttcctagttagaccctgggaaaattattgaactctctgggttggtatcttcatcccctccccccgagaaatatctaatacttacctcacaggatttttgtgagtgtgttatgttttgtatcttacctgttactcaaaaatctgattatagtggcatataaggatgtccaatccaaaaagataaattcgaaataggtgagaaagataagaaaacacaaataggaaagaaagtgttagctggaagaaagcatccagcatatggtagagaagtaataaatgatagctccctttccaataccattgtgcttcttgtattattaattgagctggagttgacgtgatgtggtggctcatgtctgtaatcctaacactgagatgggaggattgcttgagcccaggggctcgagaccagcctgggtaacacagcgagaccctgtctctacaaaaaatttaaaaattagcatggcatggtggtgcacacctatagtcccagctactcaggagattgtgccaggagggttgctcaagcccaggagttcaaggttacagtgagctatgatcacgccactgtactccagcctaggtgacagagcaagactctgtctctaaaaaaaaaaaaaaaaagtaaagaaaaataatctagaattgggagaattgggagatgggcttaatgatcctcagaatatctaacttcagatttaggtggaacttacttctctggagtttgttttgtgtttgttttactttgaatggcaaagtgtaatcattgatacttaattggtgaaaatacaaattagtctgaggaatatttaaatacaagtttactacaattaaagtgatgtgcttacattcacatagctcacaagtgattatggtgctagtctggaatgactaaatgcattctaattataattgtgctttgcattctctcttcacatggaggttatattggagaacttttaaagggacagcctagtgaagtcaaaagggcctggatagaaagtcatgaatcttgggctgtagggttggctctatcactaattcgctgtgatacaaacgtttcccttatttgggcctcagtttctcatctgtacaatgcctaacttgtttctcaaatctggttatctctcagaaaatttatctctggcatttatttgtgcattccatctctctttctctcccatttctgttcctagtattgggatttcagacaatccttttctgtaaaaaggagagaaatgcctcacctgagtatgatcagctgctggcatatgtgaggaggtagggctagctggcagggggatcatctcttccttgacaggctttttactgtctctaagacaaaagggaggaagtgtccatagaacacataggcttttgggccctttgctttagacagcagtatcattctgggtagcagctattagagagggaagcggttagtcagtgcagattttacagaccagctgggagccagaggctcctttgacatttacctatactccttccaagagccctgattctactaattccccatcccaaaccagatgacgccatcctctaccctcaacactgggggctttgtatatgtgcattgcagggggatggctgtggaggatgaggaaggcatgatttggagcctagtgggggcagaaaaattcttgaacaaagaggtttattaacttcaaaaaacctcaatgcctggtagttttttgttagtgttggtttggtttgtgtgctgtgggtgtggatttgagggaagtccagatagtagggaaccccagatagtagggaaccctgggcagattggtatgctagttctgaatgctactgcttccaaaacaaagcctttgggagacttggaaaccaagaagtccatgacttctcatcattgttatcttgagaagtatcatttattgagcacatactatggcctattcctggctaggcgctttaatcctcacaatgctcctgcctctgtgaggtgaaagaacatactctaggtcatgtagttagtaagttgtgatatggaattttgaatacaactctgatcacaaaactatacttttcctgcactgcactactctgtttggggtgattgggagtattcaacttagagaagactcaaggaagatatgctttctgtcttcagacctctgaaggactatcataagaaggaggggggcagtcacattctgtgagtcagagggacagaggtggaccccacaggtgagaaaatacagggaaaaagatttgaactcaaggaattgagcatttggccctcttgaggccaaggcaggtcaggtcaggaatcagtagagttatgtgttcataggcatttgggggatgtgagctcttctctctctaacttgatgaggcataagggaggaagtccgttctgtctggctcttgggacccatcattcaaggaggccctcctggtagagcctgggcctgggaggaaggagctagactccttggcaggaattggcaaaagctttatggccatcctggaacgcagcagtcatctggccaatgaccagagaggaagccaaccagagaggaagtactccttggcaccagcaataaataataggcaacaatgggatgccatagcttgaggaagtctagggcctggtgggaaagggaagtaggactcatagtttgtctcatttacctctcttcttgtgagtgtgctacagctagaggggagagagaacatgttttgctatagtgattttgtcacttgcttcaacttctaaagcttttgatcttggattacctaggtgccactaaagggctgtgctcaaggacagaggtgaaatctcaaagcatcgattcattcatctatttactgattcatttaatattgactgaaggtctacactgtcgaacaccatctctgttcttcaggaacttggagttccttacctataaaagcatagaaaggcacatgcaactctctacccacaaagaaagaaataaacgcccttgaggtcaggttccatggggtgatatataaagcataggatttagaaccagccctgagttcaaattctgtcctgttacttcgctgtgtgaccttggatggctcatttagcctctcagtactttcctttcctttgtaaaatgataatcatgctaatctcagattttgtgatttaatcctcaaataagtaaaatgcctggtgcataccaagcattctaatattggtggttcttattaaggactaaagtaggtggcattgccctgagagttcagatgagggagctatgaaatcaggaagttcttctggctcagtaaagtacttaggacttgaatactctgcaataaggacagtaaacctttttttttttcattttataaaataactaacatatattatagtaggaggatctccatcttacagatgaggaactgaggcttacagaggtgaaattatctgtttaaggtcatatagctaggaagtggtatagctggggcttaaaccagggcacatagcatttccagtttttctaatgcttttgatcaactgtcctctggaaccttcttccactttacctgcttccaaaacttagaaccctagctaggttgggcatggtggctcatgcctgtaatcctagtgctttgggagtccaaggtgagaggatcacttgaggctaggagcttcagaccagcctgggcaacatagcgagaccccatctctacaaaaacttaaaaattagctgggcatggtggtgcatgcctgtagtcctagctacttgggtggctggggctggagaatcacttgagtccaggagttcaaggttacagtgagctatgattgcaccactgcactccagcttggttaacagcaagaccctatctctaaacaaacaaacaaaaaacgataaaagaaagaaacttagaacctcagctgagtatgttctctgttatagagcaggtgaccacttgaccacaggcaatgtgtaataacagaaacagcaatagtggtagcccatcttggtgctttccagtggtgcaataatttgctttcaggtgggtggctgatgcagatgctgccaaatctgtaatggtatcttgggggtctcaggtgtttgggcattgatgcagttttgcacattgtttctcacacagttcttctcttgtggctccagcattactccctcattctcctctaggcgtgcacgctcgtgtgtgtgtgtgtgtgtgtgtgtgtgtgtgtgtgtgtttggagacaaggtctcgctccgtcacccaggctggagtgcagtggtgtgatctcactgcaaccttcgcaccccacagtctcaagtgatcctcccacttcagccttccaagtagctgggaccacaggtgcccacaccagctatctttttgtatttttagtagagatggggtctcaccatgttgcctgggctggtctcgaactcctgagctcaaaagatctgccccgccccagcctcccaaaatgctgggattacaggatgagccactgcgcccggccatgctctgggcttttgaagtggctgatgacatcactagtttgtttactcagataaatgcatgggggattcaagaagagaatttctgggcttttgaagtggctgatgacatcactagtttgtttactcagataaatgcatgggggattcaagaagagaatctctgggctcctaagctgacctgatctccgctcccctctacagacctcagatgtaggttgcctccacatgtcaaaaggaggtaaagggtttttttttcttgcttccagaagctcctgataattaacgaggatgtactccaaggcagatcttttcttttcactgcacctcagttttccattttatgttgcttgaaccctgtaactctccacagtcatggagctgagtagaatacacaacctccagtttcttaagctagtgtcttaaaaactgaagtcctactttctttaggtgtatggggcaggttccaggagggatacaaagctgtgagatgaatgtggtttagtattctagagcattaattttacttgcaataattttaaaaattcattatttatggagtagaatataaaatttgcacaaataattaaacctgaggcttcaaagaaattatagctgggttacagccatctacctattatctccccctaccccatcctaccacaccccctatgtcccttgggtatatgcattcattattttctgctgcttaaggattttttccatgggagctttgagaaatactggctcagatccgataagctggctgtcgggtcaaagggagccaataaagaattttctttttcctcagggataggaccatttctcagagtggaatgataaggaccctagtcactggagccacagaggttattcctggaactggaagctagatgctaagctctcacttgaaaataaggtttctctttcctctggaatggaggtctcaactggaagcaaagctggaagcaagaaaaacttggcttggaaaaggggtttagagttgcctgataaaatggttcacagcacccccatgggccttagagatttccttgtagcctggggtcaggagtcatccatttttgttctttgttctttttcagtttcaattctgatttcagaccatatttccttcccgccacgtcctcaatttctcactttgagacttcagtgcaggctgagagatattactcatctctttaagccctagagcctaaggaagtggaacatttatgtttctgatttctttatgttcacaaaggaagagacagtgctcagagagatcaccctccctccccccagcactgagcctgaattctctctttttttttttttgacatcactttaggtattactttgcccaacttctcctgagttactctggatctcagaactactttagtcaccatgatccttctctctctctctctcttttttttttttttgagacagagtttcactcttgttgcccaggctggagtgcaatggcgcgatctcggctcactgcaacctctgcttcctgggttcaagcgattctcctgcctcagtctcccaagtagctgggattacaggcatgtgccaccacacccagctaattttctatttttagtagagacggggtttcaccatgttggtcaggctggtcttgaactcctgacctcaggtgatccacctgtcttggcctcccaaagtgctggcattataggcatgagccaccacacctggctaatcctccttctcttatcacacccctactcccacccaatagtgaaacagacaacgtggtgcaaaaagaggctaacggtctcactcctgggatttctgggactggctgcatagtctgtgcctacctcacttcctttcagtcttggagtctcttagcctctacaattagtctgttagtacaggcaaagaccagttgctgcttgtctgagtccattttatgtttgttttgttttgtttttgtttgtttgtttgtttgtttgtttttgacagtgtcttgttctgtcacccatactggagtgcagtggtgcaatctcagctcactgcatcctccacctcccaggttcaagctattcttctgcctcagcctcccgagtagctgggactataggcacgcaccaccatgcccggctaatttttttgtatttttagtagagaccaggtttcaccatgttagtcaggatggtctcgatctcctgacctcatgatctgcccatctcagcctcccaaagtgctgggattataagcgtgagccaacacgcccagcccattttatgttcttataataaaatacctggagctagttactttatacagaaaagaggcttatttgtctcctaattgtagtggctgtaaagtccaagagcatggcaccagcacctgctcagcctctggtgagggcctttgtgctgtttcataatgtgacaaaaggtcaagtaattcacagggacaggggtccccatgactgaaacacctctcattacatactacctcttaatgattctacctcccagcactgccacaccggcaatgaagcatcaacatgagttttggtggggacaaaccacatccaaaccatagcactgctctactacttctgttccaagtctgttctccccccatgacctaatatcctggccctcatggtccatcttcttctcttcagcatcttcagtgggtcttctctctctctctctttttttttctctctctctcagctggattgtttcttggatcttgccttttcccaccaattgcatctggacacactattcttctgcaaccctgtggaaaatgattagaactgttaattgggccttgggccctgtttagatctaggatgatatacaaggtgctttaaaaaaatcttttctgttcacgcccacccactaccttcatcctctgcaaaaagccaatattacatttcaacataagcattcacatttctccatctgaaactttctggcagttccagctgcctattgacttagagtcagggaatcaactggccattgaattctggaagccttttgaactttcctcattacctcccacccccactgatcttttctaaacatgtttctaattatccacatcagcaagaggtagctgggaaatgggattgtttttattaaccatttgcaaaataaccttgtaatgtaattagtacaatgatagaacttaagagaaaaaagagatcattgaagccatactccccaatttggatagataaggaaggcgaggcccagagaggaaatatgctaccttgatatcatacagctagttggagacagacatgaacattttgctcaggtttcctgatacttgatccaagctatgaaggggaagggtgacctggtgagcaatgaaggtcgatgacttgggggacatggcttctccccaaagtggttgtcgcttgggtctagtgggaatgccaggaagcatatctcgatgcagaagtgatcaaagtttattacctggatgggaaatttgggccaaaggagagacaaggcaattaatcacttgagaagctcaggagtcgtaagctcatatgagtacttggcattaggacatagcatgctagagaagaaaaggtacaagctctatagtcagacacatcatggttctatatggctctgtaattttagatgcattacctctctaagccttagttcctcatctataatatgggtataattgctatctcacagggttgtttactgttcagcgcctgacacatgattggtgcttaataaatatgagctacttttttctttggggtctctgaagctctagattgtaaactctgggtgtgactgtggggcctgactttggatgcataatagaaactttgtggatacagtgttagtgtgtgtatgtgtgtctttgtgagtgagtgtgtgtgtgcatgtgtgtgtgtgtattttgaagggagatattaatttgttcataagggaaggacatcagcaaaactgggtccttgttccctgcttccatctccaggtatatttctatgattctttctcaccttacccttaccctccacttgcatccttctcccaaaaaacaaaataaaaaagactgcctaaggccagcctgacctcattaggatgtggctcagcttcactgctgccatcgacagtggtgggtatgctggggttgagctgagggccagactattaacatgctaatgtcagggactagagaacagagctcatctgtgttctcttggcaagcctccttttcctgcccactgttcagccaggaggctcaggacaacagggggcacctcagctgctacactgaggtacttaccctatttctaccctcatttccaccctaaacctgtgtaagaggaatcatgacttggctctgatcagggttggaaaaaatcctctcagaacccaggcacagcatggcttcagagtccttcacaatccccgttttatcttctcaaacattctttatttggggtattgtaaatggaactcagtcttaagggtgtgggtattacccccagttgctaaggatgaaggacaatatatgggagtggcccaagagaacaagatacaggagttaatccaacaatctccaccttcagcctttaatccatcatggaagtgggaagtggtgtgacattgtagagggaaggaggaggtggcagaaatcactggatatgcatggatttggagtcaaacagacctggtttgaaccctaattctgtcactcacaacctgaaacttgggcaagttatttcatttatttgaacctcatttttgatatctataaaatgggcctaattgtaagtctagcataggggtattatgaaaattaaaggagatgatggatgtaaggttcttggtatgtgtcagtgctcataagtaatagatccctttcctgcctcagcagtactttgtgcagagagatgccgacatcagttcttgattgctgctcaagtatattttcttgccagatgctgagcaccttaaaccctttaagggcagatataatattgacttcaaactttgtgtcctctgtgcctcacacagaggaagtattcaatcaatggttggttgttttggttttctcttctaggtggtgaaaactattggcttgagggaagtttggttctttggtctgcagtaccaggacactaaaggtttctccacctggctgaaactcaataagaaggtaactgcttattcctctgttggatttagaattcttttcttttccagaacattcctgggagggtaccatgtgctagttggcaaatcctggatacctagggctgtgtttgtgactgggtggtctgttgaccacttggatcagaataaggaccgaggacacaagcaaggcaaagctcttgctctgtctctactttgacttctaacagcgacaatggccagcattcaaagaagaagagactcttttctttctaatgggaacactagcttgaactttgacttgttttggatcaaatccattagtggcttttcaagagaggattggtatccccttcatctctccaaactcaatggctttaggggatttgtgttttttttgtttgtttgtttttgttttgttttgtttttgacggagtctcgcactctcgcccaggctggagtgcagtggtgccatctcggctcactgcaagctccgcctcctgggttcacgccattctcctgcttcagcctctcgagtagctgggattacaggtgcctgccaccacgcccggctaattttttgtatttttagtagagacggggtttcaccgttttagccaggatggtctcgatctcctgaccttgtgatccgcccgcctcggcctcccaaagtgctgggattacaggcatgagctactgagcttggctggggatttgttaaaaagagccacagattcttgaactagaaaaaaaaaaatctgaaagatcttacagtcttatgctgcaccttctccagcagtcaactaatgtctgaaccccatatagatgtttccctctttcttgatcttttacctcagttggaccccaaatgggatggtttgagtccatgcaagctctccaccccaagcagcatcttcacgggaacctggcagccttccatcttcgtatcctcaaactggctggccttgtccttagaagtctccatactgtcctgcagtttgcttctctgattgtgtctagggagtaggtaccccaccttctgctggtagagtcttgttttcctaaagagttgagtcttttgctggacaagtgtggagccactagtattccatttcaggctttaaaaaatggtctaatttgtgctcttgtttagccagttctcagtcctcagacatatatcctagtccttactttgctaatttatgaagttggaggagacttataagacgagcttaaaagaagagcttatgcctactatcagaatttggggatagttggatatagtcagataaaagtggtttgaagatttctgatcatcagtcggtattaaggtaatttcaggaagaaattcccaacagaaagtgattacagacatgggattcagtccccagtgaaagtaatgtattatttttcttaattaccaggggagttgccacccagctgtctaagattatgcaaattgatgatctttcagtgttttctccccaccctacagccactccattacccttaaaacctattttttgagagtccataacccttactcttcccaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagaggtgaggtggttccctgccctcctttgccttggccataaggggctgcagcccacagctgaccaatccctgcctcacagggatgccagatctgttcttctccattggggtctgtctgaagactgtgttatgctgctcaagagacatttgcatatagtgtcagactctgttgttgtttttctggctttccaaataaaaagcctttttgttttccctctgtctacctggttacagaactttattaccctggaggcaggtgcttatatagaaccagagattgagtaatttctttcacccatccctggttccattttctcagttctttttactgatttagatctcttatatcagaagttcacaggggagagagagaaataagcaaaccgaggacatggggagctcaaatagtcttttaatattgacagctagtgtacagagctttccccttttgtaaacttcaaagtcaaaagctctaaaacactcattatttttgtttttgtatcacaataacacacaaaatgaacaaagcaggcaatatccttatttcctggcgaaggaaatagaggtgcagaggtactcacactgactttccccatctggtgcagctcatctgaggcagagccagagccagacctggaagcttagcaccttaatattttaacactaagttttttcctactatacccaatggccatttccatagtcttttggattagaaggaaaagctttgcttcattctgggagcctcagtcccattggagttatggcatatatgtacaacacacccataagatattagggatagtgcttgtaccctggggactctacctgagtcattgccatgatatctgagatggcatgtttaaagcaaaccttgtttataatctagtaggtcttggaggttgggcctgttggtttttctgaaagccattaggactcagttcattgctctgtagccaaaggccatcctttcatttctgagcagtattcttataaacatagagtgttggtcctaagaggatctaggagagagtgtacctgactccatgaggtccatccctactgttagcccctaaagtcagcacaaactcctgacacattactgctatgcttagggaccacagcacatcatttgatttgtggatgaaggtacaaaggaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgcacagggactttgtgctttaaactactcatcacccattgtctttccagagtcctggaacagcacaaactcaacaaggaccagtgggaggagcggatccaggtgtggcatgaggaacaccgtggcatgctcaggtaagcttgcccaagcagtggtgggccccacttcccttacagggtgaatgagaatgcgttctagggagaagagactgatgacaagggacattggtggatgttggagaaagagggaacagggacgatagaaggcaaactaggaccattataaggctgttttttgtttgcttgtttgtttgttttgctgaatgctggtaactggtagcccaaacagttttgactatcaagaaatggagggagctcttacacatggcaaagcatttttgagggttgtgtagttgaaggacaaatatcatcattttgccatcaccacattctgagccctgctaagaatgtgcctttataagaggctgtcacaatgaatgagagaaagaaaattgcttctatggcagccaacatgccagaggccagcaagggtcagcccatctttattccccttgggagcttagaccctaggtttttgttaggagattttgctttgcaaaagtcatgctgtgctctgttctccatcatctgcttgccttttgtcccctttcccactcctgatagcaagatccttgtcagaagtacagagtaagcaggctttctatctccttgggtctgactcacaagccccactttgtgacccccaactctgtgtcatttagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacaggtatatctcagatctcttttagtttatttaggtcacgttaacatctagggctcacttttcaccaaggagcagggccatatctcttgggtcccatctcagttctttttctacctaatttagtccagcccagatgatttcacaacttcccttagtcaatactaaatcctgtattgactagactcacactgtcaactatggtagccaccagccacatggggctattgaacacttgaaatgtggctactttgaattgagatgtgctgctgtaagtgtaaactacacactggactttgaagacttagtgtgaaaaacagaacgtaaaatgtcttaatattttaaaaaatatttatttacatgtttaaatgataatattttagatatattgggttaactaaacttactataattttattacatccatttctttttacttattttcatgtggctactagaaaacttaaaattatatatgtgacagtcattatgtttttattggatcgtgcaggcctagactatcttatcagcatttgtaattagtctcctgtgatggttaagtggcttttggcctataatcctctcactgtagccttatcccacttgcttatatttttcacttggtgtgctcttggtgaggatggagagcaataaattattgttccatataactcctgaatcttggagttcattatttactttctctcaaacttttgtaagcttggatagaagagactcagttaaatagggctggggattcccttgaggaactgttacaagttccatgcctcaaacaaatacataacaaaacaaacttgagacaaggaatcatatgttagttgtactatcaggagatctttagtgaactctcaatgctggcagctgacctggtggcgtgtgatgacactggctgagctgtcactgagtctacctcctccagagagaagtgtttgtttggccaggctcagtggctcacgcctgtaatcccagcactttgggaggctgaggagggaagattgctcaagcccaagagttcaagaccaacctgggtaacatagtgagacctcgtctctatttattttaaaaaaaaaaaaagagagagagagacatagaagcttggaggtgacagtgagggcaagcccccagttctctacacccttcttgtcttgcccttgtcctgatgttattggtttctatttctacagactaactcccaagataggcttcccctggagtgaaatcaggaacatctctttcaatgataagaaatttgtcatcaagcccattgacaaaaaagccccggtgagtgattcctccctctgaccaagacaggtacttgccaaggcctgcataatgagcaatcatgctattctatttttctcttccttttctgatgtgtttgtgtgtacgtgtgtgcgcgcatgtgcacgaacaggaagcacaaatagagattgggaatggagggggatgttgatgccaagaaatggccagcagacatcctgtacctggttctactctgctacctgtctctctcactgtggatgtgggagagccacaggcagtgttaagaactgcttcttagccattgcctctgctgccctgaggttctggggtggaaaccgaatgcatctcatatttccaagcccctgggtcccagaaagtggacactgttcacatatttgattccttccttccttcctctctctctctctctctttcttttttttgatggagtctcgctctgttgcccaggctggagtgcagtggtgcaatcttggctcactacaacctcagcctcccgagtagctgggattacaggcgcatgccaccatgcctggctaatttttgtagttttagtagagacagggcttcaacatgttggccgggctggtcttgaactcctgacctcaggtgatttgcctgccttggcctcccaaagtgctgggattataggcgtgagccaccatgcccagcccttgacttcttttttttttattgtggagaaagggctgtggccaaagtccaaatctgaagatgatcctacagacttcttggtagaactttactgctgccctctcagacttttctccagagcaatccaagaccaaaaaagtgctttaagttcattcatttctctaacacactcgccatgcttcttacccactcagtagcctgcagctgacaagaccagacagctggtgattgtgggtaggttaggaaactgagctgagtgtccccttttctgggatactgcatgtccaacaaggcccagtgacaatgctgagcctgacccttttcatgaaggctcagtgattcttctccagccatgaggtgcctgaacttcccctgctagggactttacacatgttgtctccttaaaccctcagcaacatggtcaggtaggtactaagtagcatactaattttatggctgacaaaactgaggttagagagatggagtgatttgcccaagatcacacagctaaaaatggtagagctgggatttatacctgcaccccaagctatatgagacagtagcagtgtgtggtcagtggcagaggagatggtggtgcccatcagctggtgacttcggtccagtggtatttgtagtaacaaactcaaactcactggattttcttgtgtgttttcttttattgctgctgtgctcaactattatcagaaaaagttaagtaacaaagccagctgagatcaagggctcattttaaaaacaacaaccaggacaagcagtgatcaggagatttatgtattcatgtatgtatttacagcctgccttgttccaaaaaggatttaaggggctgggtctaggatttgcttttaggagattgtagaaacagtccagccacccatactgcacccaccagggtattattcaggggtcatttggcttccaaaagaggtcacctgagacctagcatgttccctaattagcagagaaagtttgaatccttcaacttgattaagagtaatttaggatgctttcacaagcaaagattgaaagaaattgtggtttcataagcaaagattgaaagaaattatgggaagaacatgggtttcagagtcaagaaacctgggtttctagtcttgggtctgtctactgtctaaccctgggcaagtcactttaccactctgataattagtcttcccatctgtagtgcaggaggtcagattaaatattctttccagtgcttttggatttagcttttcagaaggcagaagatcaccttcacctgtccctccaaattctttctgattgctgatttcccaccaggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcggtaggtgctgcacactgatgtggggggccagggctggggcaaggaagcttctcaaaggtgccctgcatgctaagtcaggacatgaggccaacctaggacttcatagatgagaggttagacaccaatattcacatttattcagaaaaaatctaccaagtttgaggggcagtttttacagagctggatctagcaggaaactgccctgtaggacctcacagtctactcagtctagtagcagagagagggaaaacaatatatacataactcaaggtacaaaggccatgtcattcattcacttaataaatatttattgagcaatgaataagaaaagaccaaaaatctctgcttttgtgaagctagcattctagtggggaggagacgaacataataaataagcaaattatgtggtacataagatggttaagaagtgctatggagacaaaaacatagaagagggatggggagaagggtaagccaagtattctgagggcccagatggagaatacctagccaagggagataagaaggttcctggaagaggtgctagggcaagaaaaagcaaaagcaaatacttattccagatttgtaacagactctgggaaaaagaagcctagagctgggctttagggcaggcagtgttagacctgaggactgatgcactagccgtagagattactagacttgaagcacttcatcccagcacagagccaaaacttgtctccctaacaaggtggatagggcaggtcttattggaccattttcaagataggggaacaagagcaaagcagtgacatagctaaggtcacccagtgggttggtgggagagctaggattcctgactcaggggtacattgacagggccccgtgtacactggcctatgtggggctatgatatgaggacaagggtatagaggtaagggagggtggcccaaactcacaatccctaagtgtgttgggaaggttgggttgagagacccagaggcagcaagccttggaattccccaggcttttttttttttttttagatggagtcttgctcttttgcccacgctggagtgcagtggcgcaatctcagctcactgcaacctccgcctcctgtcttcaagcaattctcctgcctcagcctcctgagtagctaggactacaggcgcatgccactatgcccagccaattttttttgtatttttagtagagacggggtttcactgtgttagccaggatggtctcgatctcctgacctcgtgatctgcccacctcggcctcccaaagtgctgggattacaggtgtgagccaccgcgcctggcctccccaggcttttgtggagcgttgttatcctgttctatccattttatctccttccctagtgctatgctggaaaatgagaagaagaagcgtgaaatggcagagaaggagaaagagaagattgaacgggagaaggaggagctgatggagaggctgaagcagatcgaggaacagactaagaaggctcagcaaggtgaggcttggagtcaccttggagattggatttttccaggcctaactctgagctggagaaccttctgcctgagctgtagactcagacaatgtagttcaggtgtggctacagactagaagaagaatgggcaagaagagagctcagaactttctgccagctttgtcttggggtggatcatttccaggaacgaagctattgtgtcgtctttatctctgtgctcttcactgccttctcccctccttttctgctcagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggtaaagctgtagggtgggctgggattatgggaactgaactttcttccttgtctgcctacttacttatagctacttttgcttacatgctggctttttagagcaggctaccactccatgggcctccagcaaataactagttcagaagcaagctgagaagtcactagtgtggcccagaaatttttgcagtcttccctaacccttagtttctgttcactttcttaactcttgggtatctgagctgattgacctggcaaaggaaagggaaggagaaaagaacaaaagggactcatatttgagctcctgctgtatgttgctgtgttgggaatatttcccttttccttacttatttcttcttcccagtaaccctatgggattaacctcatatgagataatatcccagataaggaaattagagctcagggaagagattcaccaaagatcacacaattgtagctaaataaggattagaacccacccatttctgcctctgtttgaaagctttgctccctgaaatcacatgcaaaactatgtgtctatgcatttttggggcatttggcatccatactttcatcacagtttccaagggttctgtgactcagaagttaagaacctgtggtccaaactccttgacatatactcttcctttgtactgttggaggtgggaatagagggaaccaagacctgtctctcatgaggaagctgtcatgggagatttacccaaggtgtgcataagcttttttccttgttcagatagctttgtgacacttgagtgtctttcctgtacttgtcctgggaagactcttagtcgaatcctgagcattctaggatatcaggaaaggatctgccacttcaggaagtgacccaatgatggccaaagctttactgaggcccccagctgcatacttgccaagaggggcagggggagagataatgaggaagggacagagatggcatattgtttgtcttcaagaggcctacagtctaggtgggggagctctgacttaaaaggaagtggtggtcagggaagatgggactggaatgaagtagtctggtaaaagagtctctgaggcagcaagcaagtggagcagtaggtcccttactagtcccccaggggacttgggttgaagacacctgggtcctgaggaccagaaggcccagctctcacaggcttccaatttatccgtaggccttggaaatggcagagctgacagctcgaatctcccagctggagatggcccgacagaagaaggagagtgaggctgtggagtggcagcagaaggtaagacacagggcctaaagcaaagcattgaaggaatgggtgccatatgcataggtaacagctccttagattccttatgttttggctccctccctctttcatacttcccacagcaggcagcatgggagaaggcactcatggtttcgtcaaatacttactggagttctctaatacctctaggaagttggtacaattgctcttgttttatggatgaagaaactaaggatcaggcagatgaagtgccttgtcctacctggtgcctgcctcttgccagaccgttctaggcatatacaggatgccacagtttaactggtctcactgacagtctttctctccttctgtcactggacaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggtatacaagtagggccaaggggcaaggaaactatatgcattgatttagtagcccatggcattccctagaccatcatgggggataggtataagatcctgtcccagtgttgtatgggagcccaagccgttcttaagtgacagctttaaggataggcacctctcacttattaatcagaccttgggctatctcttccctttttgagattttctctctgccccacctcccactcactccattcacctcttacattaagaaaatatctagctgacaaaattcccacctgaatcttttgtatgttgttctactcttaaaggatacccattatcaactggtcccctaagtttatttatttttttttaatattcttgccccactgcagttctaacagagttggaaatgactctcaatatttatatatagagagaaagggtgaggaagaaagaaggaaacagaagagaagggaagtctggtcaaataacaggaggtaaaatgagagaaagccattgacctctgtgttcccatacatcctcacaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttc

SEQ ID NO: 35604 - DNA, 82844 bp, Homo sapiens
agaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaaggtgcgcggcccgcgggccggacgggctggaggggcttttctgagggggcccggggaggggtgggaggtcctgaaaggtaactggagcgtctgtgatgggaacgggggggtcccgagaaggaattggcgggtccgggaagggaattggagtcctgaggaggaatcgccgagctagaggaaggaattgggaatctgaaaagagaattggcggctgggtggggaatatgggagtcaaataaaaggaatcgggaaggctgatgaaggatttggagggtctgggcgtgccattaggggaaaccgaggagatgactgggcaggctgaaatggaactgggatccgaggcgggcttgaagggtcggagcatgggttgggggtgctgggaggagaatcaggggaggctgagaagggaatttctgggtctgggaagtgtgaggaggagcttgagtgtggaggggttggttatttggagagcagaaagatctgaaggagattggaattgggggagcctcaggttgggggagttataaaggggatgaagaatcaagtgtgaggatggagtggagattgtggggtctgaagacgggtgggaagactagggaggctgggaagatgaaaacaggggctaagggtagaattgagcatgaaaagacatgggcttagggtgtgaggagggtagaggtgccaggactgggggtctgaggagggtggggtgcggaaggaagaagttaaggggcccgtgaatcagacgtttttgaagggggtgagatttatttgtggtgccctgttccaaaggggagaagattaagagataggaggaataataagaggaattgatgagggatggagaagccgaagtagaggggatacggagagtggggataatttggggagggatttctaaagaattgatgggaagctgaaaagctaaagcgttggagagaatgaggaagtgtagagggagaaggtgagatcggtgggagggagggtgagctggaatggtggataatgggagagaggttcgtttaggaaaatgaaagtctcattagaaagggaatgcgtaatggatagactgagaaaggaatttgaggagggggtgctggctcctggaggtgcagtcccgggactggagagcgtgtgtgtgtcgtgcaggcagaatgagtttggggaggaagcgttgagagtgtccaggaagaattgtgtcttttttggagagaccggaggtaggtgaagggatcctgaagcagagactgtgttcaggtggcactgtttttttggggggcggggggggcaacttggtagggccccacagcagtgaaaaggtgatcagaagtggagtgggatccccgagcgaggtgtcagtgtctgtgggggggggataaatccagtgtggttgaggggggagctctgagtgtgtgcaggaagagctaaagaaaggagcgtggtgagtgggtgtgtgtggggggaaggggttgttcagaagttttgtgcgtgaaatgggtgggaggtacttgaagttggaagcatttcgtgggatctggagatctggattttctttccagatttgttactgattcgctctgtggccttggacaagacccttgaactctccgggcagttttgttatctgcaaaatgcaaagggatccgagggttccctgcggtgattctgttaataaagagggatgtgtgtagagttgggactttggacagggctctgaaggtttgggagagtgagtttggtggagatttttcaggaacaggctacagggctttgagtggtgacctggcagagtggggagtgactggaagcctctcgagggcgcgagttggtggccaggagcttggcacaggcagcctagcccaggctggaggggaaagggtgggaagggtggaaggagcagctgttccaaggcagcctgaggtggggccgggcataaccttgggtccattaccagcgttgcttgaatttcctcatccgtagtaactgaggggcatggcagtggcttggtgggaggggtgtccttatccgtggccccacctactgcaggatggacaggttgcgatagttggcataaattcactttttgaggggaaggtgagatctgttctggagtctcaacaataatttattgcctgaggcagtgccaggttggaaaaggttgccaagagacctggaaagttgggagggagcaggggccacagtggtggttttgagaatgtctaggctttgtcttctgcagctgaaggtgctggagaaaataaacccctcccccttttttctcaggtgataagggtggggggaccttccttttctctcccttcctgtcttctgccactcctcaagtgactccttttgcgagccgggtttcactccctcccgagagttagggtgtgggctttgttcgtggttatagtgtcccttgcctacagggtgaggctggggcaccattcaggccctgggtggaaaccaggactccccagaacctccaggccttgctgccatgtgtcattctcttacctcccagctcccttcctctggggccgggcaggtttgagggaaaagggtggctcacagagtccgctaataccatctgctttcgtgtctcagccagagccagattctagtacctcctgctttacacctcctccagcaaatatttacccttagctgctctgtgggggaaactactgcttcacctctgtgccctttcctgttatggggtagggattctttttgaaatgggggaaggagtaatggaaaggaatacaccaatctgtgtggctctctaccttcctactaagaaacatccctgcactcccaggctggctgggttgtttgtttgtttgtttgtttgtttttggagacggagttttgctcttgttgcccgggcgtgatcttggctcaccgcaacctccgtctcccgggttcaagcgattctcctgcctcagcctcccgagtagctgggaatacgggcatgcgccaccacgcctggctttttgtatttttagtagagacggggtttctccatgttggtcgggctggtctcaaactcccgaccccaggagatccgcccgcctcggtctcccaaagtgctgggattacaggagtgagccactgcacccagactggctgggttttttctacattgcagtgttgctttagtgaatgacagattgcccttcttgcctctccaaggctgagccactgggcacgggaagaatgacagtcctgggggttctgtacatgcatactccaaaaaaatatgcatccagaacagctgtaggccctcaaagtgggtagaattgaattcttctaggaattaagcaagagttggcccaaatcagaggggacgtgtgtctcacttctgcttggaagccctttgctctgacttctagggacccctgtaacccgtaagtaggttatgcaacggtttttacatgagagggccatgagtgttctcctggcgggatggagaagcattgttctggtctttgagcaaattcttgagcaattacagttctgggccacagttccctctcccaatttctaaaagtggcctgggtaacctcatcaccctctgttgtcctggaagggtgagatctcttgaaggttatgccaaatctcattacagcaagaagaaatgactcacttgctaagttttcgtgttcattgaaacatcactatttcaggggcctcaatgtttcaaccctgaccgttggctttttttttggagacggagttttgctcttgttgcccatgtggctgtattaggtatgagttaactatttgaaagtttttgtttgttttttgtatttgttttttttgttttgttttgttttgttttttttgagacagagcctcactctgtcaccaggctggagtgcagtggtgtgatcttggctcaccacaacctcttccaggttcaaggaattctcctgcctcagcctcctgagtagctgggactacaggcgtgtgctaccgtgcctggctaatttttgtgtttttagtagagacagagagtttcaccatgttggccaggctggtctgaaactcctgaccccaagtgatccgcctgcctcggcctcccaaagtgctgggattacaggcgtgagccactgtgccctgccttgtttttcttgaagtagatctttttttctttttaaaggctgataatggaggccccaaagtagccatctgttactttgttccattactctaattgcttgcctcttaggatctggctaggactaacagttttcaaaattgagtaacacacttgacaaaaaaaaaggaaccaaactcaaactcaactgttatctagaaaaaagactgtgtaaatatgtgtgagaggcaagtatactctgtttgccctcttgtaagagggataggggaggccactcagctgctagcactctgttctctcccctcatcctctccagaatgtattttagaacttgactcttctaatgactgaagaaaaggtggggtatgggaagatggcctgggactgcagggtcacttacactcacctggctaagagttgagatctggctggtgccctggagtggcacctgccactcacctaatcctaaacaatccagggtgtgggcccaggattgccctctgccttttgaaacaccctccctggttccggcttctaagaccaacagggaggctactttggtggcagggagctgactcaccctccagttggaactggtgctaaaagcctccatttaacggcagccgactgcttggccccaagtgggctgccttgtgggggggaaagttcagtggaaagtgttggaggaagcagggtggtgtgtgaatatccaagtagtgctggtgctattaagctctgacacagtcagggaggtcagttaaaatgtggtcttatggccgggcgcagtggctcgcgcctgtaatcccagcactttgggaggctgaggtgggcagatcacctgaggtcaggagttcgagaccagcctggccaacatggtgaaaccccgtctctaccaataatacaaaaattaactgggcatggtggcaggtgcctgtaatcccagctacttgggaggctgaggcaggagaatcgcttgaacctgagaggtggaggttgcagtgagccaagatcgcgctactgcactccagcctgagtgacagaacaagactccatctcaaaaaaaaaaaaaaaaatcagatgacagaggggagcggggacaagttttaagtctaagcctcctgggtggggagttctgctgtttcaacatatgctccagtcatggcagactttggccagacagcgccctttttcagagtgaactgagtgtagcacaagttatctgccagtgctagttagcaaacagaatggagccaaaaaagaattgatttgggaaggcccaaggaatttgaaaccgttgagatgaacactttccgtttttgctacactgatttatgttgtgctgggaattgtacaagcctttgaccagaccttagggttgttctttaaaaaaaaaaaaaaaagattcccttgctgctgcttttacttttttgaagggcagaagggaagggcaaatataattagtgaacagctgtttgctctagtatcacttgctcgttcaggttttctgaatagctgaaatatcaacatgtttatctcttcccttgccttagtatatcctagagcagtgttttccccggctttatctttattccttcatttaatgaactccgtgttttcatcactcacattttgttcccttccctcagtttccttcctttgccttcatttatgtatttagtttacagaataacaaaagcactcgtgttacttttaaacaaggtaaaacttaaacagttttttcctccgtttctttttttatggaaataagaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaaggaaacttagttttacagtgttggcagcctaggcgccagaatttgttataaagtgtctgaaagtggcccaggtatcacttaacttttcttcaagaaggtctatgagttacattttactcggtatcccaggcatcaaggagtgtaactttcaatgaatcaaagagaaacagaatcattttaaattccagcctctgtttaaagaaggatcttatgaaggggagaaattaaccacctgacccagggaaggatcccgcctcctccagaaagtgaaatcgccgggtgtggtggctcacgcctgtaatcccagcactttgggaggtcgaggtaggtggatcacgtgaggtcaggacttcaagaccagcctggcgaacatggtgaaaccccatctctactaaaatgcaaaaaattagccgggcacggtggtgcacccctgtaatcccagctactggggaggctgaggcaggataatcactcaaacctggaaggtggaggttgcagtcagctgagatcacgccactgcactccagcctggacgacagagtaaggctccgtctcaaaaaaaaaaaaaaaagaaaaagaaaaggagttaaatctttgcatatatttaactggcaagagcatccttacatcagtgcatgggaagttttatccaagtagcagtttccctgggattataaaaatccccgaggcatttgtcttggtgttgtgcctttttttggttgtgttttttcacgtccctcccctcccctttctccataaacaagagaggcattaacttggaatgtccgtggaaagtcttagaagctgattggtgtaatttgcctgccttccctttagtttgaacagcgtttactctggaagaggtcagtggcctttttcttggttgtgatttatgcaagtgttatctgaaggcgagtggagtgagtttacgtgggatttgctgtttgccacctgttgttgtgctggctccttccttcctgggatgagttccattctctccccctcccccaggagtgaggctccccagccagagcagtccccctgtgcttatccccttccttcgtaaactgcagccatttgtgattttccataaccacttttatagacacataataatttcctttgaatcagtttgcattttaaattaagttttgaaaggaaaactgacaagagtatggcaactggaaaacccagctcccctggccataaatataatagaaggaaactgcaaaaataaacacattgaaaacaaaacagtgttgtttccaggtggttaccactcgggctgaaggccccccaggcttgaggcctgctccctttgttagaaagggattggcaagtgttggtgaggtgttaaagacccaccagcaccaagcagagactttctctttgaagtcatcaggtttacaagagaatcaaaggaaataactttctcaatgtgattcagggtgtaatgtaaggtgtagataacccttaaaattttccatgtgtgtatgtcacacttgggaaaaaaacttgatctcatctggtcgaggtgggcagggcagcaccttgtccaggagcacacagcccctcttggctctgtgtgtcatccggccatactagactcgaacatatggctcatgactggatgatgcttgattcatcttcagtttcaagtgttagtgcttttgaggttttgtaagaaaccaggacacattgaaaatacagtcatttctcagtatctgtgggggattggttccaggaacccccttatataccaaaatccacagatgctcaagttccttatgtaagataaaacgatgtgtaatttgcattttaactatgcacatcctcctgaatactttaaatcatctctagattacttataacctaatgctaaatgctacgtaaatggttgttacactgtgctgtttaggaaataatgacaaaaatatgtacatgttcagtgcagatgcaaccattcattttttttcttccagtattttcgatccattgttggttgaattcacagatagagaacccatggatacagagggctagctgtaagaaatgtgggtttatcatttgttcctcacacaacttttttctttcttcgtttttcttgcctttgttccttttttttgagacagggtgtcactctttttaccaaggctggagtgcagtggaacaatcttggctcactgaagctttgacctcgggctcaagccatccccccacctcagcttcccaagtagctgggactagaggtgcacaccaccacgcctgactgatttttgtgtttttgtagagatggggttttgctgtgttgcccagtctggtctcagcctcccaaagtcttgggattacaggtgtgagtcaccacgcccagccaactttttctcttaaggctccagttttcttcttagagttgggcccctcccacgaagaaagcacactgccaccccttcatcggatttgaaccctacattttgaaaggaaagcagtgccctcctgctgagttaacaaggcttatttaaatgtttttcttccaaatatcagagcagaacagattctttgtcttccagtggaactatccacatggggcagaagtagttggaagcggcagttactaccctgcagaacacaatgaagtcatcttgggaaatatcgtggatggtgttgcaatgattgaatgggatgctagaacaccagcaatacaatagcatttgtgtcttcagcttcaggcaggaataaagaagactttgtggtttgttttatgttttttaaagtttcccccccaaaggtgtggggctgagtgatgtctgtcactagctttctagtgggtttttcttttcatcttttcccctccctgatgtcttttgagagtgggtggaagccacagtctaggtggatcagaggaagcacagaaggcaggcagtataccccactttgtgttttccatgtctgaagggaacacatttggtttttgttctgttttgattttttagagacagggtttcactgtcacccaggctggagtgcagtggcctaatcataactcactgcagccttgaactcttgggctcaagggatctttcagcctcagcctccctagtagctgggattatgtgtgcaccaccatggccagctaattttaattttttttttttttgagatggagtctcactctgtcacccaggctggagtgcagtagcacgatctcagctcactgcaacctctgcctccccggttcaagtgattctcctgcctcagcttcccaagtagctgggattacaggcgcgcgccacgacgcccagctaatttttgtatttttagtagagacagggtttcaccatgttggccaggctggtcttgagctcctgaccttaagcgatccacccaccttggcccaacaaagtgctggggttacaggcatgagccactgtgcccgaactaatttttaaattttttgtaaagactgggtctcactatgttgcccaggcttttaatctgcaaaaagcccaagataaagagttttaatatcttacctcctgagtagtaatgactgattccagttctaataatgtcttaattacagctatacagattgaggggactgcaggaagtgaaatagatgcatttcttttttctttctttcttttccttttttaaatacacacttcgtttcggtggtgaaggccagtttgaggttaggagaggcatcttggaaggaagctcgcaggtggttcggcatctggacatgctgggaagttgcctgagggggacgtcacaataagaggactgtgggtctacagcctgccttagcaaaatgacaggccttcttttaccaaggccaagggcagtggtggaagctgacttcagttggtgtcatcaaggcctcagtatgtgtaacggttaacaaattactattctatgatcaatctccatctgggtgtgagtaaaaggtatttagttgctatcaccatggaaaccaagttgcttacttactgttttggggagtgccctcataccagaggcagtgctaatggtggagtgttaggccccgggcagaaaaaaagatcctgccacttggtatcacaggaaaatacctacaggcacagcagccttgccaggtaggggatgaaggccctctgtcctcggggcaggagttgggccagttgattgtgttgatgaggagtgtgcatttgtgcatgagagagggagaagaaaaaggagagcactccatgaaatccgctgctggctttgtagcctagaagagtgctttttttctctaggagtttggaactggaatctcagctatgtgacttcttaataataggacaaaatatgcctgtatcttttgcctacttccacaaacactgataaattaaaaagaactctaaatttcccacaaatcccaagcacaagtaactttttttttaaatccacatcctccctaatccaaatctaacagcaaatccttttctctctgtcactccctgcttttctttaagaaaatgagtaccttgccttaaactatatattggatgaaaatattaaacactttcacaaagtgcttctttggctgttactggtatgccttgcatttggaagggtcagagatttgaagacttctgtgatcttccagttctggcctatgaaatacagtcagtttcaaaattcaaaatgtctggaagagccaacttgccaggccggttcaagggcagtcagatgaatcgacccttcttacaggctgtctacgaaccagtcatgattcagatattcaagtcctggaaggtatccagacggtaaacatcaccaggattgtgaggcagttacttttttttttggatcgtttgagctacactgccaagactgtggtaggacttgtctgtgtaaaacagaaagggctgtctctaaatgtctttttcaagaatgtcggctataatcacccgacactgtgtctcatggtggggtgagatgaaatacctagaccggttaggggagggccttcttggccattttttgaactaattttccctttccctttgtaacttttttttcttcttttcttttctttttttttttttgagacggagtcttactctgtcacccaggctggagtgtagtggtgcaatctcggctcattgcaacctccgcatcctgggttcaagtgattctcctgccttaggctcccgagtagctgggactacaggcatgcattccacgcccagctagttttggtattttttaggagagacggagtttcaccatgttggccaggctggtcttgaacccttgacctcgtaatgcccacctaggcctcccaaagtgctgggattacaggtatgagccaccgcgcccagcccctttgtaactttcattaacactgatgaggcacaagccataggatagaattgaatccattgagagctgtgagccaattgagggatgattggttaatagattgtggcttgaagctgtggaaggtaaggggtgacacttgactcctattagccttgtagaaacacctcagagattcacaggaagcaaactttgaccataaaaatataagactcacagcgcaccgagttctcttagcagctaccttagagttgagaaagttttgggcctctttaataaacaagcacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattggttgtggctaccaaggaaatcagatgatcaaatgcaaaacttcctccatcttatttctatatgatcttttttttttttttttgagttggagtcttgctctgttgcccaggctggagtgcagtggcaggatctcagctcactgcagcctctgtctcccagattcaagctattattctcctgcctcagccttccaaatagctgggactacaggcgtggccatcatgtccggctaatttttgtatttttagtagagacagggttttgccatgttggccaggctggtctccaactcctgacctcaggtcatccacccgctttggcctcccagagtgctgggattacaggcatgggccaccgcccccagccttatttctacacgttcttgatctatcacaggctggtgggggagacagcatgcatatagataatgaacaaggtaacttcagataggattatgtgcaataaattaaataacagctagcattttaccttgtgctagacactattctaagtgcttcccatggactgactggtttttgtttttttttctttcctttgagactgagtttcgctcttgttgcccaggctggagtgcaatggcgtgttcttggctcactgcaacctccgtctcctgggttcaagcaattctcctgcctcagcctcccgagtagctgggattacaggcacgtgccaccatgcctggctaatttttgtatttttagtagagacggggtttctccttgttggtcaggctggccttgaactcccaacctcaggtgacccacccgcctcagccaccccaagtgctgggattacaggcgcgagccaccatgcccgacccatggactcacttgtataatcttgtgaagcaggtgttgttacccttacatgcagaaatggatccatgggcctttaagccacttgcccctgtgacagtgccaggatttgaatgtagaagttgaggctttcaagtttatgctgttatttctacactacactgaagtctagtgattgggaatggctttgcgagcgggtggtgaggggaggagtgtgcagtgcaggtacttcagatggagaggaaggtctcaaagaggtggcatttcagctgttccttaacggatgagaaagagagaaccaagagagcaccagaggaacgcgcttccaacagagaaaaccaagcaagggggcccccgaggagcagaaaggcccgagtggtcagagcggagcccgtggaagagatgggcacagccagattgcttagagctgtgttgttagaagtgctgatgagtctacattcaacttgcgcctgcaaactcagtccctcttagatgccagtaggtcaggaacctcatgcttccaggactctggcgctcctaccctttcctcccaggcctcctggacaggccaaaccagaactgacttctaaagtgggaaccccaagacggcagaacatgaatcagccaaacaaaagctgcagttatctctgtgatgatttcggcagtcggcacgtgtatttgattaaagcgttggtaactttgaatctggagttttatggcactgtgtactactcataatggctttgtagtgtggctctcttagggagcttaacttttacaacatgaacaagttccagcctcctttggtcccatcaagaggccatttctacctggtgggatgccacttgctttacaaagcatcttttgtaaaatgttgagtctccttctttgaagttggaagccaggaagcctgattttttttccaataagtattgtagaagatggcagcctgatttatttttatttatttatttattttgagacggagtctcactctgttgcccaggctggagtgcagtggcacaatctcggctcactgcaagctccacctcccaggttcacgccattctcctgcctcagcctcccgagtagctgggactacaggcgcccgccaccatgcccggctaattttttgtattttttgtagagacggggtttcaccgtgttaaccaggatggtcttgatctcctgacctcgttatccgcccgcctcggcttcccaaagtgctgggattacaggcgtgagccaccgcgcccggcctggcagcctgatttttaaactggcttttctcctaggtcctttccttctctataaatccctctttcacttagtatttcctccttgtttcctttggtcagttggagtgagggtggttctagttcagagaaagagacaggcatacaggctgattcagtctgaggtgcttagctttctgtacctcactggaaaccagtccaggaatatgacaggtttcagtaggtttcattggacccacaactccccatttgaaggcagagcttgtcaaacgagttatgtggcttttactcaaggagggaggaacagcaacagggagctctgggctattgatagacactcctgcctctgaacacacagcacccagcaagaagttaccttcatgggttgtctagagtgaacatgggctgggattctctcagccttagcactgatgatttgacaacaaaaatcgccccgtgggtagagtataacggagcaaatgattatggtggcctgtgatggtgcagccagcccagctgcttcagctggaaagaagatggcgaggtttccattctcctggcagcatagccatgtgaacttgttaaatcttttaagtagctgtataggaggggagataagtgtgtgtgtgtttattcttatccccttaaatacaaaaacaaaacttccactttataaaatcaattcagagtgggaagaggtgcatggcacatggaaaatgtgtcggattaggttgagtcctaccccacgtttgggacacagctgtaagtttccatggtgggtggcttattatgcatttatgctgagctgaacctgctccaagctgctgcagataggaaagtctgtcttggagggggagctgcctctttctatcacactataaagacataaaaggtcctttgaaagactccagcagtcaccacttgggtaacagaattaggggctgctgagcaaagtgggtctgtttttttttttttttaaagacagagtttccctcttgttgttcaggagtggagtgcaatgtcacaatcttggctcactgcaacttccgcctcctgggttcaagtgattcttctgcttcagcctcccaagtagctgggattacaggtgccggccaccacgcctagctagttttttgtatttttagtagagacggggtttcatcatgttggccgggctggttgtgaactgctgacctcaggtgatccacccgcctcagcctcccaaagtgctgggattacgggtgtgagccactgcgcccggccacattttatagccaaccggcttcttgtgtaacatgagttggggcttcttgggccccagagtccagcactcaggtagaaatatgaccgccatggccagacagcagccctcgctgggcccctcttcagagcagagctctgtgccgagcctttaggggtatgagagaaaccggagacctggtccgtgctctcaaagagctcgcggtgtagctggggagagagcaaggccacatgagacctcagaaggacactaaacggcacaccgacaagctcacagcactctagctgtgtcccgggagaggaaaggggtgaatcagggcaggtggggtcagtcatggaaactttcataaaggaggtgagtgtgcaggaggggcgggcctttgcccccgctgcgggcaggttgccgagggcaagtattagggggtccggcgtgcaatcgaacatttcttagctgcctctttggagtagcgctaccagttcctgtccccatgagcatcgtcttcggggagctgctggtttgaaggatgaggtaccatgctcatcttggccatgtcttagaacctgtgatagccagacctgtcgttctgggtccgtatccattcatgcgtcctgtcactgtcacagatatcgtgagtgggccagactcttctccccaggtgggagggggtgccttctgaggcatatgttttcagcctgctgatggcctcttcagaattagcacaggtttcgacaaaaagaatggagagactcccttctcatgtccaagggtctccccaagccctgtgtctcagcccctcagggcgtgtggtgctgcacactgccgcccagatgaccacgcgcagccggaacggccgccctgtattgagaagtgggatcggctcccagtctgctggcgaggctgggttgccacagctcctctgttgccctgcaacgcgggtggcctaggagtgtgctgccttcagtttattcctgcctgccaagctacgcttccaggtgctattcttttctttaaataactgccttagtgctgcttgtggaacttagcgttcccatcccaggaaatactccagtgttgtgtttttttttttaaactcattcagatgctcatggccaaatgtgtgacttaaataccgcagtgtccttgatattgccttccccacaccgacaaaccgagttgcattctggtcccactgtgggataaggttagggtagcggcgcttgcctctttgtgtggtttcagatgtgtttctccccacttcagataacacatgacagctgtaatatagctcagttcgtgcaagtaaggtaggggcagaaatcatccaggagaactccagcctccatcctaaaggattagactgcctagcatcagtaggtttaccatagaaggattcagtggagatagcgagggtggtgagtgttgctggattgagcccgtccctgcagcctgggcacgggagcactgcagtgccatgaaggagagggctgggggatattagcacagccggttcctatttccttttccacctggttaagacttccggggaggccctgcccagcagtccttatgagatgctgccttcctcttttttgaaaggcatagatgataaggaggtggacatgttttgagaagagaacctagagctcattacttgtatttgaggcatgtattgcttcactcccactttgggagagttttttctggggaagttaaaggctattcaggatcagagagtttcctgcatggtcccaggggctgggaggagccacctgctcagctggtggttagctgatagcacccagcctacccaccaagataggaggcagctcagatgtcactgggattcgcagtaccacaggctgtccctgggcccaagcagttagctagctgcaccccgggagggggtgttgagagcactgaagctcctgtgggagagtgcctttgacatcccccactccccactgcccagaactaggaggtagtgaaaggtgtcagtggcaagaaggctgggccagagcatggagggaggccgacctgggctccacacccacctcctccaccaccggctggctgtgcgaccctgggcaggtggcgggggttaagcctcagtgtccttctttgaaaaggggcatcatcctatcctcagtttgaggattagacgtgatagtgcgcaggaagcactctggtgcctggtacattgtaagtgctcaataaatgcagcttcccaaaatgatttcaatggcacatggtcctgcatccaggtgggatctgctacttgagtctccccctcaaaggggcctgctgaaatacgcagctcagtgggaaaccaaaacatacacccctttcctccagtgctccccaggaagcgccaagtcctgagcccagccagcaacttcgaagaagtgccctccaacaagtggcagtgggcacttgagcaagtgacttaacgcagccctctccccagcccctgcatccatctgggcctcattatctgggaggtggcttcttgtttcagagttacaggccctgaacaattttgtgttgggatgtgccataggcagtgccaggaaggttctttcatgagtaatttaacttgttactaagtttgctatcagccggggggctctttccccgggttcccttctttccctgggtccccttccccgcaaagcaaagtccaactcaagttagaaacatcccacagcctggagtcaggctgccctctcttcagttggtgtgtgatgtagaagcaggaagggcttcccactgataaccctaaaaataactgcccagaaatgctgtcagatggggccaagaggtgcacaggagcctgtgcccagctgccgacctggaacgtgggactttctagagggcttggaggagccctgccccttccaggcctcttcccaacagtgcttctcacgcctgctgctccattcccttttcctccttcctcccgcgcccccccctttcctggggtcacttcctgatgccattcttcaacttcgcccctgtcccccccaaaagcaatcaaatccacaacctaataaggcaaaagaatgaggagaatgtccgcctcccagcctctcccctaacagggtgcaggcctgaagcaaatttggaaaatgttacaacggagtgacaaccgatgggggctgggggtggggcggtgcagccttgttcaggagctgcccattgttggcctgaggcaggaccctaagggaaggccacccggtttgcgctttcctgatcaggctgttgacacccttctagcacaagaaaatgtatggaaagtaactgcctgagtcagctgcatctccagttgtgggatccacgtgccaggagaacacgaagtacacacaggtccgcagtgggagcccgctcggagacacctccccgccatcacggctgggactgtgcatatccaaacacttcttgcctctgagatgagcagttttcttccccttgactgtgccagggttcaattagcctgggcattaattaaaacttgtcaacacttagagtggggcccccagaaatctgtcacccctcctagatcattatcccaggctaatcaaccctctctaaggcagtttccattcttgacttagtgggagggaggaacaagcccctcggtgctggggagctctgggggaggtagggactgactgggcccaacccactttgttttggaaggtcaagcttagtaattaacctgaatgcttgggggagggggtgaaggagaaagaactgagtctagggatgtgccaggtctttcaaattgctaattatcagcgagcatgaggtcatccgtaaatatatctaattctttagcttgtaattaaggtgctcattaaaagtgcagggaagtcttgttttcctaaaaggggaaaaaaacaacaacacaaaaagtctttgttttgacctgacacgatggctcagaacagggggaggactcaaggcacaggactagtttcctgccttaaagagcctttacaggaaattgactgcaaacagtattggtgaccctgccaaggaggcaaacctagggtgatgtcattgttcgaagctgtcaccgccaagcctctggccttggggcgaggagagttggtgggattaaaaaatgagtgtgtgtatgtgtgtgtgtgtttagcagtctctaaagaggcgagtcaagggaaaatcctagcgggagaaaaatcacaaggggtggggggtgtctcagaaatattcttagctgggttcaactttcctcgtttttctaagtttaaaaaatcctctcttactatttttgctcatcaaaatgctgctgctttttcagagacagccttttttgagccattccctatttagtgttttgggtaattggctgttacagtatggaatttgtggcccaaaggcagcgtggtaagttagacactaggtgcacggtgccccattgttatgaagtgtggaaactgagacgctggactagtctgatgtatctgtttcttccaccaaaaaaaaaaaaaaaccattttggagaactacccaatgccagtgacttggcatctctgagtcgctaatcttcccatgtgcctccaggaaccgtctggagcgtccctgaaaaaaggacaaggtttgtatcttgtcatttttcctctggctggaagtctaagaggtataaacacagtcttaaaatgaaagcaacaaaaataaactcaaagcagccctgcgtgaaggcattaatgcaaaatatgcaagctggcttcctatttatacggcggaaggcagtcagaagagccaggcctggttaaggaaggagttatgtctctggaggtgcctgttccttagaattacaaataaaccctgggtgattactcagatgaggttgtaatgtggtgtctcatttcatgctttgcacagtccagtttcttgatggaaccaacggcctctgaaatgctaatgcaggatcaggatacagttagagtgccccccttcctgtgcccctcctaacatcctaacagctttagaaggaagtttgaagattaaacaggagagccatgtaagtttcctgtgatcctagatcctgtgatttgttaatattctttctcttcaatccacctgacatttacccagataccatattaggcttggagatacaacaagaaagaaaaccaacccaaccctgtccttaaagaaaagatggacgatgaagggccaggcgcagtggctcactcctgtaatcccagcactttgggaggccaaggcgcacagatcacgaggtcgggagtttgagaccatcctggccaacatggtgataccccgtctctactaaaatacaaaacattagctgggcatggtggtgcgcgcctgtagtcccagctactcaggaggctgaggcaggggaattgcttgaacctgagaggcggaggttgcagtgagccgaggtcgtgccactgcactccagcctggcaagagagtgagactccatcgcaaaaaaagaaaaaagaaaaaaagaaaagatggacaatgaattgcatgatggaagtgaacagtgttagggcgatatgcagatgtaaatgtggtcttgttttactgctcactgacttactgaagtaaacccattgacttcgccttcatgggtttgaaaagggtttttccaatgtgctctgtgtgtctcggagctcaggtgttcagagctgcctcccttataaatcgacctccaggagagttgtgtgtttggttcttggtgtatggtttcgtaggctccccagggctgaggagtcaccttgggatccagctttttttcttttttcgagacagtctctccctgtcgcccaggctgaaatgcagtggtatgcacttggctcactgcaacctctgtctcctgggttcaagcgattctcctacctcagcctcccaactagctgggattacagacgcctgccaccgtgcccagctaatttttgtatttttagtagagacggggtttcaccatgttggccagattggtctcgaattcctgacctcaggtgatccactgccttggcctcccaaagtgctgggattacaggcgtgagtcaccgcgcccagccaaaatccagctttttcttagttcctggcttggggcatgttgctggaaaggaatgacagattgaggcaagaaggaggcaagaaggatgcatctcctggccaaggaaactagagtttggaggtgtcccctgtcaatggcatctgaagaatttctacattggaaaggcataggtgacccagtctggtttggagtagatgggactgggtaggggactagtcttgaagctgcaagcatgctgtttttacttagagcacaggtagctggggaggagatcactgtggtgtgggtggcagaagccatccctagccatcacctaggaagatggtggcccttgggttgcccgagctgctgcttgttttagtagctgcatttggtgccacatttttgtggtaactgccaggaagcggagcccagcgtggcctcaggaagttggtgaggtttgcaccactttttaacaggctggtaacagtgccggagctgacaccctcatggttgcagccctgggattttgttatttggggacactttggaatatgtcactcagaatgctggctcactagctccacaagcaaaagactccttgggtagctggaagcaagcgttgggggaaggagggagaggcaattgcagtccagccaagaatctcaaggctcagtcttcaatgtatggaaacttcagtccttttctgatctttagtggaaatagctgttcactcttagcgccaattggaaagtgttggcagctgaagggggtcgttcctcaggggtccccagagccagtgtatctggtatttctaacattttcctagccacccctttctcctccatatgcccctcccagccccaccattcagatagggtggctggaaagaacatctcctaggtcctctaggaaacttggtgtttccactcaagggagttggggatcacgtaacaccctccacttccacctgggatttcaggccatctgtgggagtgcaagagcatggtggggtggaggtcacaggaaggtggaagcaaagccagggcagctccacatgcagccccctttcaggaacagcaaggataggccggcctgtatcttgttgctcagagcaggtgatcctgtcatttggacccttgtgaggagaatggatgtgagtgtgcacctggttctcttctcctggggctgagggactgtggtcttggattatcacatggtaggtgaggtgacaaaatggagggaagtagcctgggtggggactggggtggccactgcagagctctagctgatggtggccaggtgggaatggggacctgggacttcacgaagctggaaatggagagttttatggggcatttcattcaacttaaaaacctggccgggtacagtggctcacgcctgtaatcccagcactttgggaggctgaggagggtggatcacgaggtcaggagattgagaccatcctggccaacatggtgaaaccccatctctactaaaaatacaaaaattagctgagcgtggtggcttgtgcttgtaatcccagctactcgggaggctgaggcaggagaatcccttgaaccagggcgtcggaggttgcagtgagctgagatgtcgccattgcactccagcctggtgacagagcaatactccaacttaaaaaaaaaaaaaaaaacctgcaggccatacaaaatagggcctattgggtgtgaagagctacccatttgtgacccctaaccttgcatggtcttgaccctgtctctgcctctcctctagtctcccctttcctcttgtctgaattgctgctgcttaatcctctcactaggagcgagaaaattgtactttgccccttagtgacagctctgataaaaggtggttgaagtggatggtagtaaaaagggtttgctttagctgtggttttccagcctccggactcctccccctttcccatcaccatagataattaagagttgactcctcaaaattcctcccaccatattgcatatttttaggcttcaggtttttgtgaaccaaaatagtggaaagtttttttgtttgtttgttttgggtagcccaaagcaacacttttctacagaggcagccattctgcacgcacaataacctggtgaacaatgccagctttctattaataaatgaactgccagttcagaatttgtacccatgtggcagatggacagaaatagtttctttaggattgatctcttaaatttgactttgggaagatactggcagtccaggttttgtgacagagatccatcctgagatctttgtaaatggaaaagcctgaatgcagcgtttcttattgataggagagttgatggatttcaggaaaatgggatatagtagatgtgcaatgaatttgttgacttggaaacaaatttggacacttatccctgaaaacttcaggccattttttcctaaactctaattgagtccctgtgattggagtactagccccacagtccttatcaaacttcgcatttggagcaggcagtctgtctgggaaaagccaggaagctcgccatgaaggcatcgccctctgcttttaacttttttaggctctgttacctctgcactggcttgagtatttcctggctcaattgtttctcaggctggccttgagtccttagatgttatttgtgtgcctagaaatagctggaagaaaaatggttgtaatgctttgcattgctcactgctctccatggatggaaattctgtgagggaaagagggctttccacccagaaaaagagctgggcagcgtagacttcattgtcctgctggcctgtcatgttattctgctatactacagcgattaggatgagagagtttctcgctctccctgggtgtgccacctaaggtacattagggtagggacgaacatggcgggagttctcatagtgggctttcctgccagacgtatggcccacacagcagtatttcttacatgtggttcttttttttttttttttttttgagacggagtctttctctgtcgcctaggctggagtacagtggcgtgatatcggcttactgcaacctccacctcccaggttcaagcaattctcctgcctcagcctcctgagtagctgggaccacagatgcatgccaccacacctggctaatttttgtatttttagtagagacgtggtttctccatgttggccaggctggtcttgaactcctgacctcaagtgacccactcgccttggcttcccaaagtgttgggattacaggtgtgagctaccacaccctgccaaggttctattatttgatctatgttctttgtttgtttgtttgtttgttttgagatggagtttcgctcttgttgcccaggctggagtgtaatggcacgatctcggctcaccgcaacctctgtctcccgggttcaagcaattctcctgcctcagcctcctgagtagctgggataacaggcatgtgccaccacacccggctaattttgtatttttagtagagacggggtttctccatgttggtcaggctggtctcaaactcctgaactcaagtgatccacctgccttggcctcccaaagtgttgggattacaggcgtgagccaccatgcccggcccctgtaaccatttttaagtgattgatcatctcagcatgattgatggagatgatggggttggccatccattcttttttttttttttttttggagacagtctcactctgtctccaaggctggagtgcagtggcacaatcttggctcactacaacctctgcctcctgggttcaagcgattcttctgcctcagcttcccaattagctgagattacatgcatgcaccaccatgcctggccagtttttgtgtttttaatagagacagggttttatcatgttggccaggctggtctcaagcccctgacctcaggtgatccccccacctcagcctcccaaagtgctaggattacaggcatgagccaccacacccggcctattcatcatttattgagcatttatttatacccactatgtgccgtaaacaaggtgctgagtaatgagatgtgaacagaatagtccttcttcttgtcctcatggagcacacagcctagtcggggacaataggcattaaaaaataccaacaatgaaaacccaagacatacatagagtgttccaaattgtggttttattttttatatatatatattcatatatatttatatatatttatatatatattcatatatatttatatatatgaatatatatttatatatattcatatatacttatatatatttatatatacttatatatatttatatatattcatatatatttatatatattcatatatattcatttatatttatatatattcatatatatttatatatatttatatatttatatatattatatatatttatatatttatatatattatatatatttatatatttatatatttatatatacttatatatatttatatatttatatatatttttatatatatatatttatatatgtataattttttttttttttttttttgtgatggagtctctatcacccaggctggagtgcagtagcgtgatctcagctcactgcaacctctgcctcccaggttcaagcaattctctgcctcagcctcctgagtagctgggattacaggtgcctgccaccacgtccggctaatttttgtatttttagtagagatgggatttcaccatcttggccaggctggtcttgaactcctgaccttgtgatctacccgcctcggcctcccaaagtgctgggattacaggcgtgagccactgcgcccggtgtgattatttttatgaaggaaaagaccagagtcctttaagaggggacagtgggggacttgcaatagattgtgtgggagctgtcaggggagactttccaagatgatgacagtgaagtgaggcctggagggagagttagagccaacctcagagaagggaacactgttctaggcaggaggacccagggttgtgggaagagagaaataaaatgagaccaagacagtggggagagcagtgtgagttgaagtcagaggggtgacagcagccagaatgtgccggtagcgaggatcttggattttattctagctgcaatgagagctttgattctacaaatatttattgcgtgctagtcactgttttaggtactgggtgtacaacagtgaaaaaagaacttcccagccgagtggaatgccgtggagcatatctgtttcgatgctgggacagatccctaacacagctcattaaagcagatagcaccattccgtctctttcttcagcttcactttacgtcagtcccagcatttttatccctacccttacagatgagagaactaaagttcagagaggtgacgtgacttgccccaggcccctcagtcagtaaaagacagaactgagaatccaaccagactcttccctttttaggttatttctctaacattagggccgagtatcgattctctttacctctgacttcgtgtccctggtattaagactcagggcccacagtgcctcttggaattcaggcatatggtgacatcagtgtgcctaccattcaggtcttggagaatagggtatggcgaaaggagagaactcgtgatatcgctgattcagtagcccagagttgtacgagtccttgggtgtttcaccttcatccaggcatctgagattggagacaagcatgtggctgaatgacgtatctgggggaagctgtctaaacagccgtgtggagttggagagttgaattagctctgtggccaaacctctgggctcagtctgcctatatatggcttgatctcaaagaacaggtgatagcagtaggagttgttttctgtgttgctggtgggagatgcccaggcacattcctttgtagacaagcacaaactagatatttttgaaatcggaggtctgaaaccagccgaagaattaatcctggcctggaaagcatatgggagagtacagccaacctggcttgggtgttgctttcttggttttgttgcatttttgaggcagggtcttgctctgtcacccaagtgggatcacagtggtacaatcatggctcattgcagccttaacctcctgggctcaagtgattctcctgccttattttttgattttttttgtagaggtgaggtctcaccatgttgcccaggctggtcttgagctcctgggctcaagtgatcctccaccttggtctcccaaagtgttaggattacaggcgtgagccgctgcccctggtgactttgttgctttttaataagcccagaaatttctttcaagagggaggatctttgtgaacatcttgagccgcgttcttgatcgctggctgtggaagcctccacctatcaggctcaagtccatgttgctatcatgtgcactttggctggtgaggtgctgagcagaggtttcagcctctaccacaaggtttcctgatgaaaggtcagctgggtgggcccagcttctccttacccaactgagaggcctcatagagcacaaggcctgggtacggaggttcctggggctcctgccatacccagccaggccaagcagagggccccagtgtgttgttgggtgctgagaggctgcccgcagctctcgcctgtgttggaaggctgtagacttggcttctcccaaacgtaagctgtgaagccatggactcagattctcagcctggccctgctacttactgtgggaccttgggcaaggaagtctccattttctcttttacaaaatggggccaataatctgactaccacagggctgtcaggatgcagcgggatggagcctttatagggtcttgttctgtgggatctggagtcccatatgggagttattagttgagggacgaggcatctgggaatctttattcaactaggaaacttcagccaaagaactaatgccatagagatgtcttatggtgtctgcatttgaagccagcggttctttgaaaatttatcctgagttccagaaagccaactgctagataagtaagcattgagcatttaaggggtcctggaagtaagattcctggaaagaagcagcaatctcttactcatccccgattatctcagacacagagtggtggatggaacctttgtggtttaggggctgactcttggtattgctggataaggaatatgagccagtagagacgagtgtgttgtatagcagtgtcctgcgactgggctggagacgtggctgagggaggccagggggcctcagagtgcacgggaggaggcttacagaggtcttttgcatcctgcagaacaccacatgtgtccttccctctgggaaacctcccacccgggcagggcctctggggccggatgtggaaggtaaacaggctgcctttctgctctctaccacagacaggcccggaaaggcctgagtaggagcttttcatctcaggaagccctgaggtcccacagcttctcctgaagcagcctcattgtccctttgtaagagcatgaccaggtgctctagctcctggagcaccagtggagaactagagtggcccaggtgctgatgccaagttcgagcaacagctcctggcgggtttccctgcatccccccactcactcccatctattcttcacataggggccaaagaacatcctgcttgacatcttgatcagtgtcccttgccctcaggatcaaacctgcaagtccccaaggccctgcaggatctgttttctcctctctgtgctccgggcgcatgccagctgcctctctgctccatgctcattcctgcctcctgagggacttcacacggggcccttgcctctgcccctttcgcctcagctcgccacctacctcctcctcattcttcagatggcagtttatgcttcactatttgtagggccgtcgcacctgacacctccagcctaggttaggagcatgtccatcacctctacttctccttttaactccaaccatccttggctctccctctcgagggtcacgagagcagagagagaatctattttgttcaccactgtgtccctaccatgtgggacattgtcaaggcaaatgtaagtgtgcactaaataaatatgtattgaatgaatagatagccaaacagacagaatggatctgccacaacacaaacaggatgcttttcaagtgggcagaagatggagacatcacttgtcgagacactcaaacaagtggctggatggatgagtggcagatccattctgtctttctgcttggctttaggagtagagggatcacccatggtccatcctctgaggacaagggtatcatgaccgcccaggccccactcacccctgccaggctcattgcatcccatctaaaagtgtgctctggaaggtcataagaagtcctcacctgggacacttctaggcccagtgttcagccagctgtcctgagttctgcatcagtccctgctagatatgaaacacaaacaggatgcgatgcttttcttttttttctttttcttttttgagacggagtctcgctgtgttgcccaggctggagtgcagtgggtgcaacccctacctcccgggttgaagtgattctcctgcctcagcctcccaagtagctgggattacaggtgcacaccaccatacccggctaatttttgtatttttggtagagacaatgtttcaccatgttggccaggctggtctcaaactcctggcctcaagtcatctgcctgtctcagcctcccaaagtgctgggattacaggtgtgagccaccgcgcctggccaaacaggatgctttgcaagtaggcagaagagggagacatcactgtcccatggagaggtgggaaaatcatcgttagcacaggataattcatcctattttgtgctcatgtttactgagctaggattgacctgtgtccgggcagcagggacacagaggtgagtaagacaaagagaaggcccttgcccttaaaaatgatacgtgtggctaaaacgctgtagacctttttgttttttcctttttgagacttcctttttatacagaaattgctacctgcaggtaaaattaacttacatcgtgaaagcgacagtaaagtgtttctagggatagctaaagacctaagaacacagccctgtggtttgactggctggccaccttcctgcagctgggtttactatggtgctgtgttctgggacagcccactcgtctccatttattgggctgagcctcgagacctgcaataccagggaaggaagggaagtctaggctgtctttggtggccattgttatttatggggcatcggcagagaagtcagtaccatggaaaatctagagaaagatagaggatacgcagtgtggttgagcagaatctgatagctccctggctctctccgggccatgggacccagggcgacacagccaccctttttctctctgctgtctggcttgggcttgggctttgtctcctgtgtccctccacaccttcttcgctgtcagtggtgaccaatcccgtggaatcagccactgtgtgttaccccaagtccttgcccctgggacctcgctctgttcggagacaaaacccgggactgtttctccttttaaatgcaaccttgttccacaggagaggagaaaagcaagaaagaggtggcttgtttatctgatggtagtggggtgtgctctgatatgcctttgaaaggggcccagctttgctttgcccagcggcctttgcaggataatgagagaaggaaaacacagggaacttagtgggaatttgaaactggagtgtgggagtgggaaagttcagcttttaccttggagcaatccagtctttctcctgtaggaaaacagaatggtgctgtatggcctccaagctgggttacatcctgggaaaaagacacgtgcttggctattggcctgggcgcagtttatgtgtaagcctttccttgtggattccattttcttatttcccgaatacttctcagccccacaagtccactgagtcttctgtctccagagactgcctggtttccatccccgagggcatctgcgcatcacttaccatggtgtaccatgcacctccagtgtgcccggcactgtgtcaggagctggggatacaggtgctggtccccacctcactcccctcaacctctgcaatatatgatacataacccacacacacagaccatatgcaaaagtggtgggactcctttgtacctgtcacctgcatcagtgattatcagcattttgccagacttgtttcatcagtgtctcccaacacactccccccagacattacccatacgtgctcaaatagatttgggtgtgcgtgtgtgtgtgtgtgtgtgtgtgtgtgtgtgtatttttttagagacagggtctcgccctgtcacccaggctggagtacagtggtgagatcatagctcactgcggcctctgaactcctgggcttgctttgttgcccaggctggtctcagaactcctggcctcaagcgattctgccaccttagcctcccaaaatgctgggattacaagtgtgagccaccgcacccggccaatgtatgtatttttaaacataaccacatactgttatatttaatgcttctgaccatgtcttaagaaaaaaacaaaaactccctttggcttccttgacatcacagtctctctgtttctctgactcttcttcctcatctcctatggctaaattctctccctctgtccactgcttacacatgggcatttcacaatgtcctttttccctgaaggaacttaccccctcccctcagccttaagtaccccatctgtggggatgatgcccatgcctgtagtcctgactcactcaccacgctctatcgcagttatttactgatgcatctctctcccctatcagacgctgaggtctttgatggagcaaccttgtatttgtccgtgtatccccagcaccacacctgtccatagctggagctcaggaagtttttttttttttttttttttttttttttttttaaagtcagagtctcactcagtcgcccaggctagagtgcagtggcacaatcttggctcactgcaacctccacctcctgggttcaagcaagcacgtctgggtaatttttgtatttttagtagagatggggtttcaccatttggccaggctggtctcgaagtcctgactgcaagtgatctggccgcctttggctcccagattgctgggattacagacaggcatgagccactgcgcccggcctcaggaagtagttgaatgagtgactgaatgaatgcccacgtgagcaaatgacctgtttgctgaactttagactgacgttgcctgatgcccactgcttgtgcagtacgtacttcagtctcagcgtgtctgagaccaaactcattttcaagtcccacttcttgggcttggcattgcccatttgtcagccatccgagtcagaaaccttggagtcagcttttgacttctcatcctgtaacaggcaccaagtttgatttctttcccttgaatatctcttagaaccctcaccttcctccttctctttattcctaccattgtccttactcaggaccatatagtgagggtttaaaagtgcagagtcttggccgggtgcggtggctcacacctgtaatcccagcactttgggaggccaaggcgggtagatcacctgaggtcaggagttcgagaccagcctggccaacatggtgaaaccccgtctctactaaaaatacaaaacttagctggatgtggtggtatgtgcctgtaatcccagctactcaggaggctgaggcaggagaattacttgaacccgggaggtggaggttgcagtgagctgagattgcgccactgtactctagcctgggtgacagagtgagactccaatctctagaaaaaaaaaaaaaaaaaaaaaaaagcagattctaaactcacagtgctgctgctggctgcctgagcttgtgtggctttggacagatgacttaaccactctgtgaagatggtatctgatgcacaggaaatgctccaacgttggctcttgtcgtcatctgtgcccatgtctccctcagcagcctcctgactggccttctccagtctcctggtttggattgaggctccctagaccctacctttctgagactggtatctagtcaggttactctgggagatctccaccccccactgcccagagagcaggttctgagctcttcagtctctccaccttctggccccggctgacaccatccctgccacttctcctggggtccccaaacatctgtggtacttttgtctttcttgcccttggtgttcccactctgcagaacaaccttctctccaggtcaccactgatcgcaatcgcgctctcctttcaaggcccagatcaggtgtcacctgacctttgctgtcctcagatcacacctccctgtagcgactggctcgccagtgtccctctctgaccgagctgtgcactcctccagggcagcactgtcagggtctcccccagacccttggttgtgattctctctccttgtcctgaatctcagttttcctgatacatgggatgctacctgaaggcaggtttcaactttcaatctttttttttgttttttgggtgagatggagtcttgctctgttggtcaggctggagtgcagtagcgccatctcggcttactgcagcctccgcctcctgggttcaagggattctcgtgcttcagcctcctgagtagctgggaccacaggggcctaccaccacacctggctaatttttgtatttttagtagagacggggttttgccatgttgaccaggctggtatcaagctcctggcctcaagtgatccacccacctcagcctcccaaagtgttgggattacaggcgtgagccaccgctcctggcctggaggatttcagatttaaagcaaagaggatattttccaacaaagcaactgcttttcttttttctttttaaattttgtttatttatttttaataaagatgggatcttgcatcttgcccaggctggtctcaaacttctggcctcaagtgatctgcctgcctcagcctcccgaagtgctgggattacgggtgtgagctaccatgccctgtctctttttttgtttgttttttttccaaattgaaacagggtctcactatgttgcccaggctggattgaactcctggcctcaagcagtcctctcgccttggcctcccaaagtgttgagattagaggtgtgagccaccatacctggccctgtagaggggaggcattgatgaaggtcaagaagtcctgttagctctgccttcagaatctaccccaggtccttttagttctctccagcctcactgctggaaccctcacccaagccaccaccttgcagtccacacacggccactgggattggggcggcgttctccgcgcgaaatctggctgtgctcctcccccatgaggccctccaaaggcttcctcttcttaggatgaaacccacactgccagccgaagctcctcaggctcccaccctctacaagctccttctgctccagccacactcaccaggcccgagttcccacctagcaccttccctgggaatgatctccccctggttggctctttctacttattcagcctcaaatgtcatctccactgagaggcctttcctgacctgctgagcttgattccctcccctccccagtcacattactccgtgttatggtacccatccctgtctccttagcttgtttttgtctgtattggctcttccactagactgtaagttgcatgagggcagggatgtctgtttaatcccagtgctcaggatagtgtatggctcgtgatagatgcctagtacattttaaaatgagaacgaatgaagtttgggagaggctcagagcagtgagtctcccccttgttgggggactggggagtgcctgggaggggctatctggtgccagcggtttggagtggctgggatgactctggaatcctgtgaggcccagtcagtttctttggttctcatgcagtgcagtgccctcagacctaaccattttgttccgtgctggcttgaaagggtctgcctccctcccagtgcagcccctgcctctcctctttctcgccccccgccctcctccagagaaagcaggtggtgagggctctctaacccagacaggacttgctgttcagccccagcttgaaattgatttcctccagccctccttgagccaggccccgtgaacagaggaggggtctgagccaggcctcctaggccattggtgggagggagaatgagacagccatttggcccacaggccaccaacttttcccccccttctctaaaagacacacaatggcagttgggctgcacctttgtgagtcaccggtgatagcccatcataaattgttatttcctatatttccagagcagctttatcgggcgttgcctgtgcagtccgggaaccgatttggtatggggtcagttaacatgctgtcttgttgaaatctgtcatcatgcccatataaggcaaactccttggattactttttaccttggcagaatcacaggaatgtcaaggtaaccaggccacctcagcatagctctgattctcacccggtcacctgacttgcccgccctcccccatgactcacccagtggctcagcatggggcctgctgcactgtggctgctggaatctgccaaggacctcctgggactgcccttggttttgtgtcttccttagagtagatcaaatgagaggaaccatgtgaagtagctcacacagggcctaacagagcaaacacaagacgtggaaagcagacttggtgaggcttgagtttagtttgggggttgcgggggtcccagctctgctgcttaacagccctgtggccatgggtatatcccccagcattcagagccttatctgtaaaattagagcacgcagaacaaaccctggtacacactaagtgctcaataaatgtgagtcatttgtgtaattatagtagggtaggccttatgccccacccagtcataaaaatgcctcttgctgttgttggttcaggctcagccccttagtggctttcatggggcaggttgacatggtacccagagtcctcctcggtcctcttcccatggtgtagtgagagcactcaggaccacctaggcctttcctagaaaactgaacccacaccttcccagtgctgccccaccctggtcccccaccccctgcaggacaaaccactcctcccttgttttggggccaggagtcagatctgcccctgagagcagcaggggcccctttgtcctttgacgtcatacccacaccgctcctggagacagccaccccttcatgccagccccaggaaggcttgtaggtggggcgagccagggtgagagtgtagccctgttcctcggccagggcagatgtttcaccatttttaatggagcaattatgagtcagaggtttcagtctctactggttcctcccgatcctataattactctttggctatagaatcctattttgatctcttcttttcttttctcttctttctctctctgtggtcatggtcaggtttttctttttttaaatcctcccaagacactgctaatgttgtctgtctcatgcatccaaggaatctgagatggactgaatattgtcaagggaaaaaaaaagagacccccaaatccagagtgatttcttaacccacccaaatggctttttgtttgtttgtttgtttgtttgagacggaatctcgctctttagccagggtggaaggcagtggcgtgatctcagctcactgcaacctctgcctcctgggttcaagcgattctcctgcctcagactcccaagtagctgtgattacaggcacatgccaccaagcccagctaatttttgtatttttagtagagatagggtttcaccatgttgaccgggatggtctcgaactcctgacctcgtgatccacccaccttggcctcccaaagtgctaggattacaggtgtgagccaccgtgcttggccaacccacccaaattgtgtaccctacaccatcctagtgcttgggagccaacacccactcacaggaggctaagggcaagtttaggtaactcttaacaccacgaattagttgcctgctggcaaacttcaaactccaagcctgaaatttctggttggagtcacctcccagatggactcagggattcattcaccccctcatccagtgctcacggagcctctgtgaggtgcaggcctggagaggagccctgtggcctcagcaaagggcaggcaggctggtgagcacccaacctctggatcgaggggactcaattatgcggataaaggcccctaatcctctcagtgctccaaactcactctgcttctgaaagggatcttcgtaccctgggttcagagagtaggaagcccgcagggaccgagtatgcatgaaacaagcccaagtctgtgggggctgtacatggtcaagatcacagatttccagaccaagccagctccaccctagctgggatgcccaccctgagacacccctctctgctttcactggaataggatggccctgacttggccgggtggactgttgaatcagagcctctcaaaacaggaaaaaggaaaaggatcaccaagcaggagtttcagttgtcaaagacaaaacccttaccacgattaaagattactccagggcctcgcatattcacccttccaccagcagggcccagtttacggatcatttgaatactagcaaaaaaacaagccatctgctggagagattgaacagagggagaaacaggagtgtttgccctgcttccagacacccctttcctgtggcagttcctgcacctggcaagatctactggggaattcccggggtcccactagctcaggacgggtgtgtagcacttgcctaaataacaatcccatcagtgccctgtctgaccttttctccccaaatgccaaaggcctcttgtctggatgaacaaatccctgggcggatttgtccagactaaaacgttaattctaaagactgggccccttaggcactcgctaagattccaggccacactgtctcaaggccagaattggcttacttggctatctttttgaaagatcaaagtttaaaccagatgatctgtagtcccccacccccaccctgaaacctgagcttagctgtaagcattgaaagtaaatggggtgtttgtagctcaccctccctgttctccaggtgaagggccccgtgtgcctgatcatttcatagcaaaatgctagatggggccagaggaggccccagcctctgctgctgccctaattttaaaactgccttttgggagtgtaagtttcctctgttaaaggtagttatttcaaggtaggcctcaccatctcctcctcctggtgagaagctctgcctggagggctgagcactgcctcccgctctgtgggccccacctgccttgggttgagacctatctcttcctggactctgtgtggggagtgcaggctcttccccttggggagaacccagttctttgacgtataatctgagtggtttgggttggttggttggttggttggttggtttcccatgtgtgggatggctccggaagtctgtttgagaacagaggcaggctcagatgggagcagctcctaccccgggccgcctatccccctttaccctggggtttcttttagctccaagcatccattccagtctaacaaatctggtggcagagtctcttttttttttttttttgagacagagtctcactctgttgcccaggctggagtacagtggcacaatctcggctcactgcagcctccgcctcctgggctcaagcgattctcttgcctcagcctcctgagtatctgggattacaggcgtgtgccaccacgtctggctaatttttctgtattattagtagagacggctggtctctactaatagttcaagacggctggtcttgaactcctgacctcaaatgatccacctgcctcagcccccccaaagtgctgggattacaggcgtgagcccctgcacccagcccctctggttctactgagacctcagatctttcatttatggaacaagggggttggattagattgttcgctctcagccctcacttcatgttagactcactaggtggactttgtcaaatgtcattgcccagggcccaccttgagggaatctgtctcattttgcctgtggtgaaattcaggtatttttaaaaagctcccaggtcccatacatctattgtcaattgattttcaacaagggtgcaggaccattcaatgggggaaagaatagtgttttcaacaaatagtgcaggaacaactattaatagatacccatctgcaaagaatgaagttgaacctttacctcacaccatatacaaaaattaactccaaacggatcagatacctaaatgtaagagctaaaactgtaaaactcttagaagaaaacacaagtgtaaatctcatgaccttgggttaggcaatggttattagatatgacagcagaaacacaaccgaagaaaaatagataaatcagactgtttcaaaactggaaactttttgcttcaaaggacactattaaagtaaaaggacaacccgcagaatatttacaaattgtatatctgataagggtctactgtccaaaatgtataaaggactcttaaattcaacagtaaaaagacacaccagttaaaaatgggcaaaggattcaaatagacacttctccaaagaagatctacaaatggtcaataagcacatgaaaaggtgttcgatgtcattactaattagggcaaatcaaaaccataaccactacaaatggtcaataagcacatgaaaaggtgttcaatgtcattactaattagggcaaatcaaaaccataacgtggttgggcctggtggctcatgtccataattccaacatttttggaggtagaagtgggaggatggcttggggccacgaattggagaccagcctgggcatcatagtgagaccctgcctctacagagaattaaaataaaaaattaggccgggtatggtggctcatgcctgtaatcctagcactttgggaggccgaggcgagtggatcacctgaggtcaggagtttgagaccagcctggcaaacatggtgaatgaaaccttgtctctaccaaaaaaaaaaaaaaaaaaaaacccacaaaaattagctggacatggtggtgggcgcctgttgtcccagctagtggggaggctgaggtgggagaatcgcttgaacctgggtgggagaggttgcattgagccgagatcacgccattgcactccagcctgggcaacagggtgagaccctgtctctaaataataataaaaatgagaaattggccaggtgtagtagcatattcctgggaggctgaggtgggcagattgcttgagcccaggagttcaaggctgcagtgagctatgatgacaccactgtactccagcctgggcaacagagtaagaccccaaccctaaaacaaaaaaaaacagaaaaccacaatgagataccactgcacacccaccatgatggctataatcagaaagtcagataataagtattgactaggatgggagaaatcagaaccctcacattgctggtcaaagtgtaatgtggtgcagcttcttgggaaaacagtctggcagttcctcaaaatttaaacatgttttgtatttttagtagagacggggtttcaccatgtcacccaggctggtcttgtctcagcctcccaaagtgttggaattacaggcatgagccaccacgcccagccaagttcctcaaatttttaaatataagaggtatcatatgactcagcaattttactcctaggtatatgcccaaggcagttgaaaacatgtccacataaaacttgtacatgaatattcacggtggtgctaatatccaaaagatagaagcaacacaaataatgcccatcagccaatgaattgataaataaaatgtggtatatccatacaatggaatgttattcagacaggaacgaagtactggtacatgctacaacatggctgaaccttgaaaacatgctaaggagaagccaaactcaaagatcatataccatatggttccacttatatgaaatgcccagaataggtaaattgcaagagacgaaagaaaggtaggttagtggttgccaggggctgggggctgggtaggagggaagtggggttggagagtaactgtaccagttttgcggtggtagacatgttccttgtatttttggttttttgttttgttttgttgttttgagataaggtctcactgtcgcccaggctagagtgcagtggcgctgtcatagctcactgtagcctcgaattcccaggcttaagtgttcctcccacctcagccttctgagtagctgggactacaggcaagagtcaccatacccagttaatttttaattttttttttctttttctttgagatggagtctcgctctgttgcccaggctggagtgcagtggcgcgatcttggctcattgcaacctttgcctcccgggttcaagcgattctcctgcctcagtctcctgagtagctggaactacaggcgtgcgccaccatgcccggctactttttgtattattagttagagacgaggtttcaccatgttggccatgagagacaggactagctggatttcctaggccgactaagaattgctaagcctagctggggaaggtgatcgcacccacctttaaacaccgggcttgtaactcagctcacacctgaccaatcaggcagtaaagagggctcattaaaataccaattaggttaaaagcaggaggtaaagaaatagtcaaatcatctatcatctgagagcacaggaggagggacaatgattgggatataaaccccaggcatttgaggcgggagtgggccaccccctttggttcccctcccactgtatggaagctctgttttcactctattaaatcttgcaactgcacactcttctggtccacgtttgttttggcttgagctgagctttcgctcaccatccttcactgctgttcaccgccatcacagacccactgttgacttccacccctccggatccagcagggtgtctgctgcatttctgatccagcgaggcgcccattgctgctcattcgggctagaggctcgccattgttcctgtgcggctcagtgctcgagtttgtcctaatcgagctaaacactagtcgctgggttccatggttctcttccatgacccacggcttctaatagagctataacactcactgcatggcccaaggttcaattccttggaatccgtgaggccaagaatgttaggtcagagaacaaaaggcttgctgccatcttgggagcagccactaccaacttgggagctctaagaacaaagacccaccggtaacagccaggctggtcttgaactcctgacctcgtgatctgcccgccttggcctcccaaagtgctgggattacaggcgtgagccaccttgcctagccttgttctggaattagtggtgattgttgcacgatcttgtgaatatactaaaactccctgaattttatgtaaaagggtgaattttttggtatgttatgtgaattacatttcaatttttaaaaattgattctccaaattatgtacatatttaaagagtacatgaaagagagggagagaaagaaaagctggatgcgagatgccgcaacctgattccactcactcctagatttgttgagtacctgctatgtgaaaggtaccagtccaggcagtgggttcccacagcaaacagaaccctcctctggggagcttatgctgcacttgggagggagactggttatgaacaaagaacatagtttttgatgatgaaaagtgcagtgagtaaaacaatgcagtgtgaggccgggtgtgttggctcacgcctgtaattccagcactttgggaggccgaggtgggcggatcacctgaggttgggagttcgagactagcctgaccaacatggagaaactccgtctctactaaaaataaaaaattagccaggcctgtaatcccagctactcgggaggctgaggccagagaatagcttgaactcaggaggcagaagttgcgttgagctgagatcatgccattgcactccagcctgggcaacaaaagtgaaactccgtctcaaaaaaaaaaaaacaaaaaaaacaaaaaaaaaaacccaacaacgcagagtggagtgatagcctaggggagatgacagagtccaggaaggcctcctgggttgctgacatttgaggcaagtcctgagtgatgagacaaaaccagctctataaagagctagacgaaagtcttagaccagtatttctcatgaggaggagacagcactccaaaatccatcctttggcctggcgcggtggctcacgcctgtaatcccagcactttgggaggctgaggcgggtggattacctgagatcaggagttcgagaccagcctggccaacatggcagaaacccgtctctactgaaaatataaaaattagccgggtgtgatggtgggtgcctgtaatgccagctactcgggaggctgaggcaggagaatcacttgaacccgggaggtggaggctgcagtgagccgagatcatgccaccgcactccaacctggcgacacagcgagactctgtctcaaaacaaacaaacaaacaaaatccgtcctttgcagcagcaacacgcacgctttctggcacctcaaaggggattgtccaagactggaacactggctgcagggagggggccgggtgcaaagagctggtttctgggtggacacgcaggacctttggaatgctcgctaccccactcagcagtatttatacctcttctccaactgcgaagtcagagctttttcatgcaggctgagaaaactccgaataaggcaacttcaggccaggacataagacgcattccatatttcactgtaattgctttcaaattaggttatgtcgtcatgtaacaggcacacacagtgcacttgctttgcccctggctggggttgggtcctggacaggctgccccgtgtgtcgctgaactgccgcagtgctagccctgattgcctgggcagtagggctgtctgcgtcccacgttgctgcacccatctaatttgtggctgtgttattgtgacctgctcgttttctgttctttcaacctgcttcctggcttttatctccttcagaatctggtggcagtggatcttcaaaaagtgctcaggtgtgcagtctcacaggccagaggctccacgggcccccttgccagggcgagcatctctgcctgtgccgctggtaacccagattccagaaggcttagccgtctggccctgaaagcgcctttatagttggtgatgaagcccatgggctggggagccgtttctgctttcaggaactgaaaagatgccccagtggggctaggccttgcctgaggtctggcaatagcctgccagatgggtgataagaaggcctacccaggtgataagcctacccaggaataaatagctgtacctcccctgtgtccaagccctggacacccttccctaggacccatggaagcaggaaccatgggcagcgtcagaggccacagcaggcaaggtggaagttcaggaggtgggacggcgccctccccctcaaagcaactgatgccccagcggagcgacaaaccctacacggtatttcagagccaaggtttgaaaactcccagggtgctagggagctccgtctggcctccgggtacctggggttggggctggctgtggccagttgcagtcaaccctgagcctgggcaaaatgcatgcaggctggtcctcctgggtgatatcctgctaggcgggtgggcagtgtacacggcagaagagggttgcggcatgaggcagcaaacgtttttttctaaaatcttgtcaagcgtggggtccgtggaatccacatgtgagcatcagcctggtgggtggggagagtgaagcctgcgatccagtctggatcatgtgctacacagtgcagagccggcatgctcacccctcctgagggatcgctcgagcctatttctaggcccaaagcgactttgcaagagactccctttattctgggcttagtggaattccagcttccaacagccatttccctccacccccttcagttctgagaacatgttttgtaacaggaaggcaggaagaaaagagaaggcgagtttgttcagctgggtcagccgcatcccaccaaggccctttcttccctccagctcaccatcgctctgcccactggaaccactcggttgccctgtgtctgccgaatgtttgtttcttaatcagcgccccagagtagagagggctttgcctcttcgggttgagggagggaatcattgatgaatggctcattaaagcccactgctgccacattcctgggtgcttaggtcacctcctgaacaatatccatcattcattcacctaccgccccacatcctggcggctgggaggggtccctgtgacgcaggaaggactttatgaccagagatgctaggtctccgtctccctcctgcagcccacagtgacaaagcagaaactgctcttggggccccctgaagcccgccttagctgggtcaccatgggccttggcacacggaggggtgacagtggatcccaactcaactgacaagcttgcctttctctgttcttccaccccccttccccgcactcacaccctgtgctattttagcaaccagagaagcctctttaataggctgcccgtgtgcaggggcaagctctgaagcctcctctctgtggtttggttcacatgtgttctcaaagacagatgagtccacatccttccttcctccctagataggtcaagggctgggtgcaggctgccttcacaggagggccagggacaggctgggaggagcggggccaccttttgcgaagcgggtgatctgctggggcgttgctctgcctgcctgccttgttctctgagtttacctctagcttggggaccaagggtgggctggggccttctttttttttttttgaaaccgagtcttactctgtctcccaggctggagtgcagtggcgcgatcttggctcactgcaacctctacctcccaggttcaagcgattctcctgtctcagcttcccgagtagctgggtttataggagcccgccaccacgcccaggtaatttttgtatttttagtagagacgaggtttcaccatgttggccaggctggtcttgaactcctgacctcaagtgatccgcccgcctcggcctcccaaagtgctgggattacaggtgcgagccactgcgcccggccctggctgggggcttcttgacctgactctgctgtctctccctcactggccagcacctcccattctactcagacatcgtggaatgaatgcccaccccgtgtttgtatgtatcatctgtgtctgtgtgacattaagcaagtcactgaacctctccctgcctcagtttcctcatcaaatggagatatatcgcatgtgatcatggggttggaggttttaaagagttgctaatgtgtaaatagtaagaactagcaattagccgttatagcataattacctttaatatgtcatgccccccgcacccccgtgctgaatgtaattttgcgggggggcgggttgagacagggtctggctctgtcaccgaggctggagtgcactaacacaatctcagcttactgcaacctctgcctctcaggcacaagctgtcttcccacctcagcctctcgagtagctgggactacaggcgctcagtaccacgcctggctaatttttgtagtttttgtagagatggggttttgccatgttgcctaggctgatctcaaactcctgtgctaaagcaatcctcccgcctcggcctcctaaagtgctgggattacatggtgtgtgccaccatgcctggctggccagaatgtaaatgataactgttttgcttcctcctgtgtccagtacataatagggctccaagtcagtatttgtgaggcaggtgcatgcctcttagttgcggtcctgagggcatggccactgccacgttctggacagtcagagtcgctgctgcccctggaagatgaccgcgatcatgaagcccaggagagctcgatgctttttgcctttccctcctcccacagagggctggcagctctggttcctcccaaatgaaatagaaaccttgagtttgcatttcttctttggcgtgccggcagggcacctctgccttcctcttcctgccagggggaggaagtttctctcaggggctcttcaccctgctttattcctggccatcacacattgacccttgtccccttcggctctttccctgcatggcagggacagcatgaccgtttaatggctttgtgaggccagcatgccagcctcacttctttactcccttccttctcggagtgggctctgtcccttctgcaggagggctttggcacatgctcttcccagtatctggaaggtctccctcatttttatcttattaactcctcatccttcagctcagagtttgagaatgacttcttcaaggacacctttctgtgtctgcctcaccagtcgcttggtgcccccccaccccgccaccatgctgaccgcactcttcagctcccatcccaggggaggtgacacaaactcggccccaggagcccagcacctggctttaaacccagctctgtaactttctaggtgtgtgactgatgggagcaagccacttcacctctcaggccctccgtttcctcatctgcaaaatggaggcagtactagcacctccctccagagatgattacgagggtgacagaattagtaagtgaccaagtgcctcgagcagtgcccgcccctagtagactctatggaagtgtctgctgcagttattgctgttattattaccacttttcctaagggcgttatttctggagtggactgatcgcttgattaatgagatcagacctggagcctcatgagagtgtctgcttttgctcactgttatggattcagcacagggcctggccctctgctgacccccagcatatgcttgtccagagaatgaatatgtacggacccatggtggcctggggcatcatgaggtcggctgcccacattctgagaattttgcatggtggagggcggcgtggtgggcgcatagggcccccatctatagaaaccacctctccacaccatccaccccacgcagcgtagtctaaaccgggtagggagaggaaggatggaagcagagtgttatttttgtaaccaagtagaagaagcgatgaatttttaatgtcccattcgaactccagctcctactcaccagtctctccgcatggagaagtggccgtcatggtcgacctgttcccaagggtggccttgtgagtgcaggctctcctcaccagagctgagggctttgtgaacctctgatgtcaatagatgcccctcatcttccaggaggacaaaacagggcaaagcaagacatggggtgagaacaggagtgcatcagtggggttccccaagcctgtgtcaggtccggatctgggtgggagttcccttctgcgtcatccaggccaggcgagtgggcatcctccctgagcacctgtgcttggggctttgcctgtgtcagtcaggaagacagagtacacggaagagttaccattgctttcagagcaaaccttcctttgacatgcatttaacacagcacggagtgattgacatgtgtccttgtgtttaatccctatcttaacctctcggttactgtcctgtttatcagtgaggaaactgaggcttattgcttgcctgaggcctcagtggcagaagcaagatgtgaatccgcacctgtgtgatgcccaagccagagctcttgtttactacccagagaagatgagcacaggtgggatgtacgtatggagggcgggtagggcagcagcccctctgaggacaggtggccagaacccaagcggcgaggtttgttcacagcctccacagggtggggtggggccatccgcagagggtctcctgccatcccattttccctgcataccagtgggtggtctgagagcctttgcagagaagagactggatctcagcacgtgcttatgtgcgtgtgtacatgcacacacatgcgtgtgattcatctggctcttactttatgccaaggagcctgtcacatgctttaaatgtattttccctagtttaattcttagagcacactgcaggaggtagattctgataaatccatcttacagggaaggaaacagacttaagtaggtaaagtcacttggttgaaaacatggaatgagtaagccaaggggcaggtattcaaacccaaacccaggtctgtgcccctgcagagcctgcaggagcagcccacacaggccaaggctgtgaggggtgctgtttgcacgcgtgcgtggccctccctgcagcccaggtgcctaggtctgggcctggcaacaccagagcacggggccttgccctcggggaacagccctcttttgtcctcaggctgtgggatgtgtcttggctactttgctgcccagcagtgcctgctctcaggcacatgtgagagtagaggcctagcatccgtggccacttccttcccagcccatttgctgctgccctttgctctgcagggctgctgggctcctgggctccacgcctgcttgctgcctgccatcaaggctggcagtgctctggggctgtaaaggtgcaggcgccgtacttcccaacccctggagctcgcacatggtaggagagaaagctcatgtgcatgcaacatccaataagactaaaagtgactgggggttgctacgggagaggtgctgagggtgggccggggacagagcaggcacactgtggagggggtgggcaggactcctgagaccagggcagggagggaggagatgctgggaggcacagggccatccagagagctgccacttcctgagcattgccatgcacgctgcaggcatggccatcttgagtcctcacactgcccgtggcctaggtggggtcttcatccccacgttgcagaggaggaaatggaagttaggaaggttaggtgacgtgcccacatgagtggtgtaagcatggttcccgccctgggctctctgaattcagtattgtatgggggaggctgggaaggtgagttagtactctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccaccaggaggggtctctgtctcccaggtagaggaattctccatggtgagaggtggtggtgggggatggtctagctgtccactcttgccccctttcggatttggaaggaagccccatgctgggtccacactggtatggcgtattaattaggcagctgctttgtctgggagggggctttgtgtcgagtctccctgaatgagcagggctggcgacagttgtcaaaacacatggtgcttggtcagagcccccgtagaagccccttgtcctccgcatggcctccgcctgcacccggggcgtggaatgtgctcttgtgtgtccctggctgtctgcttgcttctacactggcccctgcagatggagggggtggggtacaggggttcctataagaagcagacacttggggtttttcccaggtcctgttgcaggagggtgcgtgggctggtttccctgaaggcgcctgggcgtgttggtgttaactgatctgagatcttctgtggccctgatgtctatgagcatgccccagcttgcagggggctgagtagccgggcaccaccaggaggctgcgtgccctgtgcttgggtgtacccatgccctgtcagcatcgttggtctgttagggtcagggacttcggcttcttgtttagtaccctccatcccttccagttgatcatcagaaacattctccttagatgcggctgcctgaccccggtgagggggcctgcctcccacttgccttccagcctcctctaagctgcactgagtcttaaaaataggaaggatagggctgggtgtggtggctcacgcctgtaatcccagcagtttgggagaccgaggcgggtagatcacttgaggccaggagttcaagaccagcctggccaacatggtaaaaccccatctctactaaaaagacaaaaattagatgggcatgttggcatacacccgtagtcccagctactcaggaggctgaggcatgagaatcgcttgaacccaggaggtagagattgcagtgagctgagattgcgccacagcactccagcctgggtgacagagcgagactccttctcaaaaaaaaaaaaaggaaaaaaaagaataggaaggatagggcatggcatgttctccaggagacagagggacgggggcatcttgcttgcaggaagccaggcgacacaggcgtgtgtgcagggctcagagggtctgtgttcctggcctttcctgggagggcttgctcttgggctgcccaaagctcaaagagagactcgaggaaatcctgcatttatgggagcttttcttttcctgccactttcctgttctgggttgtatctgtgcacgtgattggaacgtagcagcctgagctcctgcctgaggagagcagccacgggtcacggaagccagggtccagctggggcctttgggtctagctggcagatgaagggctggccttcatcaagaaaacaagccccatgagggcaggagcccgacctgttcattccacaccaccgagcctggtgctcagtcatgtttgtgtgactgagtgagccggcggcgggctgaggcgcttttgtctggtgtgcgtactggtctcccttgaggcagcttgggggtgtggaaaaagcacatgttgccaaaattgacagacctgggttcaaatccaagctctgccacttaccgcctggatggtcttgtgatgggtcattaaccaccccgagcctcagtttcctcacatctgcctcccggggtcactgtaaggatcagaaacaatgtgtgtatcggccatgtacggtgtgtgtcggcgagtgctccgtggcagctgcggttctcctgaggtcagagctgcggccctgcaggtgtgtggagagagccccgacagccaggctgactctgcgcactgtcctttgttctgcttccccagaccttcacggcatggtgcaactcccacctgcggaaggcaggcacacagatcgagaacattgatgaggacttccgagacgggctcaagctcatgctgctcctggaggtcatatcaggtgagactcccagccacgcagtgcggccgagccctggcacaggtgctctgccacagcggtccccagagaccctgcccacccagctgtcccattgctcctggggaggagagggcaccccttaatagctgcacggtggtctgatgggtggggccagagtggcctggtgggccagcagaggaacctgcttttggagaacagaggagactctaaagcctctctccctctcgccctctctccctttctctctctctgtctcgccccctcttttctctttgtgcacttctcaggggagcggttacctaagccggagcgggggaagatgagagtgcacaaaatcaacaatgtgaacaaagcgctggactttattgccagcaaaggcgtcaagctggtctccatcggggcagaaggtgagctggaggtggggcagcgagggtcctgctcggtttctgacctttaggctctgaagcacaacatctgcatcctgaagagaagttttgttggtggcagggcgcttggggcactcagagccccagtacatactcagcagtgatcacaacaactgctcttgatatgatgctgggcccacaagctcccccaaacccttggaaaaatccggtgggcgcagtccaaatctaggaagtgcaacccacccaaccacgggggcgacggcttctgcagggggaggaatggttttgactcggactcaggtcgccctcactggttctccttgtgccaggctcagcagacagtgacaaacatgtgccatggcctctctctgtaccaggaacacctttctcattatgccctgcccggtatcagagaaggactggaggccccatgtcaggcattgggacagggagtgcacggccaaaggtcagtgcctagactttgccctgtgtgcatgggcttggagaattttgcctctgaccaccccaggatcctcctgggccccacgtagataaccaggaccacagtccactacctgcaggccctcactagagcagcaggctctcagcaggggcccctgggttgagctcccaggcgcttttagagacaggcgaggcctgatggagccccagcagcatgagctcgcagtccactcattagtcagagtaagatttcttcaccctgacatccatgttgtcccagcttctagaaaaacaaagtaaactaattgccgttaatgacagggctctgagagtttggccaagactccgggccagaatgtgtgtgctgagttccaaggctctgccccggcccaggacctctgcgatgaggggtgccaagccttgcatgccacagtcgaggtggttggtgtttgtttaaaaaaatcacaacccaaaaattcagtcaggccctgagattttctgtccttgcatgggtctttcctccaggctctgttccagccttctgcttctcacagctgcatttattttgctcaaatgctagtctgtaaatacagaaggggttagaggagagacccatgtcagtcatcagttttcatttggagaaaaacttggtctaaaaatgttctctgttcatgcccaaattggttcactcccaatccctgtgactgtggggccttggaacaaagcctaatggaggcgttcctggggctcaaggcacctgagaaccccgccccaccctgtccccctgtccttccacatgattgggcattcgcgggagcattggcttcccgtgggggtgatgagaggggccggaggcacagctgcaggtcagagaagcagctggtggatgtgtcatgagaaacgccatcctcctctcctcaccggaactccataagccctccgttaccagctgcacctgtacttgctgagccggggagctgcggccttgcccagctctgcaggcccggccctcaggaggtgcacagaatagatttcctgaggctcgagctgcctcgctgcactaaggggcaggtggtgctgctcagtttctgggtctggggctctgaaccctaggacagggtggacactgggtccctcccctgtctctgggcagcagaatgagcatatttcctcctctcaaaacccgaaagctgtggctcatggacacccccttcctctgggtgtgtccccgggggaaggtgagccccatcttctctgtgacctctccacctgcttccaagcaagcctgccctggagtattctgctcagaggtcagtgagcagggtctcctgtggtgtcctgggcctccagctctgcagttagctttggaactcacccctgtgcccagcccttccccgagagtgcttgcagcagtggcgcccctctgtcttctttggaagccactccatcatgccccttgcatatggcgtgttgacaagttgggaggactgccctaggcacggctggctgatggactctgggatgaggcactgccttctctcacccagccgcagacacacagctgtcctgggccttgcagagatgatttttctcttaagttactgaggctgaagaaggtgtggtccaagcccttcttttgagaagtttcagcaatttttttttttttttttttgagatggaatctcactcttgtcacctaggctggagtgcaatggtgcaatctcagctcactgcaacctctgcctcccgggctcaagcaattctcctgcctcagcctccagagtagctgggattacaagcacccgccaccacgccaggctaattttgtgtttttagtagagacggggcttcaccatcttggccgggctggtctcgaactcctgacctcaggcgatccacacctgcctcagcctcccaaattgctgggactaaacaggcgtgagccaccacagccggccgcaaatgtttgtttttaggttagttcagaaagcgtgcagtctggcctcaggcccgtgctctccccttcctgacaacacagcagccatgcttgttcctcactggccttccaggcactggatccagtggtggtcagagcagccccgccctcacgagggcaggcagacagtgaacaagtaaacagcccgaccaacatgtgatttcactagtgatgccttggggcagcacaggggccagggagaggaactgggtggcgggttggggagctccttgggacgggcagtcagggaagccaccacgagaggtgacacaagcagaagcttacacgatgagaaggaccagccagttgagggtcgcaggctaggggcgtgctttgtgagtggacagagcgtatcaaagcaagaaagagcctggcttgcccagaggatgcagctagagaattccagcaggatggcagggcctgggccttcagggcaagccctttccctgtgggccaggcatggtggctcacacctgcaatcccagcactttgggaggccaaggcaggaagatcacttgagcaggagtttgagaccagcttgggtaacataataagacccagcctctacaaaaagtttaaaaactagcaagatgttgtggcatgcgtctgtggtcccagctactcgggagactgaggcagaaggattgcttgagcccaggcagtcaaggctgcagtgagctatgactacaccattgcactccagccagccagaccctgtctcaaaagaaggaaaccaaccatgctcgctgctgtgtcgatgtggattatgggcgggaagggtacataggaggcagccgcattgagctctggagatgacagtggcttggtggagagtgtcggcagtaggattggaaggaagtggacagattcacaataaacaataatgtagtgcacatttgctgactgcgagatgaaaaagaccacctttgccctgagagtgggggcccggggtgcccccctgtagtcaggaggtacgcagattacggcagaaatgtacagagcactgagagttgagagaggtgtgaacagaggccacacgcctgggaccagcctcttggaggagcggttttttgagttgggtcaggagaaggagctggctgcggggccagggacccttgtggccagaagcctgcaggcgctcagcagcaggaggctctgggacagtgctgcctagagactgttccctgcattttctcctgagggaggtggaggaggacaggcctgggagatgcaaccagggggtggtttggagcctttctctagatggggctggaaggccaccttcaggttgggcggaggagcctcactctggttttaacgaccttctgccctctgcccccttccctgtgtgcagagattgtggacggcaacgcaaagatgaccctgggaatgatctggaccatcatccttaggttcgccatccaggacatctccgtggaaggtgacagccacctgtactgcccccgcttcccacctgagtcagggcgggttagaggagagctgaagtgtgatcttcatgcttcaagcctcttcctgtttccttggggtcactcacagggcctggcccttgcaggggtagtcagtgggtggcaggtgaagggaggctcctcccagctgcctgcctcttggctccagtgccttccgagtgcctttgctctcacagcctcatctcagtggaccctcacgccaccctcatgagatgggctaggatggctgggcccgttttacagtccaggaacccaagtcccagaacagactagtgagagagttgggcctgggcctggttctctgtctgcttgacatccccatccttgaaacttggcccccatggacccgttatgagctcaggccgtccaggaatggacaatttcgcttccctgcaagcacctgtgtgcacacaggatgggcagagccacctgggctagcgtgcaggggctcccaggtgccaggtcgcagtgatgactgggagagatgtgcttcctgccctcgaagggctcccggtctgtgaggacagccgagctatccacggggaacagaagggccccctaggcctctctacagctggtatttcaccttgttcaaaagaggccaaggccggtatcaagggcctgtctgcagtgtgttctggtggtgaaaggcacaggcttggtggccaggcacatggcacagattcaggccctgacaccaccacctcctggggcagccctggtcaagcgactctcctcggggccgtgaggattaagcagggccgtgtgtcctggcagttgggcctggcagcatccgtctgcatccggaatgggagtggctgtcccgctgctatcactgctgctgttgttaggacagatatcctctccccttgggtttcgtttgaccccaggcctgagccgaaagtcccatccaacttgggctgagttctgagggtttatttttgagccagtgctcactgtctttgtgtgttttgcagagacctcggccaaggaagggctccttctctggtgccagagaaagacagccccgtataagaacgtcaatgtgcagaacttccacatcaggtaagcgccagtcctggtcatcctctcctttcctctaggaacctgagatccttcctcccacctgccctgtttgctgtgtttttgtcgtggtctgtgagatgccagccctcagtcagcccctccctggccacgggccctacaagcccatgggaaggtcacctggtcctctctgaggaagaggaggcagtttcccagccatcctggctgaaggcagtaaggtcagccctctcgccggcctaatagaacgttcttcgtccccaggcaaggtgactctcagaagcaacaataaagcttttcatttttgagacagggtcttgtgctgtcacccagactggagggcagtggtgtgatcactcatccctgctgccttggcctaggctcaagtgatcctcctgtctcagcctcccaagtagctgggactgcaggtgcatgcagccacacctggctaatttttaatttttatttttagtaggaacagggtctccctatgttgcccaggctggacttgaactcctgagctcaagcagtcctcctaccccggcctcccaaagtgctgggactacagatgtgagccactgcctgcctctggcctcttcctttattttgacagctcaggagtgaattgtttttagaattgctagtaaatttagtgttggggaaaaatgtactctgtggctgctaagatgaacaagcctcagctccaccatgaacctgcttccctcagggtgagcgggagatgagacatgtccaccatccccgtagctgaggcgagcatgggcactgccgcatgaggtccagggggcggcaagaggcaggcctgcctggtggttgggagcactggctctgggggcggtcctgaggtcagatccggtttgccttgtggctccaccctctgagtctcctggatggcccgcacaggaatgaagagcagggcctcatggggtttgcagcggcctcaggctctctgggacccttgctgggtacagagggcttttcccatcgtgctcaccctgatagcatgtggtccctcccttggtcactcttctctgtgtgtcttcttttttttcctgccactaactgactgaatctttctatagtttccattcattttcttcaactagtaagtatctagcatgcccgctgcatgccgttagtggagatacagtggcacccaaacaaagttcccatttgtgggaagtttacaccacagcgcggggaccagctgttagcacagcggccagtaatcctgcagcataacttcagtgagaagtgctgcacaaagacagggaagtcagatgaagaaagttccctgggtggcctttctgaggaggtgacatcgagcttgacctcagagggaaccaacccttagagggtctcagggaggagaatgtgacccatatagcttgtaactgaccaacttgtggccttggggaaggtctctttcctccagagaccagcatgccaagtgaaatcctggcatttagccagcccacggactggccttcctgtaagtcaggtccgccagggtgtggaggccacacagcacaaacaccagcatcctgcagtggccacctcccccgaagcggcctgtctggttcagggcggcctcccatggaaggtgctagcagttataaagcagttgtcaggagtcaggcactgatccaagcatttactcatttaatccgcacaacagccctatgtagcaggtatgtcactatccccatcatacagatgtggaaaccgagatagcctggcttacccgaggtcacactgtcagtaggcagaagagtcaggatttgatcacagactgcctggccccagaggtcatgcttgcagcctctctgccacactgtctccatgcagtgcctggcacaggccagactgcagtgaatgggaattagtcactgctgtgggtgcacagggccatacggcactctcatgacagtgagcgggccctcctataacctttgcctttccttccccagctggaaggatggtcttgccttcaatgccctgatccaccggcacagaccagagctgattgagtatgacaagctgaggaaggtgagtgtctccagctccccttgatggcccacagacgtgccctgtctgaccccctaactccgggtcaccatccccatgcccttccatcgccagcctccagatctgggttctgcacgcagatgggcagcctgggagagccttgtgcaggctctccgcaacccctggctcggtggctgactctcacctcccttattcccctcgtggactgtccagtctccctccatggcactgcaaccaacccggggttatttaagggcctggccagccatgctttataactccccttcctcaatcttctggattctagaacctcctctgcccaaaggggcagagggcaaggaattccaaaccatcaccacaagcccatgttgcccatgcagggtcctgctgtcatttgcctgtacaaagcctgtatggatccaggccctggccaccagaagctgccagcctcgtgggggaaggcaggacaaaaattgtgtccaaagcaaagcaccacaccaggccgtgtacatgtgctcaggctgaatggggtggcagggcatggggtcagatcagtgctgcggaggaggctagtgtaccccgagcgagcaggagccaggaaaggtcccggaagaagaggcagcttagagccagaggagggcttcctgggggaggcaccagatggcacccagcccgttccagccacagtgagcaagagagctgggccccggccagggagagttggagtgcagtgggctttagtcctgtaagcagtggggagcctgtgagggggctgggggacactttagggtggttgggacctgggacctctcggtttgctccccttacccagtccccagtgctctctcaggcctggcccacatcttccagtcaatgtgaaaaccaggttttagggcaaggggcttaagctagggtctgtgggtggctggaaattgtatgaaaagagtacacctgcatttttctggagaaaaagccctggtttgccccacaaagatttcacgaggcactcctgtgagtgggaattgaatttatccaggcggtgccctcccgctcacacatcacacgtggctgagaactgcctgaagaaacccccaaccctcgccctcccgggtctctccctctgggccagccctgcctccctcctgctcctgcaccctgccctgacggagttcttgttgtccccacttgcctccttctaggacgaccctgtcaccaacctgaacaatgccttcgaagtggctgagaaatacctcgacatccccaagatgctggatgcagagggtaagtcatctcttctgttcagccaccactgtgcttcctgatggccttttctgtccagggctggcctcgggcaaggggctgtgggcacatcagagctttgggtcaccttggggagctggcagagccagcaagaagggctgaatgattctgggtgaactggggacagccatgtcgccctgggagacagagcaagggtagcctgggctggccagatgccttcagggatgaagaagcgtatggggagggggagctgaaggatcaactctcctgagggtgcatctcctcagggcccaggaagggcaaggtggctgaggaggggtgcttcaggcttcctgcgagcaaccctggcctctccctccctacctgcagcaggcatggagtatggagcccgacaaagtggagtgttttgttttttccttttccggctttgctccatttcccagccatgcactgccccatttcctagccatgcactgccccagctgggacctgtgtctctggcctctggtggcccttggagttgactgtcctgctgctccttgaggccattctcagagagaggaagtggcctcattttaatccgcttcccacagccttgtcctttccagacccatgggagagggaggggctgagggtgtggctgagcccacccaagtcacgcgtcactctgcaggtccctctcccccaaggccgtggccttgggagcccgtggatcccagtgagtgacgcctccaccccccgccctactcgggcagtttaacccttgttgttcacttgcagacatcgtgaacacggcccggcccgacgagaaggccataatgacctatgtgtccagcttctaccatgccttttcaggagcgcagaaggtaccgagcagggccaggcaggccctcctcgccgccaccgcgcaatgccgccgctgcctctcgcctcccgtgctcacctcatttctcttgcagacggcagtggcctctctccaactggaagccacccccagctccctggcgttgctgccccctcagccttagctcacacacctattgggtacctcatctgtgccaggcttttccaggcattgaggatgccctggtgactgagtcagacaaggtccctgttctcagggcacttccatgctagtgggagaaacatacagcaggcctgtcacaggagtggaatagagaaaatggggccagatgggggacagagatggctggggtgaccttcagctggtgctgtcaatgtggaggggtgaagtgagcaggtacttgcagcaggagctgctagatgcaggctggggcacaggtgttccaggcagagggtgaagcactacgaaggccctgagacaggaagaagcttggcgtattcagggaccagctagagaggagtgagtgacacgcagtgatgggtcaggcccaacaagacccttgtggtgtgggataagaaattcatgttccactctgagggccatgggagccccttagggtcttactccgtggtgggagctgctcactcacattttcagacagatcatttagcaactgactcctccaacccaaaacaaagctgcctttatagggcccacagctagtctgtctccagcccaggccggttagaaaaggaatgcaccctattcggactccacaaaaccccgcaaggcatgtccacgcaggcctggggctggcttccagtccagagcaagtgctcttcctcctgcatgagcctcaggccggcccggccgccctccctgcgtctttcactctctcctgcctctctctctctttctctctctctctgtgcagatattgtgggcactctgaggccagatgagaaggccatcatgacttacgtgtcctgcttctaccacgctttctcgggggctcagaaggtgagctgggccaggcacacctcgctgctggggctgcagacctgccttcaccaccgcccttgcatcaccgctggccatctgtggttggagccctggccaggccgtgggccgccacaccacacagactgaccctgccggcctctgactcggaaggtcccctggggcaggtttcccgcctggccggtgctgggcctgtgctgaggagtcacagacctctgtttgaacacagcccaccctgggaggtgggtggtggcatcctaggctctcaggcggggaaactgaagccctgcattacagtcaatggcagagctgggatttgactgcccggcgttcccactcgccctgtccatcatctgcaccagggctgcctgcctgcccctgccaagcccttcgtggggagcactgggctttacccgttttgcagctccttcctgccaggaaaggctcagcatgtgcagcccaacctgcactcacggtcccagccctccagaggccaggcagagcccacagagcttgcgtggcagtggccgccctcctgggcccagctgacctcatgctgcctcacagctcctgccgggccctcagcgttcacgcagaggcccaagcactgctccccccgcttgccttgtggtctctgaagtatctcaggcagcattcccgatgcctgctttgaagtgtcagcagttggcacaggttcagaggaggaggcagaatcgattcttgtttactgaacatgtactacacgctaggcaccctccaaggccttcacatgcacaggcttccagagggtccctgtgcacacccccaggagggctaggcgcagttagccccatttgagagaggaggaattgaagtttagggaaacagctattcctaaaactagaaggggggggccgtaccttctgtggacccctgctttgagcctcccaactagcaggtgcattacctaccgtcagtctggcctggccccactctgccacctcttggtactgtgaccttgggtgggtcacttgacctcagcttccccacctgtgaaatgggcatcgctgtagttcggtctcacaggattgttctgggcgtgaaacgagctcctgcaggcaaagggcttagcacagtgcctggcacggcagctgccatttaggcagctgccagggagccacagtggtggggagtgtggttcttcccagcctcgggccagaaaggcctcttcacctcctcagcatgcgattggagcttgtgtttggagtgttctgctagagggcacgggccaggagggtggagggaggacccctgacccacactcccgcgggagggtgggcagggaccagcagcaatggacgattcgtcaccacagaccccaactaacagcatgtttgccattggactcacccctacgggccccgaaccagccccctgcccaccacatggcctcaccagattgcttttctttctacccacactgctcccctgtgcttagggctgaactccagtctggaggctctgagggattttgggggagcagggactggcaggcaagcccaggacagtatgggtgggtgctgaggcactgggcctggaggcttgtcactggcccctctctgagggggtagtggaggcccggctgcagggcgctggctggtcagaaaggaaagtgctgggtccctgtgtgctcctcaggacagccccgtggtgctgctcctgctgcctcgtttccccagagacccagtccaagctcttgcaagagtgctctctggggttcatgttttataaacgcagagtgaaccccaggtctagcgccagtgtgcccattctgtcctgagatcatttatttctagtcaccgaagcgttcccgcctcgttcctttattcactcactcattcagcaaccctgaacaccgccagtgcactgagccccaagctggatgcgggaactcagcggtgaaacatgattcccttgccttgcggcagccccgtgctcacagagaggacttgagtttcgggtgccagttgtctctgccaagttaggagtcagggactgacctctgtgacccccacaagctgcagccctggctgtgttttccacactggcctggggcccatgttcattggctgaggaacctcttggacctcatctctgaggagcaccgcctggggccctgggtgtgtgtcccgcagcatggcgcggggtgtgcacgtgcgtgtgtgcgctcacacgagcaccggctgccgcctccccgcctgtctccaggtgccatgtgtggaggggagaggctgggcgtcgctgcctgcagcactggctctgagccgttggccaagcctctccattttccttccccatcactctgtagaccctcctcactctttctgttcctgttctgttgccgtttcaactcctcctcttggaccctttctgtgcttcctgaaaggtacctggtctctctctccccgtgtgcaccccctgcctcctctacactgttcactgccccctagcaggacagggcaggacgctctcctgtagttcaggcccagggactatgtccaccactctcaccctccaaagccccagcacttttctgccccacggatggtgacttctgtcctctggagctcctattaacattgcctccaaggcaggagagtggacaggcctgagtgtgctcctgtgcacggaccactaggctcctccgggacccgggcgcccctgctctgttgcccccagctctccagctctcggcttcccatcctttcaccttcccaccgggagagactcctccgcagtcttaggtccaacgcagccgacccgtccagcctcaccctcctctgtgtggggcactagagggtttgcgagcagcagtgggagggctccccaaccctcctcggtgcctccagggtctgggctttctggacccaggggcattttgcagtcagcagtgaggatgccaacaaggcctattgggacagggcaccatctcactggagctgtgcttcctctccttcccctctgtgaggagttccgtgggccatggaccagctgctttcaagggacgtgcccgtcaggagggagggtggccagcccccaggcagccctgactgtgtgctcccctccaggctgaaactgccgccaaccggatctgtaaggtgctggctgtcaaccaagagaacgagcacctgatggaggactacgagaagctggccagcgacgtgagtgttcccccagtgaaagtcagggccacctcattatcctcagccagaggtcactgtgactcttgcagggggaaagcaggtgtggcagcgagatgacctagaaaaggctgcgtggtcacagaccatggcatttagccagctggtgtgtacacgacctctccgtttgcttccacaaggctaagggtcagaccggcagccaccttgccagccagcccctgggctcccgagcttgggttcctacagagatgctcagggacagtgtttcctgggcacctcagtgctttagaatcacctggggagctttgtgaaagcccctcttcccgtgccctggccctggagagagtgattcagaaggatggagaggggcctgggaaccaataggatagcaggccctgtgcaggtgcttaacgagcagcccagcaagacgggaactcggattatcctcctttccaagtgaggaaactgaggcccagggagggtcaggcacgtgcctgctgttacatgactagtgggacagagagctgggcttcacccaggcagccctgctctagagtccaaacccaatgcttcagttggaaataagggtggttagtacaactcttctggaggctcttcatttttgaaatctccatatttaaaaaataaacgtaggctgggcgcagtggctcacacctgtaatcgcagcattttgggaggccaaggcaggtggatcacttgaggtctggagttcaaaaccagcctggccaacatggtgaaaccttgtctctactgaaaatacaaaaattagccgggtgttgtggcacacacctgtagtcccagctacttgggaggctgaggcaggaggatcgcttgagcctgggaggcagaggttgcagtgagccaagattgcgccactgtactctagcctagcgacagagcaagactccattaaaataaaaataaaataaaataaaatttcccaaagagcagtggtttgactgctcatctagaaccagtggttcccagattttgcaatctcatagaccaggaaaatttgaaaaactattggatgtccaacctaagagggccagctttttattttgccaagttacggatgttttaaaaagaaacactaccatctgttaccaccagcacttctaacaccaagataaggtaaaaaggttattcttagaaccccagccattgccaagaaagggcagctggcagcacgcctcacaatgtatccacacagaggtatttctgtctttgaatttctcactttgccagaagttggcatttgggaaccacttctccagcttgtccgtgctggcagataactgattttgtacttctagaattgttttattatttttttgagatggagtttcactcttgtcacccaggctggagtgcaatggcacgaccttggctcactgcaacctctgcctcccaggttcaagcagttctcctgcctcagcctcccaagtagctgggattacaggcgcgcaccaccacgcccagctaatttttgtattttttttagtagagatggggtttcaccatgttggtcaggctgatcttgaactcctgacctcaggtgatccactcacctcagcctcccaaagtgctgggattacaggtgtgaaccagcgtgcctggcctagaattgttttagaatgtccaactgtttgttaccctttctcactccattaaagatctgagtagttcctaaaagaatatgtttgtttctttttcaattttattttctaatttatgtcccaggcccagtgcacatactggcctagccagactgagccaggtgggcttgtcggccttgcccttgaggcacttagtgagcccagaagcagtcaggctctcagcatggagctcagtgaagacagcggcagtggggcatgtgacagcatggaaagggacctttttggcgggggcatgggagtggaggtttcccctcttagacctgagggaaaagactaagagcaaaggcatgggccaggcatggtggctcacccctgtcatcccaccactttgggaggctaaagtgggattgcttgaagttcaggagctcaagaccagcctgggcagtatactgagacccccttctctataaaaacttaaaataaaaatcagccaggctcggaggtaggcacctgtagtcccaactacttgggagactgaggtggaaggatggcttcagcccgggaggttgctatgatcatgccacttcactccagcctgggtgacaaagcgtgaacctgtctttaaaaagaaaagcacaggcaggaacaggaagtaacaagagaacagtacagtgatgcagggacagggagggagcccacgctcccagagttccaggttgggggttctagcaggaatcgtggagaagttgggctggggagcaggggtaaccccctaaggtggggccctcaaagatccagatcccatgtgcccataagctggggggcagcccgtcagcactctgagggtcccccacaaaggccacgctggcttctgtggcccacagctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggtgagcaccaggattcacatgggagcagctgtgaggggcagaggcagccctagaactgcctgtgggcagtttggccagcgtaatctttcctaagttgttgatgtcctgtgggacatggcatggcctttcggatgcagtggtcggggaggggtgcacttcactcggcattgtgctcccctttggccctcactcactgtattttacacccagggttttatacgcatcccaaatccttgccacgggttgtgtgggtgtggagtggtgtgaatttggagccgtggtctgccatgatggcatgaccgccatgtgcttgaggcccttcatcagcggaggggcagtgcgccctggacggtaccacctccccatctatggtattcatccattcattcatgcactcacccgttcacgcattcattttgttaatccagaattgattgtacctgctgagtgctggggggccctgtgtaggcatccaggtataatagcaaagcatgacacagacatgaccccagccaagttctgccaccttcccatcagcatcccttggagacatccccctgggtgcctccacttccttgtgatagccctgcctgctcctgccctgccccaggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacggtacggcccagctctgccccactctgcccagccccgctcccgtgctcccctcctgtctctcaggcatgcatgggtgtgcacacacagccccctgccacgttgggtctgtttctcaggtgccctttcttgctgcttgggagcatgtgtgtgtgtcagaaatgctgctttagagccaggttcagtggctcacacctgtaatcccagcactttggcaggccaaggcaggaggatcacttgagcccaagagtttgagaccagcctgggcaacatagcgagaccctgcctatacaaaaaaattttagaataataaaattagccaggcatagtggtgcacacctgtggtcccagctactttggaggctgaggtgggaggattgattgagccagggaggtcaaggctgcagtgagccgtgattgtaccactgcactccagcctgggtgacagagcaagaccctgtctcaaaaaaaaaggaaagaaatgctgctttggattccttcagccccagaaagcagggaccattcaggggccaggtcctctttgttgcccagtctgccctcgcctcagaggtgggaccctgtcagtcatccaggaacacagccaagccccctccagcacttcagggaagtgaccttacacccatctgtttgtcccctctgcgtgtcttccccatccagggcgagtgtgtggggcaggcctcttccatcccccgcaccctgtgttcagagtcggcttccctctcccacacctctgtgagcgtggacggaaggctggggagcccatgttcactggcacgtccctcaggctagaggagggcctgcctcctgggcctgctgccggaccacagccagtgctcaccctcagacagtgctcacccactgccttcggcccacccttcagcatggcccacctgtgagctcctcccacctcccatcccttcccagagcctccttcccgggcctggctccccctgcaggagcgccactgtgctttctgttctcggcagccctgcagctgcctggccgttggctccagatgtgggatttcatcacgtccctggccctcttttgggtcatgccaaggttgagatttcagatcccaggggtctggaagccttcagaaagctgccagtgcctgggagagccacaagagccactcacaggactcctctcccactctggccaccaccttcccaacacagtctccctggccctccggccgccactccgcccagctgagcccttccttgcattcctgagtgcattttctcacccctccccaccctggcccgcatgcgagtgtgcagctccacacggcctgcagccctggccacggcccagcttgtgccctcctcacatgagctcagctcgccattcccgcggcagctgccagcctcagagcagcccagcccctttgctaccaggaaagagtgcgagtgagagagtggatagtgagggaggaagggcctggccaggccgggtgccgcacttccctcttgcctggcagaaaggcacccatgtgaggagagcgtgttagcaccgatgccatcttgtgtggttggtggcctccatccattcccggattcactcattcgttcaacagacagctcaggtggctccagccgtccttatccatggaggcctgggcgtcgccctgtggctgaaccttctgggggtctttctgcccacccatcagctcttcagtccctctacagggctccatgaggccctgcagatggtttcctgaggccaaggggctgggtgtggtggccccactggcattcctcccctgggaagggctctggggcagccttcacctgaggtgtttagaagccagctcagtctccggccagggcccagctggttcagcggcctccacacgtccctgccccacccctacctgactgggcatccacgcgggtctgcccatggcgtctgccagagcccccaggcaggctggcctactaattcccaagactcagagcctctgtcctctcaagtagcagttacgtgaaacaggacaggcaggccctccacaccccagggtctggtcgtagcggcctcctccgccctggggtgggtgggccaccttcactccacacccctcaccatcccccacagcccgcagcgggagggtcgtcgtggatgcttctctgagggacttgatttcctgggaatacgaccaaccccgaacgaccccttgtccccactccagttgtcccttggcctggatcccagatagctgtggcaatggtccgctgcccacatcctctcggtgcacccttgccaggactctgcggaggcagagggagatgtcacctgctgtttctggttcctgcccctgggagaaagcagttggagaagggaattgcaaggccgccttgtggctgagcctcctgccccagggctgcgcagcagggccggtggagccagagtctcccaggcctcccacttcttggccatcagtgccagagccgatcctgtggggagtctggtaggtgcctgacagttgagactgggagaggctgaggtgaggctggtactggctccatgcctgctgtgctcgaacaccacctcactgaaacttgagaatagttccatgccacacaggtactggggctggccccattttacagatgaaggcacaggcccagagaggcctcggtggctgcactgggcgggcagctgtcaggtgctgggacagagctgaggggatctccgctaccacttgggggaagcccaaggtggtgtgcctgaggcagggcccctgtaggagctggggtgcagccaccttcccaggctggcattttccctgcggttccctaaagaccttcacttgcttgcagggcttccttgagctttggttctgggatgtgtaattagccaggatcagggactaataacagcgttcctcctttcctttaaagggcctgatggtgggcccgccccaatgcacacaggacaccttaggacagcgtggggcacttagacgtggagaggaccaccacctgtgcgggtgcagggtcagggtcctagaagaagctggctctgatgcttccccttccccaagcctgctgggacatgggctttgaccccgggtgcttctccggatcaaagccctccagaaacaggtgctacctttctaagccgtgctaccacggcccgatttgtatggtttcctactaacaaaagttgctaagtttaggacacacaggttgagatggaatctctctctcaggctgagcaaccctgaagtgtccatccaggtccatccaggttacagttgggcttagagatccctggagggtacggaagaagattctggaagtttccatgccactgtcattggcatggaaggatgtggggtccacagtctctctttccctccctctgcttggacagcccctccagactcctgccccacagctgccgtgctgtggtctaagcgtctctctgctcctaccagggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaagtacgtgcgggctcaggacactatcatcacctggctctcaccacagcctgcccagactggtggcggcagcacgccgaggcccagcctgcctcaaggcctggaatagggtccccagtgccccaactgcacctccttccagaagccagggaagggccttatgggatgaggccttttgcccatcctgtctcagccccaggtgggacacctgaaggatttggattctctagcaggagggaggtgtctggccccttgtcttgattcttcaggctttaggggtccctgggggtgtcacctctcctggccaccccaagtaggccctggtcccctgatgggatgggccccagcctccgttgctcccagccataggtccctgagggaaccaggctgcacagtgagcctattgttctgctcggccccttccctttcttgctcagaatacacttattgtaagagcttccaggcagccgggctccttcccctccccacccagtcagataaacttgtgtacacaattagtacgctgagggtcgcgctggtgaatggggccttattccaccagtgcagcggccagcagcagggcgggcccaggcagcaggaggcccaggccattacttcatggaaaatccacaggccctcgaggggcagcagggctcccaaaatagccatctgctcaaaaataggatccttggctataactgctctttccaccgacacccccaccccaccacagtcacccccaaaggtctgcttattcctatgagtccaaggcccgtttattcctgagtccaaggcccagccctgatgccccagtggagccccatgctgggcagagctggtttcctccccgactcactacccactactgtccgggtgctttgagggttccccattggctcagccagaggcaagagtcccgtggggccatcacagcatttggcacagttggggcactccaggggtcctgccaccaccacgtccaggccaaggagagcaaggtcacagatgcagcaccctcgggggtgtgggggtgggacacaggcagcttccccagtgacggaagagcccctggaagctggtaggaaacagacttgaaataaaccctaggcttgcccccttctcaggccctgggcaaagctatgtgaaacccattactctgctcaggaacaggcggtccccgaagcagctctctggacggtagccctgaaggaacggaagggagggctgtccgggtcctgtcttttctgctgagggggaattacagaggcctgtggaccgtccaggatgagccggatgggcagccctgctgagcactgattaatggcgatagcaaaaactcactgagctctcagggctttatgtgtaccagctcatttaatccccacagcaactgtgtaactgagggaaccgaggcacagagaggccaagaggtttgcccagggtcacacagcaagggagtggttgagatgggaatggagcccaggcccccagccctactgtggagcacagcctcagcccctgtccgctgtctgtggctggctcgcctgctccccatgtcctgttcctccccagagtcgttccctgccccctacccctcctcaggccccaaggcctggttgaagggccacactcttagctgatagtggcagaatgagtcagggatgggtgagcaggaggaagccgcttcccttctcacccctggttatcacctgttaaccagctctgttatcaccccttcccttctaccctgggggtcccatgggccagaaccaagctgtgatttgattgaccaattagtgattggttgctgatatcctggaatgttgactgccccaacaccctggcctgggaaccttgggggtagatgggtccaatccatctagccacttgcccttgccgagtctcattgctctctgcccggcccgcagcgagctggattactacgactcccacaatgtcaacacccggtgccagaagatctgtgaccagtgggacgccctcggctctctgacacatagtcgcagggaagccctggaggtgaggagggggtgacatcacccacggagctctgtgcccctgctgccccggggctggtggtgtggatagtgtccagacctgtgagctccccccacctcccacggagaggatgttctctgactcctcagggccctctggacccctccccacccctcctgctcacatactgacctgccttccctctgtccctgcccccttccctcccacacactagaaaacagagaagcagctggaggccatcgaccagctgcacctggaatacgccaagcgcgcggcccccttcaacaactggatggagagcgccatggaggacctccaggacatgttcatcgtccataccatcgaggagattgaggttcgcaccccccggccccccatcttcccaagagcctctgtggggctgggccgccccctcactccagctcctcccctagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgggccggggccatccgtaggggctggggcaggacggcggggctgggggccacctccctgaccgctcccacaccgcgtctcctctgccaggtgcagcagctggtgccaaaacgggaccatgccctcctggaggagcagagcaagcagcagtccaacgagcacctgcgccgccagttcgccagccaggccaatgttgtggggccctggatccagaccaagatggaggtgaggcacggctgagccccacagagctgagaaggttccaagagagctcccgtagtgagggggtccccggccagcccagggcctgcagactgaggcgcctggcagagcaggtcccaattctcaccacccaggggccgtgatcaccctgcggggttaggagagtccacagagcttgcgcctggaatcccggcacctggggaggctgaggcgggcggatcgcttgagcccaggagttcgagaccagcctgggcaacatagtgagaccccaactctacaaaaaatacaaaaattagctgggcatgatggtgcgcagcccaaggaggtcgaggctgccgtgagctacgatcatgccactgcacttcagcctgacagcgagaccctgtggtctctagtgggctacctatgggaggtgggtttgatccctgaatgccctggtctgatgattgtgagactcaggcactattgaacctctgatcctgtcctcccagctctaaaatggggatgaaaacagttaccttattacttcaacaaatgctttttgcaccaactaaccagccacatgagtgctgtcattcttacagcagttctgaccaccactcactgagcactcactacataccaggcaaccaggctggcagcaggcaacctcgtttaaacccagcaagcctgagagggggtccgggtgccaggcaggtcagccctgaggttcatgccagccacgcagcatgtggacttgtgggtgccgagacatggagtgcccgaggtcaggagctgcagccaggccagggttcagatcccaactctgcctctaacagcactgagctgtcctccgtgagcctcggtttctacctctgcagtcagggcctgccacagccctggcctcacagagaggtcaagggtaaaatgaagttgggcacagggagcgcttggcagagaaaacctccctgtcattgtcatagctgctttaacatgagagggcaggaccggaggggacagttgtgagcagtgggccttccctcccagggacccatgggccaaggccccaggccaaaggggccccggggaagatgcaggccagcagcgcgagtgggctcctccaggtggtcagtgggggcaggcccaccagcctcaccccaccgcctgcacccacccccgtaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggaggtgcgcggctgccccgcccgctggcctttccaccagcatggccggcttcctcactggaaatggttcgggccagtgagaagatagctgtctgctgtctgttgtttttcactctgtttaaaaattattgaagagaccagcactttgggaggccaagtgggaggatggcttgagcccaggagttcaagaccagcctgggcaacatagcaagaccctgtctctacaaaaaatgaaaatattagccaggcatggtggtgcatgcctatagtcccagctccccaggaggttgaggtgggcagattgcttgagccagggaggcagaggttgaggtgagccgaggtcatgccaccacacttcggtctgggtgacagagccagactctgtctcaaaaaaaaaaaaaaaaaagattgaaaagactagatcaaaatgtttagacatttttaaaaattacactttccctagcactgctctcatcaccatgacaatgcccctcacaggacaagctgttctaggggcccacagagggcaccgtttgccctgtggccttagcagtatcagccttgctcagggccagagccagccagcgggtgccgggtcagggcagcagctcccactggctaacactccggggacattacaagctggtcgccgtcatattggtagcttgagaaaccaaaagactggacactcttgatccaacccatacaggtccacagatgcttcaaaccagagttggcttttttgtttttttcccctgagagccagtggtgagacactgaccagagtttgtccaaacagtctccacagggatcccggcacaagattcatgggtccttgcccttctgctgcccctgtagctgggaaacacacttactgtggagacagacattggcagaggcagcagggaggcaccatggcccgtgtcccctgtgaggtgtacaggagagcaggggctttccccagggcgggaggacagttcacagtcctccacgtgtgaaccacggtgaggacagttcacagcacccggcccacgatcacgcccccgtctttccgcagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggtgagcagcctgccacctcctcggcctctcccctcccgccgttgccgtaccagcccacaccttcgtctctgcatctgttcgtccattcccatcacagttgctgagcgtcggccgccactcccagggccagcagggccctgccactgtcagggtgtaggtgtgcggcaccaagaccccagcctgggccacttcacacgcacaggcagggggccggaggtcccaagtcctgccttctggggtggcatcctcaccacccccagggcagatgaagtctcagcacacccaggctttgcgacccggtctgtgaacctggacacagacaccccgcacagtgcttttagaattcagatttggtccggcagcctcatcagaggggccctgagcgccagagtttgctgccatccccagcccacccctgccgggctgacggactgagaagtgtgcagcctcagctctgcacctggcgcccccaggacaggatacagtcccctctgtcccactccaaatcccaaaggcaaggagaaccccccccccgaccctccaccagtcctgggacttgtcctcagttctgtagcatccagctgccacccctgctgtgggcagagaggtcggggaggcctctgccttcctttgagcttccgaggttggggaaaggatgaaaggggcccgtgccgcccccgaccccacgtgtccctggccatctccttgtccatgttgcctctaactctgtgtttccctcccctacgtgtcccttccccctgccctctgcatgtgaccccgatccctcatcctggtctccacgccgcccctcccgcacacctgccttcggatggccccggcaggatcatggcggggcgctggggcccgaggagttcaaggcctgcctcatcagcctgggctacgacgtggagaacgaccggcaggtactgcaccctgggccccagcggaccatggcattaactgctctctctctctctctccttctctctttctcccctcgccatcccacccctgccatcctgtgtgccatctcatggctctcttgcctccctgcccacatctccctggaccccttcccttttacctggtctcttggggccgctgtctccctgctccccgccactgtcctgtctgcctgctgtgcacatggggcggcccctcttgcctactctgggcccggcctcctctgctatgcctgcgtcctcggagcagaagcagacaggcagcatggactccgatgacttcagggctctgcttatctccacaggatacagcctggtatgcagctctgtctccccagccacccgctcctcctcctcctcctcctcctcctcctcctcctcctcccccccacctctccccctcaccgcctccagagcttcctcgtcctcggggacactcctccgcccgagcagcgcagccgtgcctgcctcttcctctgctgcatctgccggggtggggtccctccgatgacttcccgagccccccttcttccctagaagtctccagaaagagggggcagctctcccactctctcccctttttctttctctttctctctttcttccccatcctccagagcttactcgtgagcctgggctgagggcagtagaccccagttccctgctgtgggagaccacgagaggggagggtgcagagaggccctgcttcccggcctggggcactgggggcttggaggcctgggtcagctggagcagtggcaggctctgcccggggccaaggctgctggagcaggcggggaacagggcgcacgcacacgtgggttgggccctactctctcggctgtttccctggagaccccaccagtgtgggcctggctgcccctgccccactaaatgtcgggtgtcccccaccccaccctctccttgcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaaggtgagcgagacccctacgaggtgcatgggggctggcgagaggggtccctgcagtgggaggggctgagggggccagtgtgtgggtggggatggctcagagtcccatcctgcctgccccagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaagg

SEQ ID NO: 35605 - DNA, 20799 bp, Homo sapiens
agggagggggtggaaaggagggagaaaaggcagaggcgtcaagggaggccggagggagagtggggtggacagaggagcggagggacgagagggaagcgcacgatagctgcgcggagagagagcgaagagcaggcggaggaacaaaggcgacccaagacacccagagagggacaggtaaggaggggcaggtgagcaggaaggaggagagaaccgggctagggagactgcggaaaggagaagtggcgggcgtgaggaaactgctgtggataagggacgagtaagatggaaagaatggcggaagacgaacgaccgcagagtgagggtccttccaagagcgaccaggggggaggaactggggctgttgcgcccttaaggttgctaaggcgacggttctggccagagcgaggcgcattgacgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggtgagtggggtcggccgggggctcaggcgaggtgagcttcgtcgcttcgcagccggtttgcgggagctggaccgatccaagatggcgtcacggggagcgacctgcagggggacggccgcaccccctgcccctccccggcccggcgggcgcctccccgcaggcctcacgcccccggctccgagtctgcatcctcaaggccgtctgggcgttggctttggtgcggggctccccagccgccccgctcgcgctcgctgcccccaccccacggctcctggggccctgggccctccgcggccctccccggccgccttcgcccccgcgcgccgcggcctcttcgctcaccctcccccatttcctgaaggacaacggctctattttactggggtccgccatcgtctcgtccgccggtcctggctcttcttgtaagccggtagttttcctctccacttttgacgactcgtcattgctagcagtagcctttcctcttcatagcggagtgatctttcccccaacacgacggtcttagtcgggctcctgaatttcctcttgtcccctttcacctctctccctttcccaattttgcccccctgaggcctcctcgccaccactgtggccttccgactggcgtagcttgaagtctcggcttcccttcattttgtggtcatgaccgtggcctacgtgaagtgaagggcattttcctgcccttcttctagaaaatacacggtacctattaacctcttcagctcagagcctgtggtgacgaccgtcctactccttgagagattcccaagagatccgtctttttagcagagcgaggaaagcaaacacttactcaagatgaccctaggggagccgtaacttggctggtctaagggggtgcggtctgaatcaggaacagtttctcaaagtgtttttatttatttcccagaatgtaatcctttcgaaacaattttgtcacaactgaattttcaaaagaatgaatctgagtgttttgttttacatagagacaatgcagcgaaagttttaaagcagttaaataattgtgtgtggggagggaaggctaggttgttgggctttacaaataagtacacatagagaatccgggtaactcgattaaaaatattaagactgtgaagtctggttattcagggatttacatggtgactgcattaattttggtacatttctgttcgtatactgtcctattaccggtggctatctttttggttttcgtaatacattagttgtttcaaacaaaaacacagtttcactccttaggcccagttctctcatctctaccagccaaagacctgatcttagaatgattgatcatttgaatgttcttaaaatatgacaatgctttgaagcatgaaagatctgatttatgattgttcttggtggcctttaagtattatttgaaatgcagacaattctactgaagtggatcttcagttcatatgattgcctgacctggagaagtggcttgtataaatctatcctaaagtaaatgcgcgtttttgtttttgttttgcctgtttaaagtagcagcatgattatttttccatggcttctaatttatgtgcttgtcttggagccacgaactttctaatggtctgttaattagtctacttgttgttgacctttatggtgaaagttgtcaaaacaaaatgagtaacagtgtagcactttagaatagctctttactctgttaattctttctataagttcttttaaatttacagtttcatctcaatagtttacaatgcattataattggaaaagtctgattagtattgaattcagttgctgagtggaggggaccacactcttgtcttctactcttaagtgcttagtaattaggagttggaaggaaaacagtatatgaccctgttgttaaattagtaaacttttaattctagggtaaggttagctgctcatcattatctctgtttgctttactttacataaaggtaccataattcgaatcctctaaaatccattaaatgcaatttatccattaaatgtaatccattaaatgcaatttatctattgaatcttcatgcaagtttgaaacttaagtgttttaacattctcctgtcaagatgaagaaaatattttgacaattttctgtccaaatgttttacagtttatgtggtaagaattctcccctcccccaactaaggattttccttcttttaccactagtgtattatcatttaggggtggaatctggcaaacgagtctggaataaaggttgcttttaaaactcatctaattttcttgtgtgtttttaaaaattttgattatgctagtagttggctaatcagatcctcactccagtggtttgctctgtgacgttaggatactcccatgggatagaagttacgtatagggaatgtcagatattcttcattgtgctgacttgctttcgcttacagttgacttttgtgccctggtaattctgtatcctgtttaccgtttacctacttcccacgtcatcatgatttcttttgagggagaactgaatgaaattcccttaagggcctgacttcagcacccgtctctgcagaggttagtggctcatacttcctcccaggagctgaggttatcgactctcactgttgcctacagagcacagatcctgaactaaatgaaacatttacttggaataatgctaattctgtacatattttattccctagtccccacttccctgtttaaaaacaaaatctacttagaaaaaaatccctgtgaatcagttgtctaatgaatttagcaagttaaatgccagattgacattttgctttatagtttatacaagcatgtgtgtgtttttttctcgcagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggtaaaaataaatgtggggagatgatgaggtgattgtgacagttgttacatttaataactggaatgttactaatttgtattttttggaagaaaaggaatctgactaaataaaaagtctaaaacaatttcaaataagaaatacagttaaggcatttgtagtaatttaaaaattcttaattagtagaatttatcagaaaaatgaacctgtatgctaactgtacttggctaataaagggtttccaaacaattctttgtaactttttaaattagtgcgtagaactataacagataaaactgatcagaactagtatagcagttctatgaataagaaattctatagttcttaaaggcagttaatgctcctcccgttttgaacaaagcaagtaagcgtagtaaatcttatcccacttttaaaactagtgtaatgaaacatgaatctagcttgtgactgatatatcagaaattttcaattagattcggtctattttagtatagagtatatctgataaattactgtagagatattgatattgatgttcctcaaaaattttactccattttattggtcaggacttgttgcgccttgaaaaaaattaatccaatttttattcttttttgctcttcctccttgcttgtatgtcattgtgacctacgtatatggcatatgtttttctaagcaaagtgataattttacatcagggataattgaagcaaatgaatgcttcaattcatctccctcaagaaacgatgaatgaaaaagtctgggttaccaaatattttgaatagtttatgtgattcgcttctgtaaatcagtgagagaaacttactgattttcttgtgcatgtggaagttatgaggtggttcataatgattatgaattaattgaaatgaatcatataccaaaagaaatgattcatataccaaaagaaatgaatcatttcttttggtatatgattatctaattgtataatagaaataatttgctttattttccattggtttttatagtttcttataatcagtatagtttattagtaaaagaatctgtactaagctttaaaaagtatttgggtagctcattgatcaggtattttctattttctttaaaaactgattgttaaaatttgtatttagtaccatgatcagaataattaaaaaaaaaacaaaaacaactagtcactgtgaatgttgctttgctgtcttggaattatagtagatattctggctttctcttatttatgcaatttccaaatcatggaagtattgtagagccaggtcatagatgtagcttgttttgaagtcaagtgcattcctggagatccggttttgaaatgggtcactgtaaggtgatccctcttctttggacatcaatagaaaccatcaaatgagaggattaagttggtgagacattaagtgtgtatctttttatagggagtgttgaatgtgtgatgctagtttcaaagcttgtagttgccacagtactgtttaaagactaacaaaggtggaaagcaataaataattattaaaatggtttctttgcagatggaatttttagatttaatgtgtttcagcttctttaacttttaataattaaagtcacagttcaacatggtttttgctgtaattcaagggtctttgttcacatgtatacattccttccagggttgaatatagatacctggacctttaagtaattagattttcaacttgttagtgggtcatagttctgtgtattaggtgttaatttgtatgttagtctattagtccgttgtcatgctgctaataaagacataccgaggctgggtaattcataaaggaaagaggtttaattgactcacaattcagcatggctggggaggcctcaggaaacttacaatcatggcagaaggagaagcaaacccatcctcttcacatggcagcagcaaggagaagtacagagcaaaatgggaaaagtcccttatgaaaccgtcagctatcgtgaggactcactcactatcatgataacagcatgagggtaacccccctgccatgattaagttacctcccaccaggtccctctcagggcacatagggattatgggaactgcaattcaagatgagatttgggtgtggacacagccaaaccatatcattccacctctggcccctcccagatctcatgttttcacattttgaaacacagtcatgcctttccaacagtccctcagagtcttaactcattccagcattaactcaaaagttcaagtccaaagtctcatctgaggcaaggcaagtcccttccacctatgagcctgtaaaatcagaagcaagttagttacttcctggggtcattgggtagataacacccattccaaatgggagaacttggtcaaaacaaggggagtatagaccccgtgcaaatccgaaatccaacgaggcagtaattaaatcttaaagttgcaaaaggatctcctttgactccatgtctcacattcagggcacactgatgcaagaggtgggctcccgtggccttgggcagctccgcccctgtggctttgcagggtacagcccccctcctggctgcttccatgggcaggcattgagagtctgttgcttttccaggtgcatggtgcaatctgttggtggatctaccattctggagtctggaggatagtggccctcttctcgtagttccattaggcagtgctgcagtggggactcggtgtgggggctccaaacgaccccacatttcccttccgcactgccctagcagaggttctccaggagggccacgcccctgcagcaaacttctgtctgggcatccaggcatttctgtacatcttctgaaatctagggggaggttcccaaacctcagttcttgacttctgtgcacccacaggcccagcaccacttgtaagccaccagggcttggggcttgcactctctgaagtaatggccagagctgtaccttttagccaagactggagctgaagcagctggaacgcagggtaccatgtcctgaggctgcatagtacaggagccccagggcatggcctaggaaaccattttcccctcctaggcctctgggcctatgatgggaggggctgtcctgaaggtctgtgacatgccctggagacattttccccattgtcttggtgattaacatttggctccttgttacttatgtgaatttctgcggcaggcttgaatttctccccagaaaatgggattttcttttctattgctttgtcaggctgcaaatttttcaagctctgcttcctcttgaatgctttcctgcttagaaatttcttccaccggataccctaaatcatttctctcaagttcaaagttccacagatttctagggcagggccaaaatactgccagtctctttgcatagcgagagtcacctttactccagttctcaagttcctcatctccatctgagaccaccttagcctggacttcattgtccatattactatcagcattttggtcaaagccgtacaagaaatctctaggaagttccaaactttcccacattttcctgtcttcttctgagccctccagactgttccaccctcttcctgttacccagttccaaagttgcttctgcatttttgggtatccttgtaacagcaccccacgctctgtgtaccattttactgtattagtctgttctcatgctgctaataaaagacatacccaagactgggtaatttataaaggaaagtggtttgactcacagttcctcatggctgggcaggcctcgggaagctacaatcatggcagaaggggaagcaaacacattcttcttcacatggcagcagcaaggagaagggtcaagcaaaagggggaaaagcccctcaaaactgtcagatgtcatgagagctcactatcaccagaacagcatggaggtaaccacccctgtgattaaattacctcccaccaggtccctcccacaatatgtggggattatgggaactataattcaagatgagatttgggtggggacacagccaaaccatatcagtctgaaaatacagtcatattctcatcaccttcttcgtcattactggggggttgtgtttctgttaccttcaactactccataagaaatgtaccaaaaactcttgacagttggtcttttgaaagcttctgcattttaattcagtcatctggaatttgagtcttcttttactcttgtatttattagacccttaggtaagaggaattaaaataacagtgaccttgtgtctgctgtgtcaggtactgtgtgaagcactttatatacataaatactcgttatttcaaatgtacgaggtatgtgattttcagcattttatagacatagcagtaaaactgagagaaattaagtaatgtggctgtggttatagactgtagtcgtcagcttttgctggagcaacatacaacccccaaatttcagtggttactacaacagaccagtcatgtgcagttcttctggtatcagcctgtcttatgttcttgacaccacatatcttgttctggggctgagcagaaggagcagccctatatagggcatgctgttctcaaagcagagggagggcagaagctcaaggtggacagagccaaaccacacaggcaaccatggtatggcatgtccacttacattccatggccagagcaagtcctgtagccaagccttaagtcagtggggtgggaagtatactttacccacagggaagagtgacagaagcagggagggaacaaataatcgggaaaacatagtagtggggacagaatttgaacctaagagtcaagaagatagtgcagaatttaatgcaaaaccgaatgcagaatttgaacctcagagtcaagaacataattaaccactgagtagactgggaggttttttctaatttttaattttttattgatatataacatttgtatgtttttatggagtacatgtgatattttacaggcatagaatgtgtaatgatcacgtcaaggtatttaggttattcatcacctcacttaaagagctgaggaggaaggagactgacagaaggatgacaacagcaagagaaaggatataaaaatatatcatagtatatactagaaaactcatgatctgagtaatggctctgagttgtcagattaggttatattcagattgctgtttttaaaagactcactagaatccatgagacactgctaaaatcagaatgcttttgttacttcaaaattaatcttaaaaattcagtgaagtagaatgtagtcccaagtgaaatgttatttgtgaaatttttcctgaaatttttgtgaaatgtcagtgacaaatttgggggtgggagaatttgtgttttcatttatactcttaaactgtgtgtgtgttttattttatttttattattatttttttgagacagtcttgctctgtcacccaggctggactgcagtggtgcaatctcggctcactgcaacctctgcctcctgggttcaggcgattctcctgcctctgcctcctgagtagctggggctacaggtgcctgccaccacacctggctaatttttgtatttttagtagagatggggtttcaccataatggccagtctggtcttgaactcctgaccttgtggtctgcccaccttggcctcccgaagtgttgggattacaggtgtgagccaccatgcctggcctattttttgagacaggatctcactctgttgcccaggcctgagtgcagtggtgcgatcatggctcactgcagtctctaccttccaggctcaggtgatcctcctgcctcagcttcccaagtagctgggactacaggtgtgtgccaccacgcccaactaatttttatgtgtttttgtagagatgaggttttacaatgttgcctaggcgggtctcgaactcctggactcaagtgatctgccaccttcggcctcccaaagggttgtgattataggcgtaagccactgtacccagtcatgtattcttaaactttaaacttgggagagacttgagttttatacctgtgttaatatgaaatgagaaaaccttactggttattggaacaaccagaattaacatgaaatgagttttctaaaaaccatattttaaaaagtaggttacatattcacatatttcaaagttgtgcaggtacaaaggggcataataatgaaaggtctccctcccacgccattgcttttcttgaatgctgccaatgttctggagattaatatatgggcacttacaaatttatatatagaaaagaaataacgggtcaaatgaatgagaaagtagaagataacacatttttattttttcccttttacttcaggcacaacaactaattctttagatctgagaggaatttgtttttaaggctctagatgtgaaaaaaggaatgtttaatagtttatcttaggttttatttgaattggtccaataagtagtttttaaaagcaagtaaactctttttgtcttttaacttcaagtttaaaccttgattacaaagagtgatcctagctctgctgggagaagtattatagatacgatctcgtttaaattcgtggttaccatcacatcatttcattatttgtttttatctgggatcaaactggaatgtgaattccacaggctcaggaccctctcctatttgtttttaatttcctgttgcctagcataggtcttggcctggcagatccagaaaatggcttattgagttaatgaaataactcagtaatctagacattcttggatcactatgttgggcttgaattgtttttcctgataacatttcttttggcaggagggtctcttgctatctgcagtagcatccaaaaaaacccaattttcaggattttgtcttgcagtgtgttactgttgtgtgcatcacagataattgttgtcaagacattaatgaatatctgatttgttactcacatgttatgtgagtactaatggcttgtactaatgacttttgcccattaataaaggatagcatctgttatcatctgaggtacattctgttgagagtgtttcaagtgttactctctttttttcccctttggaattggtgttttcctcttaacttacattgttaatggaagaagagattggaagtgactgagatagactatcattggaacatgagagtgccagctttacatgccgaaggatctcattttgcaaactcgtaatttctttcaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggtagttttgatatttgaatatcggggggatgcttttgggacccacttggtggtcatctagtctcctttgatgaatgaatcataaaatacaaaacagggtggaacttcatccatcctgtacaattcttgggtactggaaaacaggtttctgtaatagcatgctgtcagaggaaataactaatagtgattatgaactagtgaataattgcattttggggtttgttatttccttgcagttgttttgcagtagaaggaggtgggcggtattgctttttctcttgaatcgtgatgtcctttttttgctatcctattaaatgttgtggcttttaaccttttattctacgagcctcatttgtcctgtgttctcctcttcctcagagccaggctattttgagttatgctgttagccttaaaggggaacagaattgtcctggcacttgaggcttgtgaagctaacagatcacagatttttaaaatgactaattattataaaatacttagttttgcctcagaataatgaccttggtccaggtgttttgatttgtttctttagttgttaactgggaaccaagtaccagactttatatttaggcctggctgtaggcaaggggattaattagtcaatacttgttgagtagtttatggatcaaagatagtacaagtgtgttgtagtgaaacactacaaagcagtcttgtttaaataccataatgtggcttgacatttaattgaagcgcaggttgcaaacgtgaaatgtttttggtttatggaattgtcatttgaccttcagttcttttctaggttataccaaaagattacaagacaatggccgctttagccaaagccattgaaaagaatgtgctgttttcacatcttgatgataatgagagaaggtaggaacaggctctttcttaacactatttttcaagtaagggtgtgatcccaaattgttttcaacacttgttgcaagttttagagctcttagtaattgttcaccagatgacagtctggggtctttaattctaagcttaatgtttgaaattcacggaagagacatgtgaaatgtaacacgaggccttctctcttttgcagtgatatttttgatgccatgttttcggtctcctttatcgcaggagagactgtgattcagcaaggtaagggcctctggagcatgcaatattgttacgggagaggaggcgagactagaggatttttttggttttgttttattgaagtttgttttcctctttgatcctaccacttttttttttctgttatactattggatttttctatttcttttaaattaagattttctgagatggacagaacactttgtattgggaactaatatttttgatacagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctaggacttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataactacacatatgtagcttttaaaaatttttttcagaggtattcttcaccatgagatgactaaaaaaattttgattaattctatgacttttaaaatatgttgcttgattttctttcccctgaaagattgtgttagtttgtaacacactctcacagtaccactgtaaaataagtttattgttttgtaataattttgataatttctttctttaatttggaatatgcttctaacttttttaccctcttttaggtgatgaaggggataacttctatgtgattgatcaaggagagacggatgtaagatttaccaatatcaaaaatatgttgatcttaaaagccaatgtattgatcgcttccgagcaataagaatagtgattttgaagggtcattacatcccttgtatgtcagattttattaataccttttgccaagtatttttatgacacagagaaactctttaaaggtaattttctgttcagaactttgctggagtggtggtgaagaagtgtgtgtagctgggtgcagtggccgatgcctataatcccagcactttgggagatggaggcaagagggttgcttgagcccaggagttcaagaccagcctgggcaacaaagtgaaacctcatctcttaaaaaaaaaaaaaaaaaaagattctagacccagccattagctagcaaaattaatatacctttcttattcacaaatgaaatggggacaataatagcattgatcttttaggattattagaagattcagtgacctaatgcaagtaaaatgtttagcatagtgctcagcacggttctctaagtatctgtgactggtattagtgcttagctgacctttttcccttacatccttacagagtgcttttttcttatcagataattaaatcaggtaaattatagacactcttaactcatttaactcgtcagaaatcacctattcttctctgttgtgtactgcaaacataatatattctgttttttaaaacaaagttcaggattgtgaccttttaaaaaggtttgagggtttttaacatttaagtgtttgtatctagaaaataaacttttttgatgtcacttgcactttaggtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatggtaagagaccatggtgtttgagagtgtgatttagaattctcatctacgtaactaatgtttgaatattaccaaattaaaaagagaatatttcttttaatgagcaaatatttctttcttttaataagcgaatatttttcttttaatgagcaaatactttgcattaagcccagcttagcattattcattatgccattttaggcagtgatattttagaacaaaaccttgggaaacaagatctggtatatatgtgctggtcatctcatgtttggaaatctatccatttgctggtaggcacatcttaatttacctagttatacccattacagcatgataggtgctgcttttaagtgcttaaagttatttggggccattcagaaataatcagcttccctaacctgtgaaagtgggttatcagtaatgtatatgtatgtcatgtcccctctcgttaaaggaataaacaaaatactaaaaccattggaactttctggtgatagtcagattttttgagaacgttgtgataaatttataggatagctttggatgtttaagtctcagccaatgcattggtcatttttaatggttttcttaaatttgtgcagtgtccatctgaccatttgaaaatgtacagcctgatgtactttgaaatttttctgcatttgggatatatagatagattagattagatagatagtcttgtccttcgcagcaacatagatagagctggaggccatttttctaagcaaaataacacaggaacagaaaaccaaaccacatgttctcacttacagttgggagctaagcaatgagaacacgtggatactagaaggggaacaacaaacactggggcctacttgagggtggagggtgggaagagggagaggatcaggaaaaatacctgtggtgtactttacttattacctgggcaacaaaattacctgaacaccaaacccctgtgacacccagtttacctatataacctgcacatgtacccctgaaccttaaacccacacacacaaaaaaacgcttatggcaaagataagtctaaattttagaaagattggttttgaagtgatgtgacagtctactggagaagaaactgaccatacagttagttctgcatttcctctacaggaatactattagtaaaaggaaacatagaatgtttacagctttatctcattgtcaaagaaggaagaggtaggacctggaactattggtttgaaataaaatattttactttctcatagtgggcctgaaaggaaattagggcctcacaatgctttggctttgtggacaggaattaggaactgtagatatggggtgaaatatctatatagctgggtaggggaggatatggtcctttttttatagaataaagacatgtcaattgtataggtgagaagccagaactaatggaggaatctgcatttaaataccagcgttgaacaggaagaacactaggattattgggttgtaaatgacctagattacttttgtgagaaaatattttcagagataaattgggttggcagtggcacaaaatcagtttgagagtaaacatggaaattggacattggtttaaagtgtgtggaaaaatatcttgagtgataggctcaggtataaaccggtatttcgactgtatttggaagttgggaaatgctttgtgaaatatgtcaacatactggttgcaaatgctaggaattgggcataatattggcggaaaataaaaatcacaagaatgtcatatcattcattacctgtaaaataaaaatgaattagttaaaattaaactttcctcattaaaagcaacaagctttgactttctggttttaaaatttatttgaaacttaatatttattattccatagcattatgtggtgataattacacgtcttggggatatcacttttgttatttttatttttagggaagcacactgagaaagcggaagatgtatgaggaattccttagtaaagtctctattttaggtgagttgtaaagtgtgttaactttgctagtatgtgagatacccctgaattagaattggatggacttgggaaaagccttctgaaagtataattgctactcattccccctgaaaagacagaagggctgaaagtccttctgactgtggacattcacagttatttcctctgtgacttcccgtctctcttgttccatcattgagttgattggttcagaaaagtgagtacttccaacaatacatttcctctgtggaaagattaggtatcatttgctggcatcctctgaaaacatgccagaagtttgttgaaatttagagtaaagcagattaattgaagatattcttttgtgcattttgttatgtggacttggagatgttagaacttgttcttcatgaaaggggaatggggatttttataaggtaacaggcttctgccattgtttattacagtgaatttttcacctcttctttgtcttttctttgaattggttacatatgctttgtgttttggatagtagtttggcctttgggaataaaagttattttctagttctttttcataaagtaaaccaagaatttaaatagattaaattatttctatgaaactttggaacgatatggatggggaaactatgacttttgagtattgtagttgtaggtttgatttgcattgatggcaatcttcaggaatacttaaggattacattttcttattcccttgccatttggtacagttggtataaattaacctagccactgggctaccgaagtaaggatctaagggctatctgcaggcagtatgagaatcctgctcagactagaggtaattgaagacaggtaccacttttaatctgagacactactagaatgttgaatgggcatggctatttggttgaatctctttatactttctttttacctttataacagcaccaaataatacagagcagttattttgattcttgtctttcagagtctctggacaagtgggaacgtcttacggtagctgatgcattggaaccagtgcagtttgaagatgggcagaagattgtggtgcagggagaaccaggggatgagttcttcattattttagaggtaaagaactcagaatttaatacttgaattttagaggtaaagaactcagaatttaatactttaaaaagttgtacgctctaagagggaaagagtgggctaattctgaactatagctttagtttttaagaatacctgaccattttattttaaaattatcttttactttgaaatgctgttgtttggttttctgccaggtcactatatttttaaatgagtttgagtcagaattcttgaagggccctagacatgaaaagccaaattctaaaaaccatttaacataacaaactgtgatgattctgcactattcttgttaaaatgcaagtgtttgggctatttggcaaataaggattaaaggtaattatttaaatttgaaaaattactgtgtttgtatatctccacattccatggaaatgtatagcagatactcttgctaagcggatccaagtggcagatttctatgaatgtggctccatagttgctaattgattttatttaaatcaggggtcaggagactgtaaagggccaggtggtaagtaagttaagctttgtggaccatagggtttcattcgcaaagtctcaactcttgtcatagtgcaaaagcagccacaaataatatgtaaatgaatgtatgtggtatttcagtaaagtttgatttgcgaaagagacagtgagcttggatttagcccttcatctacagtttgctaacccaagtgtgcaccctttaagcaccttagcttgatacgaagaacctcgctagcaggagatgctggtaaaatagaaattgaagctcatgtggtgactaactttaaagtcattttttatcatatgcacacatttgcaaggtagttaaaattgcataggatgtttaaggtgccaccctgggtttgagagtgtgtgtttgtttagctttttggtgattttattataggggtcagctgctgtgctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattctt

SEQ ID NO: 35606 - DNA, 44935 bp, Homo sapiens
ccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactggtgggtacctgcccggagagcgcgggctgcggggctcgcgggacagggagggaccgtcctcctctggacgactgggagactcgggtcccgaaggtggaaaggtttttttgccccaggtcccgaaagaacttcccggccgcgctgggagcaggaccgggtgtcctgacgcgtgcggggacaggttggcccctgtcctgcgaacagggactcggtcgtacctttctcccctcccgcgagcccgggcgggtggtcagagggggcgtcgggcccgcgcggggctgtcccctgcctgctggacacggctgcagccgcctttgtcccagcccgcgaatgggaggtcaggcgaggtggggctgcgaccacaaaacccaacctctccaaccgtaatcaaagtaaaagaggaaaggagcggggccccggtcctgtctggtggccgagtggtgctcggggctccgcagtctctaccggctcacccccaatccccagtaaccccgagaccacgactgcaacgactcctggactcctcggccacccaaggacgtttgtatcaaggctgcgcgtcccggcggcgcggggtcctgtcccgaggaggcgcttcggcttcccctgtccgggaaacgaaacttccccgccggggcggctgccgggcccgggtctcgaagttcggccgggacgtgcctgttaccttcggtcgtccgcgccgcagcccccgcgggcgagcgcacctggggccctgcctctgagccttttgtttcctcctttttaaaaacaccggatgaaagaccccagtgtgccttggatcgcagagcgccggccgcatgtctgctttgatccagaatgtgtgggcaggggagtgggggggtgggagaggacgacgctgggggcccgccctggcctaggcgccccgggaagaccccccggtgagagggtcagcttctccggatcccagcggaaacagaccgagggcgtcatttgggtgggtggggaagagatcctgtccctgctttgaccgggtctcgggagctggactctagatgcccacgtgagccgtgcgcgttttgcagcccgccccacctccccgccccctgctagttgttcccacgtcgggcttttgggaaagaggccctgagcgccgggacgttatttaccaggcgttgtggccctaggcctgggaggagcaacctgaatgcgctccagggagttttgttttgcaagcagttttgaaggcagggactactcgagttgcaacctgttttctgcttagattcatttatttatttatggggcatcctgaaaatctattttcgcttttttttttttttttttttttgagttagcaaagaattgtctcaatcttggagttctttgtttcctgaacaaaatgtgtctggggatttccagggaaaatgtgccaagcaatagaaggaatgaaaacttgggttttcattacatttgttttaaaattttgccagccatttaaatctgaaatttaaattttctcccgcagtcctccaggatttgagatgcacatcctttaaatgtgtgggttacacacagtttaaatccaagtcagaatagaatgcgaaggactctttagtagctctttttggcgttttcatgaaccaagtatttattttgattattatttataactatgcttttgctagcttggatttcttatcttttaaatagacaataatcagtactattaatcgaatatttcactcccttggcttcttataccttttgtaggggagtaaaactttaataaattaagtggttaatgaactgcatcaaggtacatgttttattaggattccccattgaaacatttaattttgggcaggctccatgttttttccttgtgtagtatcatcccgtgctctgtttttccaacttaaagcctacttacaaacttgtcaagtctcacatctctctgggaaggggaaagagacccaagtgaaaaattacctgactttgaggaaggatgttttttcttctcattaatgttgctctgcccggcagcagggcgtcaagctcagggcttgagtcgggaggcggtcattctttccggggatcctggcaatggaggttcctctcgagcctgacccagcctgcagtggtgctactgactacaaaatagcccacaaatgctgacttctgcgttttcaaataatagcgaccgcctgaaggcagggcatgtcgcagtttttctggtggcattctggttttgtgtggagggatatgtttggctgtggcgtgcactttgtagaagcagggtgccctctgtgcccaagggagccactgctctctgctaagtgaatgatgattaagaatttcataagtatttttctgacccgaaggttttctaaataaaggtttttgtggttttcttttctttctttctttttttttttttagcatgaaaactagtataaaaactattggttgactttaaactcatttatttcaaaaactgctactttatggctgaattattaatagattggtgatttttgagatgagtgttttgtatctagcccttccctgaataaagaaatttgaatgtgtggagggcccaactcttagttttcctttgaaaatgactttaaaacatctctctctctctctgtcctttccacgaacagcacttacccgtttttaggacagtattagatctcattgtatcctaattccctctttttcccccgaccacctgcctgttctttgtgtctttgttttagattgaatggaatctgcaactacttaattttgttaacatttggtaaatgttacaaccttgataatgaaataatagacatgtacatgttttgaaatgtaaattttggattcttcttggataggacattatattaatactgttttcaattacagcagaattactctagtcttattcctgtcattaaaacaaattataaatagtgaaatttgttaccaaagtaacaaagtctcacagttagatctttctttcacccatcaaagggtgaatttgtgggaggattaaaagcagaaaatagtcattaagtttcagaaatatgtggttataatattaatgcttatttttcttcagatctcatgatttcaaaactgagatacgtgtgatcattatttcatatacattttaaagttagtcttaaattaggttttaagagaagcttatttcttactatgagacaaacaggtcaatttgcctgaattttagagcggggggacccctaaggatcacttagcctaggcagaaaccccacacgcacacttcagagacaggaagctgaggacgtgccgaagatcctagaatccacttagggctgggttggcctgaggacccaaggatcctcaccttggttttccctgtgccttcacagcctgacttttagaatggacaggcctgtaattacaccatgcaagtatctcaaattccattaattccttaattcagcaagtatttaccgagcattgactgcattctgtgttaagtgtcaggggagatcaaggtggaaatctatagccttgaaaggagtgtaggcccttccaaggaagataagtacacgaagactagcacgcaaaagcggaatgcacaggaggggtgtacgtgacttcagagacttcacaaggaggtgagagaacatctgtcgtgggggcactgggaagactttataaaggaagtggtgtcgaactagactttggagtatttcagctgtgtcaggatgggtgggcagagagccttccagagggagagaagagcatgagaaaagtctgcgaagcctgtggagtgatctccttttagagcattctctctgagcagggaggcagtaagatgaaaggaagaagcatccttttttgaccaaggcattggagaccttgaatgccccggagagggatttggataggcagagggaagctggtgcaggttttcactgaagccattgaaagtctcctccattggaggagcagggaagtgagacgatcataactgagcttctggactgtttaggcgttggcttaaggaagccattgcaccagtgaaggagggagggaatgaaagtctgaaccagggtgagggcagtggatggaaaagtaggtattgccaaggtggagtgacagcttcagctaagaattggatgcgagagacaagggagagtctgagaaaacaggcccagagctcgagtgactcatagcgtagatagtctaaacacttttctgggaaattattgcaaagcaagatttagtttagcttaatatacggcaggtaacatttacatggttattaaatttaacttgtatattttataaaaatatcaggtctgtggttaataatagttaccattacccagcaaatacctgtgatgtgccttgtataggatgtttgttatctcaagcctcataacaaacttcccagtttacagatgggaagctgaggttaaaatatttaaatggcttgcctaaggtcacacagctagttaagttgttaagctagatttgaatccagtataccacaatgacgcaagagaagattaaacctgcagtgtgagaattcaccttttctacttgtaaacccttttctatctgagttattacttatttttaatctgttgaattcctcagtctgcgttcctgtgaaatatttcataatcattgtattctttcattaatactcttgtagagtttctatctgcttaggaaaaaagaaactcaatttgattctgcattaagccaactaattgttagtcagatctatttaatgggacaatacagctttcaacagtcatttttttctctaaatatgggcataatttcattgttcaggtaatggaagtgtcttggaaagggaaaaactgctgatgcccctgatgcctcagtgctgacttcttagggtggagcaaaggagggcttgggtgtgagacttggagagtgtgtcttgactctcagctaaccagtctttccagaccaggaggttctagaaggagtggtttcagtctggaggccttgttgctgcagctgggagcagtgcctcaccccttgattttctccatctccctcccgctgggctggtcccagtggccctgccgcttgaaaacgttcagatgtggttctgattttgaagtcacggccccacagatcctaagactcagacatgagctgctcatttgaggtgacatcttgtaaaatactagtgcagtccaataatttatggctcaccaccgacaccttgggctggaagggctcatgaatgtgaaatctacatttcatgaaaatgaagacagtttagtgagaagctgcagcaaacagatcaaaggttctgcttggaattacattttgtttgtttgtttgtttgttttgagatggggtgttgctctgtggctcaggctggagtgcagtggcatgatcatagctcactgcagtcttgaccactcaggcttaagtgactctcccacctcagcctctcgagtagcttgggaccacaggcgtgcgccaccatacacaactaattaaaattttttttttttttttgtagagacaaggtctcgctatcttgcccaggctggtcttgaactcctgggctcaagtgatcctcccaccttggccttccaaagtgctagaattacaggcaagagccagtgcacctggcctttgaattttcttaccctcaataagtttctttcatgctgctaaagtgtatcactctctgtgaattgtctcagttatttttgagtcttgtagggaacctgaggaactcctgaaatgcctcacacttaatacccaatccatttcttccttttcctctttctcttttttttcttatcaccccgcctccattttgctgcaggacatccttaaagttatggactggggcaaagacaaaacacaaaaacgaaatttctgccgggcgcggtggctcacgcctgtaatccagcactttgggaggccgaggtgggcggatcacaaggtcaggagttccagcccagcctagccaatatggtgaaaccccgtctctactaaaaatacaaaaattagctgggcgtggtggcgggctcctgtagtcgcaactgctcaggaggctgaggcagaagaatcgcttgaacccgggaggcagaggttgcagcgagctgagatcatgccactgcactccagcctgggcaacagagcgagactccgtgaaaaaaaaaaagaaagaaagaaatttcagaaccataacaacagcagcagcctccgcaagtaagagctatcactaagtgaggtctccgcctctgcagtgcccctctgagcctcacctcagccccaggaggggggtgttctacctgtcacagaggcagaagctccaggcactgccagtggatgtcactttaagttgctcaaggtcacaggctgtataactggaagtggctgagctgggcgtggactccaactgtgccctacttcaaagtccttctgaagttaatgatatgtgatcagttttccactatcccacaaacacaatctgccaaacacacagtgtgaaaatcgagaaaaccgcctggaaaagaagcagaacttttattagagtactgtttctgtagctgctgggcgaagacaaaatgcaggatcaaaggaggctgtctttctaaaatctatagagacaaaaaatccaccatgtttgctcactgctggagtgggaatggggaggggagagctgtgctctctggttgagcttttgaaatcagggtaatgagatgagccataataccctcagatgggtcttttgtttgcctttgtttttcttccactttactaagccaaacaaacattcattaagtaccttctgtgtgccgaaccttatttatgttgttaggttaagtgtttgtaggagtccaagatgactaagacatgggactttgctctccaggagcaggtagccaggtgtgtttaaactaatgcaagagaggagaggatgcagaggtgtgatatggaaaactccttgcagaaggctgtaacttttgaagttctgaacttttgaaggatggctaacacagcatttcagctgatgtatatagagagtgtttaatgaattttttttttttttgagacggagttttgctcttgttgcccaggctggagggcaatggcgcgatctcggctcactgcaacctccacctcccaggttcaagcgattctcctgcttcagcctcctgagtagctgggattacaggcatgcgccaccacgccaggctaattttgtatttttagtagagacggggtttctccatgttggtcaggctggtctggaactcccgacctcaggtgatcctcccgcctcagcctcctgaagtgttgggattacaggcgtgagccaccgtacccggctagtgaatcttagaggtaaagtatcatccttaaatgaagtattaaaaatatatttttctttttatgaaagatcctttcaagaaactcaaacaaaatagtatatgtgaaaaatgctttgaaaattataaagagctaagcaaataggcctcacggtcaatattaaagcattatataactatcataattcctaacacacatttcctgagtttttcctaggtaattattctgtgaacctgaaaacagagagacatatgagtctttctggcatatgtacaagagcctgtgttgactgaatgaacaaaagaagaggagagagaggaagggagagatggaaagaggaaggaaggaaaggagtccagttagagagaaaatatataaacaaaaagaaaggcaaagttagggggcatggtccaagtgtctaatgagcaacatagttattataaaagtatttttataaaacaaagagagtaactcttcatttaaaaactttgtttttgcctataatgtccctctttgaaatatttgtcttgtttttttgtgttttttctttatctttttgaaagtatgaactttttttcctttatctttctgaatatttttatttttttaagacaaggtcttgttctttcgcccaggttggagtgcagtggtgcaatctcggctcactgcagcctctgcctcccaggttcaaccatctcatctcagcctcccatctcagcctcccgagtagctgggacttacaggcgtgtgccttcatgcccagctgttttgtttttgtttttttttctgtagagatggggtttcgccatgttgcccaggctgatcttaaactcctgggttcaagcaatccggcggcctctgcctcccaaagtgctgggattacaggcatgagccacggcacccaaccttgtcttgtatttttaaaaataatatttttggcaacacatgtaaagctaatgccttaggacagctagttttggagtcctatttttaaagaaaaatgtttttttaaaggtagtaaaataaaaccttgaaatcttggtaatattgttcacatattcatgtggtccgtctttggattagaatccagaacttgttttctttttaaccaccgatgaagggctctctatgcaaatatttggaatccttacttgtttaaacaagttttaggatgaacttaaaaaaaaagtatgtgcaggtaggttctttgtaatatgactcatttatctctcagaagagttaaaaacttttaaggatgagttatttttttcaagggcacctattaattttggtttggaagtcaatattcttttgataaatttgacccaaatgagttgttttctttttctttttttttttttaaaaaagcacatgacatctgccatcttctgtgccactgaaatgggatttaaaaatcgaacttcatggcttgttaatttaattcctaacatgatttgaaaatctttcaacccctaacacccatatgtagcagtattaaaaatttctttgagggtagggatttaaaaaaatgtgtatacgcttgtaagtacatcattttaaaattatttctttatccattatagaattttgcattttcccaaactgcactatatgaattaaatttaattcaattagcatgaataaatttatttaccatgaacttaacatagacatttgtattattttcagtaaggaagaatgagtttggtcatttcctaaaattgagttacagaatgaatgaggtgaagaaatcttacataccatttagcccaacagatggagatagaaatttctgagattaaaaaaaaatctaaaattgtgtagtcaataacatatatatatataatctgacttagaaaggtttgaattacagcttttaaaaaaatgcatgtttcctggctgggagtggtgcctcccatctgtaatcccagcactttgggaggccaaggcgggtggatcccttgaggtcaggagtttgagaccaggctggccaaaatttggtgaaaccctgtctctactaaaaatacaaaaattagctttgcgtggtggcagtgtgcctgtaatcccagctacttgggaggctgaggcagaagaatcacttgaacccaggatgtggaggttgcaatgagctgagattgtgccactgcactccagcctgggcgacagagtgagactccttctcaaaaaaaaaaaacaggcatgtttcctgaagcaagctctcctggctctcgtgctgaagaatccagtgctacacatacagctggtgtatgtctgacatcagactgacccgatgggtcgaaatcatttccgctgaacttcctccctgattaagtacagcgagttctgtgtggattcttcattgggctaagacaagcaaactgacctggcaaggtggattccctataccttagttggcctgagtctccctctatcttgttttgatggaccgagccattcacaaggtatatacctagttccttttctcgcctcggtctgtttccaaagggaattcttggccacacctaagactgaagttggattcttacagatgaaagatagaagtagaccttgttttaaggatcagacgcggtcttgaaaagttgtgtatatgatgaaatttcgttaatcagatcacacttcccaatagacaaataatgatatcaaagattctttatttcattgttccaacacttaagctttttattttttcaacccttcaaaggattagatttctgtgcattccccattcctatacagttgttaatttatttactaagatgctgtgcaaaacatgtaagttttttagtggatatcaggaacatatgagacagggcgcggtggctcacgcctgtaatcctaacactttgggaggccgaggtgggcagatcatttgaggtcaggagtttgagaccagcctgaccaacatggtgaaaccccatctctattaaaaatacaaaaaaaaaaaaatagctgggcgtggtggtgcatgcctgtagtcccagctactccagaggctgaggcaggagaatcacttgaacccaggaagtggaggttgcagtgagccgagatcatgccactgcactccagcctgggtgacagagcaagactccatctcggaaaaaaaaaaaaaaaaagaacatatggaaatggaaatcctttagaaaagcacgaagaatttatttggtattattagcagcatataaagttacctgttgtttttttttttttttaagttcaaatatgggtaggcaagggaaggcaggcaaggtgtcttctctttataggatgtcaactgatctctagagaaataggaatgtcttctaaaactagggggagggaattaaaaaacagagcaaacccaccaatgttttaagccaatgtttggttgccttacctcctttatcctggatgtaattcgtttctaactgtggtataactaatcagtctagttcttgggtaaaaagaagttggcaagttttatattttgtggtcaaatgaatttgatctcataaattcacttttaaaaatgtgtatgtacacttcggtgcgttcattcacaattgtgtttgtcctccctgtctctgttttttaatacattttaattctagaatagttttagatttgcagaaaagttacaaaatagtacaaagtttgtgtataccctcacccagtttcccatgcctccatcattttatttttttttaacagcggggttttatgctgtgttgcccaggctagtcttgaactcctgagctcaagcaatccttttgccttggcctcccaaagtgcggggattacaggcgtgccccaccctcatcttatagctcagtttgtgattgtttttacagtggcacacattattaaatcatttaggaaactctgactttccattgtgctaagagacaactctttcatttatctgcttgggactggcattctttgtgggaatcaccttcggagccaaattgctgaacagaatttcttaatgtttcagaataaaggtattcctatgccccttcaatgaagaaaataaagataattacacaggaccttcctaattttttaattcatcctagggttctaagtgaggttgctgggcttcttaatgttttcctttgtctcttgaatttctttcctctgtttgataacaggtacgttttggaaggtgttctaagtcagttggaattctgcacaagttaggacaacaaatgtgatcttgcttgtatctcagcagtatgagaaacggacctcatttcctgtataattcggagtggaagacagagactggttgcattggtggtgggtgggggcagtcttggtttcgagagctggatggctctggcaccacctcccctgggcctgcctggaggagcctgtgtcttcttctgggagtagttcccagggaggtctgggctcctcacccacattcatctagtcctggcttgttggggagccttgcctgcagggaggaaccccaaatgggtggccaaaaaagaaatgctttcccatggtgagacagtgcagccaggtgcttcgggagaattcccacattactgtgatcttatcccatctatgcataatgcaaccattgtttgtcaaacatttttttttaaacagtgaaattctttctttaaaacacacacacacacacacacacacacacacacacacacacacacccagttggttagacaggcatcagataaaagcaggctcaggctggccctggctgaaggtaggaagagccaacttcttgtagcacatccgtgaggacttttcacagacattaaataatcacttggtctgctttaaatctctctgaaaccaaactacagtaggctgtgctgtggcataatatatcttggtaaatttaaaagccagactttggttataccttgcttgaagagcaaatgaaactctgtcatctcgttctttaagatacagaccatctgcaacattttccgccaacaccaccgttgttttaaggtttctgctaggtgtcttccagaaaagtgcctcatttgaaatgtacattgaatgagcttcattgtagagaaaaataggtattctaggaacatcttgaaaggagaatgggtttgttttgcgataaagacaatgtatttaaattttccatcactttcttcacaccatgatttttaaaaaaaacattattgtcttttacaggaattacagaaaatatatatatatatttttacagacagggtctcactctgtcaccgaggcaagagtgcagtgctgtgatcatagctcactgtagcctccaactcgtgggctcaagtgatcctcccacctcagctgcctgagtagctagagctacaggcatgcatcaccatgtttggctaatttaaaaacaatcttttttttttttgtaagacagggtcttgctatgttgctcaggctggtctccaactcctagacttaatcagtctgcctgccttggcttcccaaagcactgggattacaggtgtgaaccactgtgtccggccaatatttttgtagagtaagcttttttctcctctcctacctttccttcagcccgacttgccagtgaaatcttcatgctctgtgtctgacaccatgaggtcttcctgcagagggacttgtggtgttggggactgtcattagggaccgctgtgggatgaagcaggagtgaagctgaaatagctgtgtgtcattgtcattgccagaagtgtgtttttataactcagagagatatatttctggattggatcctggacctgggaggggaaaacttgctgtgaatgacattattgggctaattggtgaaatctgaacaagttctataaattagaaaatcatttgtgtcaattgtaaattttctgcttctcatcattgtattgtggttatatataagtgaatgtttttattcttaggaatgatatgctaagatatttgggggttaaaaagccatgttctcaaatgattcagaaaaaaataatatgtatacatagataaatatatgctgaaatatttgggggtagaagggcatggttattctcaagtggttcagaaaaaataatatatacacacagataaatacacacacatctatggagaggggagaagggggataaaagaaacacaacaaaatgttaacaattgggattccgggtaaagggtctcacaggagtggttttgtcccgtttttgcaacttttgcaagtttgaaattatttcagaattgaaataggttatttgatgtctggtttctctgtgtttgcctccttagtcaaaccggcacgatgtccaggcaccagaaccagaacaccatccaggagctgctgcagaactgctccgactgcttgatgcgagcagagctcatcgtgcagcctgtaagctttccctgttcccatcgcttctcccaaagccttggccacacccgactgtcctctggttagcttctgctggccggggcctattcactgacctctttcacgtagtgtttagagacacgctttttcagaacagactacagagagatgtgtgtcttcttaacctatttgtaatgttggtttaacaatgagaaccagctttcagacagttccccgtccccctcccaacaaatgtttacactacagattgccacctttttggaaataaagcaatttatgatttacgtgactttttgatactttcccttctgagaaatgcaacctggcatgtttctgttcctgggttgggatggatcttcatgtgcaccatcaatttagtatgattttttttttcagagaaaatgactatattgagataacaattctatctgagaaacagaaaaatggggaaaaataggcaatggaaaattgaggagaaatggtaacatttctgagaaccttgcgatgtttcttaagataactgagacatcctaggatctcatcgaatccagattagaaatcatggagttcgtggtatttgctgtgtgaagtcttcattttaaaacactagcattcacctttgctccgagtttgctaaaaacagaatagagaatggtggggccgtagccatcttttctatccctttcctgagtcactgaatcttttcagcgaagtctccctaatgccgacactggtatcaaggttacatctggcatctgcctcttcacaaagtaccccttctaaatagcctacatttgaaacagattttaaccagatgaatttacgggctctgtttagataacattttaatattctaatttcttaatttagatattgtgtgggttctagttctgaatttcttcatccagttaaaaaaagaatgtcacgttagtccatgttcagagatatttggggctcagcaaactagcttggctccagttctagttgtttcgagtgtctgatttgaaacatactccttgaaatgttcctcgcagtggcccgattcctttacacaaaacaaaatagcagacaccagtgacttaatagtgaacatacacacacacacgtcatttgtagtgactatggatacgttttacatgtagctctgaaaattttgcatggcctcatgttctcagtttatttttgcttatatgcatcaacgtgcaataaataaaaacaggttagggaaatagtgtcatatttgctaacatttctgtttagagaaaagaggttcatttgactaaagccaagtaaaagcagcaaatataaaattccagagaaagatcagtaggtgttactgaagcagaggaggaagctttctgtttttgtttttctgaatacaaaagcctttttaaattttgaagtagttatagactcataagaagttgcaaaaatagtacaaaggggtctctacccagcacccagcttcgcccagtagtgacatcttatatgattatagcgcatcatcaaaaccaggacattgattggcccaatacagttaaccaggcagaagccttctttttaagaactaaaacgttggccaggcgtggtggctcacgcttgtaatcccagcactttgggaggccgaggcgggtgtatcacttgaggtcaggagttcaagaccagcctggccaatgtggtgaaaccctgtctctattaaaaatacaaaaattagcctggcgtggtggcacatgcctgtagtctcagctactcaggagcctgaggcaggagaatcacttgaatccaggaggcagaggttgcagtgagctgagatcgtgccactgcactctagcctgggcaacagagcaaggctctgtctcaaaaaaataaaaataaaaataaaaaaagaactaaaacattatgttctcataaggtataggaaaaactctgtgcataagaggccccatctgtaccactgtaccataatggtacagtgtccttgtcacaatgagattcccattatatgagacttgtgtgtaaatatgaaagatcagcatttaacatactgaagcaaggggaaggttagcattcagcaaatgtgactttaaaagccaagtgcaaatttaaaagacagtccacaaactttggttcatgaatctccgtctgtttaccttcttatctcaataagatcattttcactggcgaaacttacagtttttgtcatgtttacagtggaagctcttgcttccattaatgcccatgaaggttttcttcctggtagtatgtgttttccttcatgtgagtgttttctttcaggaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggtattgtccacagagcatggatcgggcagtccccatgaaaaagaacaccacataaccagttacactcaattccatgacccagggcttcctttgaaggcagcacaaatgttcccaaggaaaggtttgcttacttggtattttgcaactttattatgtatctctaatacaaagtgaccatttcattataggtgttaactgtacctccctttagaggacagaaagccctttggcatggcatttgactttttttttttttttttttttttttgagacagggtctcgctctgtcacccaggctggagtgcagtggcacaaatgtggctcgccgcagcctcaacctcctgggctcaagcaatcctcccacttcagcctatcaagtagttgggctatcggcatgtgccatacctagcaaattaaaaaaaaattttttgtggagacagggttttgccatgttgcttaggctgatctcgaagtcctaggctcaagcaatcctccgtcttgtgcttcccaaagtgctgggattacaggtgtgaatcacttaagggtctaatatcaagtcaagcttagtttaataaatataaaaatgagacccttagagttggaaacaaagactataaggcagaaaaatgtagtctgaatttgttctactactacctggggcccagggtactaggaaaactcccaggacaaaacgcaagagaaaatgaaagttgctcccaggttaggcaaaggcagtgacgctttctatgctgttacgcactttgaacctcttcctaagatttaattttttgtatgtgattaagacttaagtcctggggtaaagaaaaaaaaatcttcaaataccataaaacatttgtagcttctctattgacacaaaagactcagaaaaggggaaatttgcccagaacgggttttcataggctgttttcctgcagtggtttaaaggtttttttctttgcaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggtaagcagcttcttgaacagcccaaacctgtgcaggccagacgttccagcacgatggggtcagcccatgtgtttgtgtgacaaagagtcttctagacctcaggtggcggcagcagcttgctgtttgcaggattttcctcctatacaatttgaaaagtggtcttctattttggaatgaatgagatttcagtgtggcttggggaatcagcctcattgctttatagtcatcctttatcacacaggtcatatttaacatgtgtaatttagttagtagactttgaatatccagttcttatattgaccaccggaaagatctgttgtgggagtttatgtgctaaataacttcattgttctatgtgagtggcaactgacctcatctgttttactcataggtacttgaaaaaaagcccattgtggcagttcatttaaaatggtcatagattggaggagctggaaacagtgaaactagccattctggtttaggctcattggttgcttaccttagacttttgaagtctcagttgtctcattgtgcaaccatcacgtcaccagtgtgggagtgaagcaaaataatgttggaaggatatgctgatcctttccctagaactggagtttctgcaaagtatttttcaagactaatgattgttgtgttgtttcatgtagtcattatgtcctataatgaacaggtggtggtagaaatatgccacaatcatgtagatgggaattttataatgaaaacctactcctaacccttcccttgagaatgtggatgtgttagagtgataagttgtggagagattgttatgcaatttagatgtggttgtaagaaagcttggtttgattagttgttagactaattcagcagtggttctaaaatttctcaactcctttaaaatttttgtgtattctttcctaagtagtgaggacttcagtgactaaacatttattcattcattcagttacctttttctcccatttattataaagaatataagctattacagaaggtaaggcttagaaagaacaaaagtcagttaaaatatcagaaacctaaatacaaatctatttgtatgtttttcaaatttccttctaatcttcgagcacatttcttgaggattttatatgtagtgccacccaagggtacaaagattatggtccctagtcctgaaaatgaatgttatcgaagaaaacaagatgcatacgctcaaatgccaaatttctgtctagatcagctataatacattcttgcttagttagaggggagggtggccagctcctgtggagtggaacagtcacaggaagacatagcggagctgatggggcttaactacatcttaaggatccacaatgatgggcaaaacagccttccaatcaaattagtttgaaatgtcatatctcctaaagttttcttagtatgacagttataaaaaaagacagcctgtaatttgtcatttttttgtatttatgttgggtgtagcttaagaatgtagtaaatgctcaatgtctttaaattttggaaaagtattaccacatgaattcagttttatgtcattttcttttttttttttttgagagggagtctcactctgttgcccaggcaggagtgcagtggcatgatctcgtctcactgcaacctctatctcccgggttcaagcaattctcctgcttcagcctgccgagtatctgggactacaggcgtgtgccaccatggcaagctgattttttgcatttttagtagagacgggggttttgccatattggtcaggctgatctcgaactcctgaccttgtgatccgcccgccttggcctcccaaagtattgggtttacaggtgtgagccaccacgcccagccagttttatgtcgttttctaacagaagcaattgataagcgatgctttccgggttaggcacgcagccctcatggttgcaaacaaactaaaagctgtttgattgcttactgcaggttcgctctgggatttgctgtggctcctttcctcttatcgcttgttcccctgcatgctttacctcattcccaggagactgagctgcagggcccagctgataagggaactgttgccccagcagccagtcaggaggcaggcactcctgagccaggtttttgttttgttttcccgatttgtgtttgccgatggacaggtcagatacgatacacctggctggtaatgagacgcctgagctggagcctggtcacgttgctaatgtcccactgcacgcacctggctgtctctggtttaaagccgagacagctgtgggagagaagggtcaaagtcccgggtaaccttctgttgtctgactctgaaatggctcccctttctgaagccttgccaagtgtattagaacatggatgtggcttagaacaatgtgttttatgttcttgctgcaatcccagattggaatgtttgcccttggcatgtccaagagatgacacaggtgatttggaaatttacatgtactcatgcaaaagaagggtgagataatggacttgccccagtgtggaactggcggaacagtgtgtgtgattcttattgtgaaacattcttaaatttgaggctcaaataataaatttagtcagatttaattttttaaaaaaggtaacttaagtccacaatcctaatattgccaacactcatggaaattgaatccttgagtagatatagtgacttccctttgaagtggcccatagggagttttgcatcctaaaagggaatggtatatcctggattttaaaaagccaataattacatccatcaagacaatataaagaaataaacaatgaaagatgcttttaggttgactatttagtttggggaacagtgtatgattgcatttatttaatgatttttttatgcacatttaagaatgattaaatgagtattttataacatatcatacatatatatgcacacatatgttctgtgcacatgcttgcttgcctgtgcacaggtagatttggttttttttttttttcagaagacatgatcttggttttcaggttcccatttctaaatttccttctctgcccatcttgagctggggtcaagcaagttgagggaagtatttggcaaccctgcattagccatttgggaacctttaaaaaatattctggcttcaaaaatactccatatttacatctttggttctatctgaagtaaagccgtgatggtgtgcgtaagtgaaacaggtgcaaaggggcaacaacaaagggcgcctctctttgtctttgtgtcgcaggcggagatggacatggtggcctggggtgtggacctggcctcagtggagcagcacattaacagccaccggggcatccacaactccatcggcgactatcgctggcagctggacaaaatcaaagccgacctggtacttgtctgtgtttcattttagagtcttcaaaatatctaccgaaggatcgtgtaattactcaatcccagggagtttcttctgaaacattgctattatttctttcccagaagactggaaatgtttagaaatcccacttcttaaatggggaagtggaatcagtagccctattagagattatgttaacacttgaagaggagttaaaccagaggctgaggttgtgcaaacactcatttgcagtttgtgaataagtctctttaggggtggcagtttgtttctgcggtaagcagaacatctttttgaataggggaaatgcaacagtcttatacagtagtttgtgtcattggtgaatcctttcctaggtggtaattaaaacattatttctactgagcaaagccatatgtcatcccgacacccgctcccatgctgaaaaaagtcagacttgaaactgggttgagaattacagcataaaatcataactgatcttaagtgcttagtttcccgcaggtctctacacttgtaaatcactaaactttttttttttttttttacctgagaccatagcttctcatcctcatttcttcttctggctttttggggcttacttttgtccacctgagcccctgaccaactttctccttcatttctctaagacctagggaatcctaaatgatgtctttaaactttaagacaattttctaacacgtgagtctttaagtgaccctgatctgggctttcctttgtggagacggtgctgccaggccagcaagggtttgctttccaaccgcctaggaaaaagtccccatgggtgaaatatctcatagagctagtaattctttctttctatggagggatctgaggccagtatctgaagaaaaggaggcttagaagggccactcttttctatacaatccacaaggggatttatatctacctgctttttgttgtcttctagcgcgagaaatctgctatctaccagttggaggaggagtatgaaaacctgctggtaagctgatttatttctcaagtgcatcgactttctgttgtttccaattcaattcagttcaagaaatatcaagcacatcctggcggggaggcacctgttcatcgatgctaatgttgttgctgctgctgagtttcctttagaagtgaattttaaaagttgttttcttttctttttttcttttaagtagagacagggtttcaccatgttcaccatgttaaccagggtggtctcaaactcctgacctcaagtgatccgcccgccttggccttccaaagtgctgggattacaggcgtgagccactgcgcccggcctaaaagttgttttcagaagtcagtccctactgctgttctgttttcaagttgtgtcacataaatggcacttgttaagtacttgcagttgaagcaagaaaacgttgccacttgtgaattgtggtcttttttacgaagtgtaagcaaaaataaaagttatttttctcaagatagaggtctaccagatcgtcatcacaattttatgacactcagtcatatcagttacttgattcataagaggagagatttccattcttttgcctatttgtgtcatcatatctttactttttaatgtttccttgttggcaatgatactttttaaataatgtcactcgtggtgacacagtgattttcctattgggctggggtgtgacttatggcactttgaatttttggggagaaggtaggaaaagcttgatttctctaacagtccattttcccccttatagtccaaaactaattattgatgggtacaaaaatacagttagatagaaggagtaagttctaatatttgatagtacaatagggatattatagttaatgataatttattgtatatttcaaaatagcttgaagaaaatatttgtaatgttcccaacacacagaaaagataaatgttcgaggtgatggatatcccacttatcctgatttgatcattatacattgtatacatgtgtccagatatcatgtgtacccccaaatatgtacaactatatcagtaaaaaataccaaaaaaagaccttatttagaagaataaaaaaaatttaaggccaggtgtggtggctcacgcccataattccagcactttggggggccgaggtgggcggatcatctgaggttgggagttcgagaccagcctggccaactggtgaaaccccgtctctactaaaaatacaaaaattagcaggacgtggtggtgcatgtctgtaatcccacctactcgggaagctgaggcaggagaatcgcttaaacccgggagggggaggttgcagtgaaccgagatcgctcatgccactgcactccagcctgggagacgagagcgacagtccgtctcaaaaaaaaaaaagttgctgccttcttgttcattgcagatttggatgggtcttttcccataccaggtggtcagtgaatgcacaaggttaacatttttcctatccgtgtgattttttttttaaagggaccacaggtttaatctttaaacctgcagagaacaccagtcactgcatattgttattttaatgctgcctttgaacctcctgtgcagaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccgtaagttcaccccacgcggctgtagatgcttgtcttgagcctgttgccttgaagagctggggtctcggggaatgattggtctattaataatttaatcagccacttgcaattcagccttctttgaaatggtcgtgaaaaatccttccttcctgaaaacttctccgtgtggaggccattatccttagcaaacttatgcgggaacagaaaaccaaataccacatgttctcacttaggagtgggaactaaatgatgagaatacatggatacatcgagggcaacaacacacactggggcctttcggagggcagagggtggaggtggaaggagggagaggatcaggcaagataactaatgggtactaggcttaatcgtgggtgatgaaataacctgtacaacaaatccctgtgatacaagtttacctgtgtaacaaacctgcacatgtatccctgaacttaaaataaaagttaaaaagaaaaagaggggcaataccttgtttaatatcccagaagaccgtagtttgtttagagaggataagaactggtacgttcagataacccaggatgtgtgtggcactgcaggagggtgggtggaagcctgggattagaaaacctcaggatggatgtagctcttctttcctcctgtgtcatcttgagtaagcctctgccacatcctctcctgtagcaaacatccttttcagccttaaaaatgctgtgattcttgaggaaaacagcgtgattctttggcattgttcatttccaaaatgcagttttgtatttcacttttaaaaagtactgtgggggtgatggaagtttaatgatgacttgctgcaaaggatttcttatttcttcattcacagatacgcatgagtcaactggaagttaaagaaaaagagctcaataagctgaaacaagaaagtgaccaacttgtcctcaatcagcatccagcttcagacaaaattgaggtaggcttcatgaggtttatatttttgttagaaaaaaaaaaacttttcataaagtaagactaaccaaatgagtaattcttatatgacttaaagccgtgccaactttattttctattttgggatcaataccctacaccaggggttggcaaactcttttcaggaaaggaccagacaatcagtattttagactttcaggccatttggtctctgttacaattacttaaccctgctattatagtgcagaaggaggcatagacactgtgtaaatgaatgagtgtgcctgtattccaataaaactttatttacaaatagaagtgggccacatgtggcccttgagctatagtttggtgaccgctgccctagactgccatctttgggccacgctcaaggctgacattagctggtaccactggtatggccatactgcttgttaaaaaacacagaaagttccatatcagttggtaagaatcactgtcttgagccccctaagccctttgcttggatgcctcgaacctccccatgattcagcaatcctccaggaacagggctcggtgtggcaaagggatgccactccagtgctagccccagtgacagttctgattggtcagtatctctgctatttgggtgatacatattttgactaagactcctcatggtgtctatttgtgaaagctgattttaaaatttagttttgaccataccaagagatatatggtgagaaattctctttccaacttttagaaaaatatctgcttgacttagaatgagataaaaactgcttactagctttcatgcaggctcacctatctcttggtgttcatgcatctgtacaactgagctaggctaagacagctgacattttcttgtttcaggcctatatggacactctgcagacgcagtggagttggattcttcagatcaccaagtgcattgatgttcatctgaaagaaaatgctgcctactttcaggtttttatatttagtgataattttgttgttatttaggtcttaatacctaatcttttgagtgtgttttataaagcactgaaaataatcttcaaaatgttgcataaatcctcttcattgattttgagtgcagagtagcatagatttgcaaccttgccatcagtcctacaaatagtttcccgctgccacatacctaaatactttctgcacgaattttttcctttagccacctgtcaaagagatgtttagggatgacaatccttgaaacagaactactagatgaaattgctcattgagttgctgttcattcactgatcactctcatccttcacagttttttgaagaggcgcagtctactgaagcatacctgaaggggctccaggactccatcaggaagaagtacccctgcgacaagaacatgcccctgcagcacctgctggaacagatcaaggagctggaggtatcgtctcagacccagaacctcagcagctgtgcctgatcagggagataaaacacatgccttggatgcagttggctctgattagtattattgtacaatgcacgcccagagccaagcaagcattttcttcagcttccagtggcttttctcaaaattaacttctttacatgcccaactactcttgacagttacttttgcttcagtctgggcaattggttgaaaataagaacagagagaacattacttcacatgacaattcctttgggaacgcatacttcaaattttatcagcatagccctttcacacaaggatgttcttccctgcccacttaattcctgcctgcatagcttctggagagtgttgtcatgaaaggttctcatgtttcctgccgacgaatttgtgattttttacaattgatgcaactgcagtgatactcagtgtgtcatgtagctacattaatgcaggttgaaaatctcctctaaaactcacagggtatctatgtttaagtatgattttattcaccattgcagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcaggtgtgtactcatttagaatgatacaaaagttttccctgtctttacacacaaatttttgtccatcaagaaagcaacatttaatctagagttcaataatcaccacagtcaatgtctttgatctatgaaatcagcagctatggaacaaaagcagcagctctgttctgaatcatatggtagttgtcaataacaaggacagtagttatttttagaacttttaaaaattcgcaaggcttaatacttttcttctagtatgtcaaagttgtctgtgatcactctcatctttaaatttctgataaaagaaatgagaaatgatgcttttatgttgcatataaagtgaatgtctctcactatgggtgacacagtgagaccaaataaataaataaaatgtagctcacttcatgtataccttttaggctcacatgtattatttaaagcatcggtattgttgggttgtatgatgatcagcttcatttgaggggaaaaacgtaaaagctttaataattcgcatgtgttcatctctgtttccatcattgagaaaaaaaataaaaacacatacttatgaataaagccaaaccctggggttgcttgccttacagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagtaagtcatccaagttcccaaagccacgcatgcacgcatgaatgtgagggcagaggaagagggcaggtgtttatacctgaagcttagacacacgatgccttgccataataaacaccttctaaaaaaaggaaccttgtgaaggtcaccttcactttgtcttgcaattttatgttgaatagacagtcgttattgaagaataaaagggaatatctggccgggtgtggtggcttatgcctgtaatcccagcacttggggagaccgaggtgggcggatcacctgaggttaggagtttgagaccagcctgaccaacatggagaaactctgtctctactaaaaatataaaattagccaggtgtggtggtacatgcctgtaatcccagctactcgggaggttgaggcaggagaattgcttgaacctgggagggggaggttgcagtgagctgagatcgtgccactgcactccagcctgggcaacgagagcaaaactccatctcaaaaaaaaaaaaggaatgtctgactgtagtggggccagagtgaataatacttgtcatgcacttcaaaggcatcattttaaggttctccttttcttagaaaatcagttgttatacatgtagctacaaatataaaatgcctttaatatcaatattcactcattgtaggaagaacattcgtttaacaggttgtccatggcagattcctttaaaccatttagtatcgaaatcttcaaccacacactgaatagggagagtagtgtagtaagctgctgtgtgctcatgaccaagctttgggtcattggcatctaatgcacctgccatcctgccttagacctctgtcaattacaaagttgccgaaaaacaagacaacaacaaaaagttgtagtatatatgtcagccaataatgtagataattcagaatgtacttttggggagtaaatgaatccaaatccatgaactgttttcaaagttatacctctacctgttactttatcagtgactgttgtaggtttttgtgcagtggtgtgagcgtgtccaggtttcccatttgggatgaagtgtgaaagcctggctctagcatgttttccctttgtgcctcttaggattgagcagtactacgaagccatcttggctctgtggaaccagctctacatcaacatgaagagcctggtgtcctggcactactgcatgattgacatagagaagatcagggccatgacaatcgccaaggtatgtcctcagggccacttaggctgcctggagggagggcagcgctgccccccgcagtgcctgtgtccaacagttcaaccttcttgctgtgtagcagtgcttttgtgtctcgtcaagcaagtcagctcagccctccttagaggttctggtctgtccaatagagaacaggagggattagcatatggctgattatgagagaaagaagcaatactaattcaggtggcctgacaagcaagccagaagtgcctgtggaaaagtcatgcactcctgtaagattctggaccctatgctcctttgatgtaatggaaagttaggtcataaaggattaactgggtatcacaaaagtaaaaggtgggatagaattcttggaagagcacccaaagcattacttactctaaatcagttgttttcagatcatggtctgaagaatcctagcaggagagggagatcctttaggagtgacagggatggaagtgaggagaggggcacagaaagtaccttttggggtcccccgagccctttttctctttgtagttggagcagctttgctgggctctgctttacatttagggcttctgaataatatttcgttgaagaaaaatattctgtaggcaaaaaaaaaaaaaaaaaattagcaacccattcctgtggctcttgggaacaatgtctaaaacctaaaagaccttttatatcttaatgagcctgtgatgagtgttgctttgagtcccatctagtgggtggcattttttggccaactcttcttgattgcattgtggggcagtcataaatcccaaatcacttctgcctgtctcctttcagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacaggtcggcttgggacatctttctctttgtatcaaccatccataccattttaaaaagaagggagtttgcataaaactggtttcagaaccatttctctgaatgctatatagccagtgttcttcgtgcactaaattttcagaattgattctgaaattcaaaggaagaaggtatacttttaggtagtatggatgttttttgaggcctagcaccttgatacctaggtattctctgatttttgtggccctaacttctttttacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaaggtaggtatctgctagtattttgcctggttaccctgtatatttttatttacctgtaaatgaataaaaaaaatcctggtttaaatgtttgtaggcaaaaatattaactttcaagaaaacaggcttctggcaggatttccttatgtattatgtttccaaatttgtagacggttatcaggctgggggttaaactgttcgtttgtgtgttgttgaatcaggctaccgtccatctcaaaagttttcacaaccattaatttggcttcttgcagagaacaacctatgatatgggttagacagggggaatgatctttatttgtagacatgacactgacatgaagagatttggttggtgagatacgatctcaaagccatagacagagtgtgactatggcccaggtgtgtcagctcctaactcagtgatgttttctgctcaaccaagcctgggcacactgcactggaaggcctaaatagagatattctaagaggatcacatttacagtgctaatgaggccatactcaagaaagaaatagaaggtcaactcctctctcttccttgaatcctttacttttagtggactttttaagggcaaaaatgatcataagattcacacagctacaatgcagagtactaacctctgtgtgatcagtatgccaaaattggaatgtagttgtgttgcttaatgaccggggcacattctaagaaatgcatggttaggcgattttgtcatgcaagcgccatagagcatacttacacaaacctagatggtatagcctactatacacctaggctacaaacctgtagggcatgtgactgtcctaaatactgtaggcaattgtgacacaatggtaagtgtgtatctaaatatatctaaacgtcgaaaagatacaataaaaatacagtattataatcttacgggggctggatgcaggggcacatgcctgtaatcccagctacttgcttgagctcaggagttggaggctgcagggagctatgattgtaccactgtactccagtctgggcaacagagcaagacccttctctttaaaaaaaaatgtgtgtgtgtgtgtgtgtgtttatatgtatgtatgtacatatgtgtgtgtgtatatatcttaagggaccaccattgtgtatacagttcatcattgaccaaaacatcattagtagacacatgactatacacacacacagtggggtactatttacctttaaaaaagaaagagatcctggggccaggtgcggtggctcacgcctgtaatcccagcactttgggaggccgaggcgggtggatcacaaggtcaggagttcaagaccagcatgaccaacatggtgaaaccccatctctactaaaaagtacaaaaattagctgggtgtggtggcgtgcgcctgtaatctcagctactcaggaggctgaggcaggagaatcgcttgaacccaggagatggaggttgcagtgagctgagatcacgccattgcactccagcctgggcgacagagcgagactctgtctcaaaaaaaaaaaaaagaaagaaagagatcctgccatttgcaaaagcatggatgaatgtgggggacattatgctaagtgaaatacaccagacacaaatactgcttgatttcacttatgtgtaaattctaagaaaaaagttgaatgcagggaaacagagagtaggatggtgattaccggggtggggagggaggaggaaatgggaagatgtaaaggatacaaacttgcatttgtgtgggatgaataaatctagagatctaaattcagcgcaagactacaggtagtaatcttgtagtgtatattgaaattttgctgagagtagattttaggtgctcttaccacacatacaaaaaaagataaccatggaagttgactgatgtgttaatttacttacctgatgtaatcatttcactgtgtctatgtgtattaaaacagcatattgtacaccttaaatatatacagtaataaaaagaatcagctaaatcaaaagagctttccttcatttttgacagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaataggtaaactcagctaacactaatctcatattttccttttctcaagcttctttttctgggtcttcatttgctttagatgcttgccttacagtttctctgttactagagatttacttacatccttctgtggtttggagagcatgttaattccgctagcctcgcatgttaattccactattctgaactataatgttatcttagaactaagttatgctctaagggccagaacttgagaattcttcagcgaatacaaaatgttggtctgaatcacaatagaccaaaaaacagacaaaataaatttttatctgctttgacgttgttccctttcattactagctgtgagaggcaaatcttcacagactaattatgtcactggcaattttatgtgcttcttttgctctttccagcttatgcacagtaagggcactgctccaggctattctccaaacagaagacatgttaaaggtttatgaagccaggctcactgaggaggaaactgtctgcctggacctggataaagtggaagcttaccgctgtggactgaaggtaacttgaaagcttataacagtggcccaacttacaggaactaattcagatctgagctcccaattataaagcctcactgggttttcatgagttttgaggattattgggtttcagtggccacacaggttgacatcagttgtcatctctgtaactctgttttccagactgtgttagcaggaactatataagaaagtaattcgtgatgggattagtttggggaatgctgagttaaactggtttctttactgtgggacttcttagaaactttaatatgttcatattattattataacaggatagcacaaagaacaagattattggaacaaatactgggaaatgcaattcagtaaatatatttccctggattgactgttaacactttaaattatgaatattctaaagtgttttataaactttgccgcccaatttggtgacttgtagtgtagcatacaatgggagaagggattaatttgcaatctttttttttttcatcttgcagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggtatgccagcctcctcccgctccttccccatcttctccccttttggttgttcacaagataatgtcacttgaagggaaccactgaagaaaacagaggttttgttttttgtgtaagttaggcgtaacagatgctcttttcatggactgcctgtatgcagctttgttagaaatggaaggagaatgcatcacgatagccaaccctgtgcaggccaggtgccatccagggtcttagagaaacggcagaagccctttagccagctcttttgtgtcctataaactcttgttatgactcttggaaggagtagctgccttgagttagcattctccaaaagtttatgaaaattaaatcttagaccaaaaaaaatgcctttctgcaaataagagtttaaaaaatctctggaatatgaatctgcctattctggaaattttatatgactggaatcatacaatatgtagtccattgtgactggcttctttcacttagtatcgtgctttcagagttcatctgtgttgtatcatgtttcagtacatcattttctatttttttcatgtgtttttatgattgaataatattccattgtttggcagtgccacattttgttgatcttttcatcagttgatacctgagttgtttccagtttttggctgtgataaaaagtgctgctatgaacattcatgtataagtttttatgtgggaatatgatcagttttcttgggtatatatcaagtgaatttctgggtgattctatgttacatattttaggaactaataagataatgattttattgtatctatttccccccaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaaggtataagccaactttttgttccatagctgttttgagattaattgggtgtaattcatgttttcctctggtttttgtatcagtgcctaggtttgaaatgatgaatatttaatattactaacccattttgtgaaggcttaaagaatgcccagaggaaaagcaactgagatgtttacaaggaaatgcaaattatgaacatagaaataacgtgatattgttctcttcatgttatcataaattatctttataaattgaggggataggcccagaaaacaggctgactagaaagtaacctcttacagatagtaagttaaagggcttgcttctcttctctgaatggaaaaaatgctcatctcctaagctgtaactataaaaatatgagacaagtacatgtagtaataaactgaaaaaagggtacaaataacagtggtaaaagagtgaaatcacatttatttaaaaatatttgtatgcattaacattggtaaatatttcactttttgtatagaacttgcacagtgaaatatctggcaaacgagacaaatcagaggaagtacaaaaaattgctgaactttgcgccaattcaattaaggtatgttggtttcataaagaatgttggtatttcaccaagattattattaactgcatgacttgctgatttgttgtaaagcgtatacacttcctgaggatagcaattacggtctgtatatattcttttctgaacaaaccataaaaattaaaaatctattagcttgaattcattccacattggcagtatccatttgaatggctggtttctattctttgactggtggtaggtgctgcattctccatttagcatacaaagatgtactgcttggtttaataatggtgtttgtttgtttgtttgtttgtttggagagagtttcgctcttgctgcccaggctggagtgcagtggtgtgatctcggctcaccgcaacctctgcctcctgggttcaagtgattctcccgcctcagcttcctgagtagctgggattacaggcatgcaccaccatgcccggctaattttatatttttagtagagacagggtttctccgtgttggtcaggctggttttgaactcccgatctcaggggatctgcccggctcggcctcccaaagtgccaggattatgggtgtgagccaccacgctaatgtagtattagttgcttggccactagtggcgcaaagtctttggagtgggcaattagacgtgcagcccaatgatttaaaactgtggaactgtagctgttagtgatgctttttaagtctatgaaggacacttttcttaaacttcattatgctgcaggattatgagctccagctggcctcatacacctcaggactggaaactctgctgaacatacctatcaagaggaccatgattcagtccccttctggggtgattctgcaagaggtatatatgtcatcacatatctcttaaaacctgcccctccttctgcttcttcccttttccctgtctcctgcctcttcccttttccctgtctcctgcctgtcttccttaccattgctgatttcatcccattacagggtaccactttaagaggtttaatagcaggttatgtgccctccagtgtgagtcattgatgtatgatacattttcagaaatgatcaggaatgtgttatttagagtctttgtagaaattgggcttaaatttctgggtttgatgagagagacttctaaaaagtggaaaatacagaaatttctaaaagacagcctcttctcaaagatgtcagagactatcgtacctgtcagatggtttaggggaaacagcctggagagatgagaatgggatacatttttggccctttgttttgctgtactttcttttgctgattttggaatgaacacactaaagaagagaattcactctttataatttcactattttagaaaacaaaatcggtcaaattacataggactttttttttaatgcaatatctttttctttctttccttccttttctccaaggctgcagatgttcatgctcggtacattgaactacttacaagatctggagactattacaggttcttaagtgagatgctgaagagtttggaagatctgaaggtaatttatactgtcttttcttgtagcgtcaaaaaagaaaatagaatagaaccttattattacttccacattataacatggatttggacacatcctggtgaaactgtatttcctctaaaggtttagtgtaatactgcttgtttgtaagtctggggttacttccatgctccaatacgctgctttaaatgaacttaagtaatagtcataatattgcaacaactttgccaaacaaaagtcacttgatttaatgtttggttaaggaatttgctttatttctctgtgttaaagataacatcttggactaggtatatttgaattttttatattcagtgattgttccctttattcctcatttatgatacttaaattgagattatatgtaaacttattttaatgtaaacttgaaataaagggaatataatttatgaaatcataagcttttgattttgaaagaaattacctcattttacagatgaggtagctcagactcaaagataatatatcatttgctaagagcatatgagcagctggtgcaagaattatgatgagaatccagatttcttgaatatttgcctagtcactctttgcatgtatgtccatgtgtgtaaagagaaataagaatgcacattggtctgggaggggaaaagtactgcttctttcttggaatgtgaggtgtttttcttttgacataatctctgatttcattccacagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggtattcacaaatacttgatcacagcttcactgtttctcaaattattcatcacattattatctcatctgaactgtgctctttctgcttaaatagatgcttatagaaaatctaatttttctttttattgctctactacttcctgtcataatccaggtaactgctttaaaataatttcaatgctgtgtgccctgctgttctttaattgcatcaaatgctgatctctgggtagcctgtgtttggccctgcttttaagaacactaatacatgtataacttcctccgaatgttccattctacttcttagaagttagctcttatttagtgagctatgacatacatttgtaatgaaaattttcttaaatagaagccatactaaagtgtttccctatgcaatttttaaaacactttttcttttgcctgcttagatgatttttttgcatggattatttagtgttcgcttttgatcatggccctagtgtgtttccttttgtttgactttccttctcctaacccttaatttaaaaataacttatttaacttctacagacaatatttgtgtgtggctgggttggtgtgtgtgtgtgtgtgtgtgtgtgtgtatatctatatattatatatataattatataattacataatatatatttatctataatatatattttatataatatatatcttcatatatttgtattgcttcattaagtatgttcatctagctgtaacaggtgagatgtaggtgtagcaggtatgataacctgaaacaaaactccccacattttttcaaagcataattattgttaagagtaagacaggtctgcaacttacagttccttctatagaaaaaaatagtaagtatgaagccatttattgaagtggcaacatatacagaatttttcccacaaatttgtaaaataacaagctcacagtgtatccagggacaatatagaaagaaaaaataagcaaggcttttttttttaaagatagatacacaaaagaaagttaagtcgtgatagtaatatgatatgattcaaaacattattttttcccatttctttcttcttcaattccaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagactttt

SEQ ID NO: 35607 - DNA, 42610 bp, Homo sapiens
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcagtaagtgccgcggcgcggggcccccgagcggccgccgcgctgccccggccccggtccccggcccctaggcgccgtgcgggtggcgggggagtcctcggcgcgggggaggggtgcgggcgccggccggaggcgtggcggggccgccctcggtggtgcagggcgggacccccgacggggggtgcgcccccaagttggcgccgtgggccgagccggaggagccccgctgcccccaagggcctggcccggggcgcggaccaggaagtcgcgcggttcctggcgctcgtggaaagtggaggccgccctcccggcgcagtcaacaggtgaccggccgagaccggtccggggctccttctcccttctgtccccgccgtccccgccctgccctgacatgccccgccgcatttgtgtctccgcagagaaggtgttcgccagcctcccgcaggtggagaggggcgtctccaagatcatcggcggcgaccctaagggcaacaattttctgtacaccaatggaaagtgcgtcatcctaaggaacatcgacgtgagtaccccctaccccgggcgcggttctgctccggagccaccttgggatgggataattcgccttcctctccacttctcacctcctgcccattggcccggggagggtgagggcgccacgccccctctaccgggagccacacctcggagccccggaagccggcctcagattcacccaggtccttgtctgctccttcttgatgaggaaactgagtcttagttcgtttctgtctacggtcatagcaccctgaaagcgccggatcgcctctgatcttggaagctaagcacggtcaggcctggttagtacgtggatgggagattagattagttcattccttaaaagcaagggctccggatttgagggatcagactgacccggtcggccgctgcgtgaccttgagaagattggcgatttgggcatctctgagccccagttttctcgtctgtaaaacagatgatgagatgatgaccactctcgcttcgcctgctggctgggcagatggaatgaatgagctgctggcgtccctcaagcccagcggtgcctggtgcactttgagcccttgctgaatggaatggcactcagctaactcgctgttaataccctggtcttccagtatggcagagcccggaaaaacacccgggcctctgggccagccagatctgccaccatggatctaagccccaaagcaaaaacaggaagcagtgttttcccatgaatcattctctgcaagcctccggtacccaggctgaaaaggcttctagagccagctccttgggaaatccttgcaaattcatgttattcctctgtaattgttggggtgacccagtctgtcagtctccctcccttcctgggttacacgcttaaattttgcttttcccttcctcagcctgagtgatggaattggtggggtgggagttggaggtgccggcccggccattgggtgatttctcctgtgctgtgcttagtgggggcggctggcacaaagatgtatgttttgattgatgccataggcatacaagggttgtcaacttaaagtcagcctgatttcccttggtaggttgggactgttgatcggacacacttgccctccaggaggccagcaactggctgagggaatgaaggggtctctgggtctcagtttccttctctgtgaaaggagaagcctcttggtccgaagagctgctggctctgcccgcatctgtctcgttaacccaggcagtcgctgctgttcctctgctggaagacagagctctacctgccctggattgctgggcccctcaaatgagggggtgggcgggtgtgaatgtgctttgaaggtgctaacaacttgctagtcacacagattcctagaaagccgaagggccttgcttagaactggagaaaatcaccagggatctaatggtaatgatctggaagtctccgaaggcaggtcctgaggcttttgagaaaataaaaattgagacaaccctaaagagatatttagtagtttggcaaataaaatccactaacacgtcctcggatacagagcagtaggatatttcgttttgcccctaaccaggccttccctgtcgttgcagtccacattgacttccagggagggggcctcacataaagtacctgctgtgcatctggccctgtgatagcttcttaaactgtagcatctctttccaccccacatgggtccgttactctaaagaggagtcagacttagcaaggtgaggcaggccagtaactggagctgcttctaatggagtggtcattcagggacaggcacccctttgcagaaagcatttcccagcttgtgaaacccattctgcctgtttctgagctctgtattcttaccccttccccgtggtttgccattttcttctcaggggttaccctgtttcccttctcaattatttttaagtttctgcaatgccaggtcagcacgagatgctactaatatagccctccctgggctggatgtagatcaggcactgagtctcttgttagttggatgggtggactgggtactcaagtaaaggtgggtacgattttttttagggcaaagtactcttggaaaaaaaagtgacatgaattggcatgaccgttcaggaaggatgatggtctgtttggaatgcaggctcagggagggaagagggaagaaatggaggaccagatcatggaagatctaacatgtctcattgacatctcagactcaacatacatactccaagccaaatttgtgtttcccacgtgctcttcccctaaaagggaacaccgttcctccagctgttcaggccccaaaccttggactcctgtttcactctctgcttcgctactgcgccacattttaattttagtaaatccttctgactccacattcaaagtatcttcagaatctaacagatttccctggcttcctctgcctccacccacgactaagctatcttcccccacctgacttattgcccccagactcccgaaaaccaaacaggtctccttgctttcacccttgttgccctgggggtctgttcacaacactcgctggagtggctgaaacacaagacaggcctctagtggcttcccacctcggtgaaagccagagtccttaccgtggcctcggctccagcgttcttgcctccttgctgcttcttgaacatgccacacatctgtcttggtacctgctagttattgcctttgcctggacattttctcagatagctgcaagtcttgctccctgtcttctctttggtttttcttttttaatttgaggtggaggcttactgtcgcccaagctggagtgcggtggcgtgatcttgggtcactgcaacctccacctgccgggttcaggcaaatctcctgcctcagcctcccgagtagtggggactacaggtacgtgccaattcacctggctaatttttgtattttttagtaggtaacggggtttcgccgtgttggccaggctgatcttgaactcccaacctcaagtgatctgctcgctcgccttggcctcccaaagtcctgggatacaggcgtgagccaccacactaggcctttccctttggtttatacttagatgtagtcaccttagtagaggggtgtccccggaatagaattttccatccccggccttctgtctttctcattgctgacaataagtaggaagcaagctaacaagcagcaggctacggctgcctacaagtgtacataggtatctgcctgtccccctaactgggcatcagctccaggccagcagggctttcccctctctttcagtcactgccgtgtcctcgcctaagagagtgtctggcacacagtaggtgctcagtgagttactcattgattaaaaagcctggaaaaccaggctgtgtcgtgaagataataggcagccactgaggtcttactgcatgagaacaaggaaagctcagctcagtgtagattgccggacctaaattttgtggaatcgcctttcatacctaagaggcgagcaccgttgccagctttgcacttggagccccctctgtcatttattttgttgacttaaaagctgttttgtgaacccagcataatggcacttcttaaacttgtagaaaaagggtgtttcttacctgtttatttcaacacatctcgttgcctcacctggagaggcaactctcctctgtagagtgaaagactataatggtggccatgtagaaactaatattccagaaggagagagctccaagaaggggattccagtgaaccatatgtacactgtgtttgagagacattagttccccacggagaagggatggatagtctgtgcttcgggggtctaaggaaggcttcctgcaggtgctggtacctccttaggtctggggtggttccttctaagtttccttaccctgcctgcatcacctctgcctcttatgacctctgtgcaaagactgggaagggtcacccccaatggctgtgaacgaacctgtttgtgattctaaacagggcacgggaccatcctacaataaaaattacccagcctaaaatgccagtagtgccagtagtccctgtttagaaaaagaaaaaaaaaaagcaacttttgcctcacaacagaggccctcttgtgtgctgccaggcagccagcagatttgctatgcaggcaagtttggggcctggtttttaaagtatccagttcctagattccagaactaaaatacacatttggaaaaatgatgtctataaaattgagtttccgggagtgcaaggtttatagcaatttgacactgctgggaacccaggcgcagtatcagtggacttttctccttgaacagggggcagaccaagtggggggttggggagggtattgggctcactcttggtttcccttggtgtgagctgccaccattcacatgcagaggactcacctgtgtttcctgcgggttgggggtaatggtggcatgacagagggcttgaggactgacctagctgcttctccggaattggacgcctgctgactacctgcgtgtatccagatggccattggcctgtgggggtgcaggatggaggccctgcccacatggagctcactgtcctgggtgggagtgaaataaactctaggtggcagaaggaagtggtgcgttggattatcacctgggtgcaaacgagctggcagcagcgcctgccaggtgcagagccaggaacctctaggccttcagtctgaccacctgatggcaggggaagcagagggtggtggggggccttcatctcaggagaatctgagtggctgcaggtgccagtcaggacgctgggcttctgcagatgggaccacatctgggaggaccgaagggccgggtgcttatgggctgttactgtggcactgagcgtgaggggagtggacaggacccaggctgagaagtgctggtgtgcagtggtggcaggtggctcacacagccctaccatagcgcagccctgctctgaaggccactggagccattcagaggtctcacagacaagtaatcagatccagcctacggtaaggagaagttctgtatctgagatctgaggcagggaagccaattaggaagctgctcaaagatgaaggcggcgtcagcgcaggttccgttgcgtggtgcagccatctctggctctcacgtttcccacacatgttcactaagcccctgtcttggcaagccataccctaagccacagaggaccaggattaaaatcagtgattttcagggaggggtaatttcccccacctcattcccctgagggatatctggcaacgtttgcagacatttttgtgccactggtatctgaagtcagggttgtggccaaacatccgacaaggtacatggccgtccttccacaaagaactgtccagccccaaatgccaggggtaccaaggttgaaaactctggtaaagaaccttcgaaggcaccaggttaagtgcttcaaaagaacaatgccctgggtgctctgggaatgtgagggaggagccagctgtgccacagagcggggacagctgctggagaagtgccacatttgagttgggtcttgaaggatgaataagagttctccaggaggagcgttgagacacacggcagaggtggggagaaaccaggcaggaaacagcatgtgtacctgggtcctctcagccccactgtggcctcctgtgtgttgcttttggtacatttcttgccctgttggaggtaacgggagggatactgaagccatctttgaggtaagagaagaggtttagcctcatgcgtaagactactggagagatggccttgcccaagagtagttggagatgcttctttggagagtgacctccaccttctgcaaggcccttgttagggacagctgtggacacaggaaagggccctgtgtgcgtctcttcgccgtctcagtgatgggcaggcactccctgccctggcgatgtgcctgctccttagacctgtgggtccttagctttggtcaccttgcttgtcacttctacgtatgggtcctgcctgctctccagggaaaggccagcatcccacccctacccccgccccactgtccaatccagtgtatacccctgagcacctctctgttctttgttgagtgtattttgtgctggtctgtggctgaaacttggtgtgcttgcctcttctgtttccatgcctgcgagagtgggaggaatgttatcatgggatcagtgtaagatttaacggagctaattcgtaaagcatcttcagaaggttgtctgggccctggcagggacctctgctcttgtcttcatgactgccctgttgggtggataccctcatctctcttttgagaggtgaggatgctgaacctctggaaggtgctggaatttgaaccctgggagccacccccaggtctacctttgcaactcatcagttaaggccctggtgggccctgggtggggagtaggagaggggaagactgaaaacggaggtggtggtgtcccgctcacacgtagtccaatgaggggtgctgctgtgcagggccacacggtgagtacccccaggcctgtttcaaggcatctgaggctgagctgggaggcaggaggggaaagtcgttcagggcatggcggcctgtgagtgaccaccccgtcctcagccagctcaaggagctgcctgtacactgtttggaagcacacagctggttggccagtgcagactttattctctgtattaaagaatcacactaacattgagaccaaccgtaaggaagacaacaaaaccacagggaggagtaaaggccgccacatatggtccctgatttgcagtgacgtgacctgggattgtgtgaaggtgttgagcatttgttacctcccttgactcaccgtgctgttagttatatgctcataacccaggtgagtcagcaactggccctgagttcaggtctggcgctgccacttaacagctgggtggcctggggcgtatcgcccagtgtctgccttggtttctttgtcatgtgggattatgaggttaccttccttacagcaggtgttgtgaggtttcaaagagaatccactgaggggcccacccagggcctgtctgagagtgaatagtaagtggccggtggggatttgtttcttgataaacagctaccaggctccagccaagttctggtctttgtcggtatttggcagctgctatggtgaatcaagtgtgaaccttccccactctggtgtccacgtagtacagaaggcaggtggggcacaaatgatgtgtagtccaaggtggaaagtagtgagggcagtggggtgggagtcagggaaggtgggggttcagggtgggagagatgatttctagcttggagcatcagggaaggctgcttggaggagaagccctttgcctgggccttaaaagataattaggagaaggcgttgtgttgtcgcagaagtttacattcctgctttggagctgaggttttttgctgtcattcagccttggccttagttgtagtcaccagtgaacataagggccctggccagttatatttgcacaggtcagttacagcagtaacagctttcagcctctgttgcttgcaggaacttggagtatttacaaagccagtgccctgactggaagctcacgctcacttggcctgggtggaccatggaggacgcctgagactttctctggggttcccggggacagttggcagctaaaggagggcacagcaggccccttcatcagtgttgtgtcgtcatctgctgaaatgttttttgcttgggcaggtatctccaaccttctagcatgttccatcaggttcactgtgggccaggagctgagataccagtggcaagccttgagacccaagccccaggacccagggtcatcacagcctacctgtaaattggagtagtgacctctggcccctccgtcacccacctgagactgggaggacataggaaagtaagagagctttgaggggctcagggctcactaattgtaaatgttgctgcctggggcataacagagttacggaaatgtcgcttctgtgtgcttgtttgcatgacctgtgtattatagcgagtctcaaaggcggcacagacattgtacaggtgccgggggggagtatgtttaggtttgccattcaacaggattctcagaaaaagaccagctattcctgggcaggatgcctcagtgcacaggtgggaggtgggggctggtgggacctgagcatagtgtgacagagtagaatggcctcccgggtcaagtccaaagcttctgcttcaaatgggcaccactgggccttgaaccaggccctgtgttggcagggctgggtgctgttacatgctgtcacttgccgaagtccgtgggtcctgggtctgctcgcgtgtgtgactccttgattgctggctggtgtccttcatgtcctcagaggcccccggactcctccaggggtggtggcagaattctggggcttgtctcgaggtcttatcccagccccagctctggccctcacaggccctagcccccaggtgtggaggccactggggaaggggtctggggccagcaaggtagaggggctgcacctgttctatcctcaagggttggggtgaggggccatgggttggggtagtcagcccaaggagtggctggcaacgtcagggcggcagcagggtagcgacgagtgggctgaagcctggagggagctcaggaagggtgggttgcaagccggaccgtgaggtaatcagggtcgggatttgaagactaccggcttggtggagggtggagatgcattccaaagcagttatcgctcttcccaggaagaacaggaggactgcattgaaaatggtggaggtaaaagagaagatgggttgggagttggcaaggaaaactgggcaggcctgtggtgaggactgaacggcagcctcccactgccagagctggcccagcctgcagcagcatgagaagaaagcctgggaggaggggtgtccctgagtgggcaactccaaggctgctcatggtggtctcccccaggcccccagggagatggggagacagaacttttgcctacagtagcactggggctcctggaattggcttcctgccctccctgtctcgttttccccattccagagtttttccccaaataagcttctcaacccccaatctcattcttcttccccaagatggaaggagggggaggaggctggggggagaggggcacactgagggtgtcaaggtgccatctcgacccagctgatggggacagagcctcacaggccgagtgacacgtgggggtgtgaggtatctttctgggtgtagtaagcagcctccctctgcgagctgaggagctggggaggaggctgctctgactcagatgtaagtcattatctgcagtttggagtatctcagcccccaccgctgacccagttgtatttagaatacaaacgagagtgagtgattcatcagctggcaggattctgttgccctttggggtttttacacacagccctgaccatttaggggaaggaatttttaggggcagaacttcctctcatgcccctgcccaggcatcttccatctctggatgccctccccagcggaaggcccatgggagccccaccctttctacggcagcacggcctggggaggaggtcgtccaggctgggagagcccacgaggccatctgtctggcgggatgggcaggtgcccctgtatgtgagcgtgagacctcccccatccccagtcagctgtgagtgtacaccgaacagggtcttggaggggctgcctgttaagtggatcattttcttgccaggtgctttgggtagggatgtgtcagtgtcagaatatgaaggactaattggagtgggagagggttggattgggcagacatttaataaatagccagcatcttagttttattgaggtgtactttagatacagtagaatttgtctgtattcagtgtgtggcttggatcttgacagatgacctatatagtcccataagcaccacccctgtcatgacagaacattcctgtcactccggagggtgccccccgcccccgccaccccttccaccctcacccccagcagctgcttatctgctttctgtcattggggttgccttttctaaaatcttctttcatatgaagtgagaggcaatgtgtagtcttttctgtctggctttttcactttgcataacatgttggcgattgatagctggtgttgagtgcatttgcactttgttcctttctatcactaagcagtgcggtgtgttgcctgtttctctgttcacctgttgatggatatttgggtatttccagtttttggccattgcaaagaaagcttctgtgaacattgctcctgtgtcttttggtggacacatgcttccatttctccagggcagatacctaggagtggggttgctggtgtttggtgtgagtagtgtctgtttaggtttataaataacctgcccaactcttttccaactgtaccattttgcatttccaccagcagtgtgaacattccagtgtccccacccctctacccttgccagcacttggtgatgtcagtcttttctttttattgattctagtgagtatggagtggtattctgttgtagttttgacttgcatttcccaagactaatgacactgagcgctttttcatgtgcttacttgtcattcgtagtatcttctttggatagacaccttgatacattctaatttcactggcgaacgattatcccaaaatggattaatttatgactggtgtctattatatcacataatgctgtgttaagtcttagggatgaaagagaaggtctgtgtgtacttctttttttctcccccaaaccacttattgagatggctagtgagataaaggtcatgttaagcagggcacagcagagttggaggagatggacaggaatgctagggactatgatgtgtgttgtgccatcccggtggacatgttaaatgatctggaagcacagaagagttgatacggatagcttgggccatacttggaggcttcatggaggagggaacgcttccgttaggcctgatgggtgagtgggtgtccgtaggcagggagaggtgctggccaagggcacagactacacacagacgtggagcttaaacaggatggcagaaggtgggcaggaatcagggtctgtacttctgtggtctcagtctcgtgagatgggggcccctcaggtcttgaggaggggtctaagggagatgaggggtggggtggcagcaggtggggtcatgctaggggtgcccgggcaccctcacaggagtctggtgtgtcctaagcctcaagctggcgggaagctgcctctttcaaagagcacttggtttgtaaaaagctgacagtaggtagcagagattagatggccatgtctttattccctcctgaaagaaagcttcactgtggagacagattgagagcagcccagtgtgtgtgtgtgtttctgtttcactgaggccctgcgtgtgtgtgtatgccgggagggaggcgcagggatctacttttagcacattacatgttgaaacctcattgctgaagatgcttctagtctcaaatgttggccccatttttgccacaaagtccacccagcctttgatctgtgctatgcaagggagtggggaatcgactttcctttccaaacccaagtttttgatagagagggctcccacagcgtgtcctgctctgctcctgcacagcacagccaggcgctgagtttggggtccaacattgattggcagccaggagagctggtcctaaacacggaagagaacagagcgctggaatgaatgcagcttcccacaaatgggagggattagaaccagggcttcttgctctaatccaccttttgtgtatctgtttcactgatatatttgttctgtattatggaaagtacagaaaagcagaaaaggaaaaaaatcaccttgttgtacagtcatagactaaggagaacgaattaaagtaacatgaaattctatcacccagagataggtaggcaggcagtagatacgtaggcaagtggtatgcttctgcggttttcttcacggttttagcttcagtgtttctttgtacacccctttcaccccatatctgttgatgtggagagctggaagcttgactgcttctccattccttctgttcattccggggtctcctcctgcagaacccagcccttgctgacatctacacagagcacgcccatcaggtggtggtggccaagtatgcgcccagcggattctacattgcctccggaggtactgtatgggggcaaggctcgtggacacctgtgggggcctgggtggcgctcagggcccagggcgaagctgggcttctggccttgggagagtgggaggagggaggtggggggtgggggagcaggctgggggtggtgagttgaggggagccagtataattagtttcagctgaggctgacaaggaatgtgtaagccagccttgtccaaccggtggcccatgggctgcatgtggccccggatggcttcgaatgcagcccaacacaaattggtacactttttaaaacgtgaggttttttttcttttcttttttcttttcaagctcatcagctatcgatagtattagtgtattttatctgtggcccagggaagccaaaagattgaacacccctggtgtaagctaccaaaatgccccttttcaaaactggccttagttctagaacagaaaggacactttctagtttgtagtgttgcagttagttccagcttggaggtcagcagaaatgccaccatgaggttggccagggaccttttgcgggaagccatggcatggtatgttggagcccttgtgggccgtgtgtgtgtgtgtgtgtgtgtgtgtgtgtgtgtctgtgtgtgtgtgtgtgtgtgtatgtgtgaatggatgttttgttttgtgtcatctttacccgctgctcctttcccagtgctaccacaatgctggcctccaggccagcgctcacgttttatttgtacactgggcctttgctctctgcagcctgggcttttgtgtggctcagtgggaggctaggcagaggcaggggtggagagatctttcctcttgaaggatgtttttttatttacttagttctttgacgcagagcttttcctgtacacagatgggaacaagaggtacaggagtgagagtggtaccccttctagaatggtggcccactcattcattcactcactcattcattcataagctcaacagatacttactgcctgccttgcctagccatctgcagcccagggaggccaagtgagtaagctgatgtgggcctcatcagcctctctggagagtgacagctatgaccaaattgctgagagagctaagcaccagtaggggagggcgggactcatgcacgccgtggccctatgcttgtaccatcctgcgtgtgcacagcagcctgtcctgaagggtgtatgggagatggtaggccttggggttggggaagacctgggttcggctctgtcttactctgctttgtgctcacaggctgggtaatttacgactaacacaaatgtattggctcatagttcttggggctgggcagttggacagcaggggccgttgcacagcaggggccggtatctgtcaagggccttttgctgtgtcagtccatggcagaagaacaaagagaaggtgagagaagaagaggggctgggcttgtccttttattgggaagctgctcatgtcataatacccattcctgagggcagagccctcctggcctaatcacctctccataggccgcctctgatgcattggggattaagtttccagcacatggttttcgaggtcacactcagaccatggcagcctcttactggtggcgtagccttagttgagtaactcaccttcctgggcccaaattttctcttccaaactggggctgctagtgcctgcctcttagggtgtgaaggagccagtaaggcatggatatgcccagcatggctgttgcactaatgggtacttacccctgggtgacccgttacctgtcacaaaactggggctctgttctgatcgagccaggcggctgggtgagctggctgactgctgttggcggtcagctgaggtcacggtgaagggttgggcccggagtctggctcatagtaggcatttaatggtttttgtgtttagatcttctccagctccatctgtaaaacatgctctcatttacatcccatgatttatttagctctgtgatttattttttccccaagccctgcttgccagcaaaagtctcttcatttaaagccccaagatttggcccgaatgtcttttacatgtttaacatggagccgaatgctcttagaagtgtcttctcaggagaggaatgcagttggcaagggcctccgctcctgcctggcacattgtccgtgccctgtcagctgcaagctgagaacctgcgggcccaggcctgccctgtccccagtccccagaaaggtgtccaatgagacagaattcaatggaaggctgttgcggagactgttgcaaaggacagaccacataaataagtggccatcgtgggacgctgtcctccctgaaaagtgccctgattttgtagaggagccaagggagtttggggccatcctcaggtccaagtgttcttgggcgagatcatattttatgtttctaatacatttctttgaatagagcgaagcaattgttaaggcttacattggaacgtttgctgcagagatgaagtggggctaaaaatagtgtggtaggggggtggtttggagaagggggctgagaaagagccgtgctggcccactaagtgggttgcctggcagctggccccagccctctgcaggatctttagaccctgtcagtctgactggttcatgactgctgaagtgttgaaccttgggaagggctgcgcacctgggagcctccggcactctgggagcccacattcccacggggcagtcctcagtgcacaggtcatttcgggggcaggcccaggcctccttttcctgaggttattttcatgatactgttctgtctgccttggcgctggggccgtggttccaggctgcccttgggagttggcgagggccatgtgacaggcgtgtggtttggccttacgtaggcccagggcaggcttcctggaggaaggcgcctctttcagggtgggacgccctctgccttgtcctgagagcaatgtcttctccatggggcagcatgggccctggatgggcctgagcatagcagaccacgtggtcacatgtgcatgtgtggacatgtgtgcatgtgtggatatgtatgctcctgagtgtatctgcatgtccttcctgcacacacagtgctcccctccgatgctgccagcctgtggtgacttcctcttctgaccccttcttcccccccggcctgttttatcagtgaaaggacttaactaagcagatctccaggtcacctttggaactcagctcaggtagcacagcaggtggtcttcctggaccttgtgcagagaactgggcccttctgggactccccttagttagtgctgttcactggatttggcatcacctcttgcctgtccccgcagctggactgagagcaggacagtccttacgtgcatctccctcatctcagaggatggctcagtctaggctcgggctgtgtctgcccacaagcaaggcatcttcgtggcctgtgtagagcctccgttaattcgtggactcgttccacctgactcgtaacgagctcttgctgtgcactgaagactagttggagacttcgcacgtgttaactcgtggaacctacagcagccctgtgagtggctctgttatttccactcttctggataaggacacaagccatgttgcttgctgagccccacaaagcctgtgtgtggcagaggctggatttgaacccagggcccctgctcccaaggcctggctcttagctgctgccctcctttgagctgctcagttgcagcaagaaaacaaaagctcttttcactggaagcagctgtagagctgtggtggttgttaacgtgtcctgacaatcctcttaaaaaggcgcctttacctgcttagcagatggggctgaggttttaaagcgtgaagccttgagagttagtctagaatgctcccatttcttcacgccaacacagtgctcatttggagagggtgtgtcgggattgggacttggtacttggtgacaggatcgtggtgggggattgggggtacgtggcccccggtgttgcttctgttacaattggctgcccacgctccggtgagaagagaatcagcatcgagttctgtgtgtaattctccttcccccgcaacacccacctgctactctcacagaagaatcttacgcttggattcctgtgcgtcgtggaactgctcggtgtgtgagtgaggctgctgatttgccaggcagcagcacgctgttgggaagctgcacaggaagcccggtctgcaggcccaggtggaggccgccaggccacgctgaggcatcgcagtgggcagcacgctgcaccctcacagctgtgcacctcgtttccagaagtcactgcagcaactgcaaaggagaggcaggtgtagccagtgccgtcccattccacaaaggtggcctgaggcccacacgtcattctgatgcccctacaagaaaagaaacacagtgagaaaactaaaccacttcctggcatattggagtttaccatgatgtgtccctgggctttttctgatgcctaagcagggtttgttatccagatgatttctggcaagatttctggcaaaatgcagaggcccaaatggcaggcctctggatgccacgggctctgacttaagggtggctgaatattgttgccctaagacacgttctcttcactaggccttttcctctagaaagcctaagcaaccagacatggttctgagtgggcctatggccacgtggccctggcccggcagtgacctgtggctctccccctgccctttaccccaccaccgcctccccccctcccccgcccgctgtgccccacagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtgagtcactcctctcagcccctccctgccctgttgctgtggctcatgcgtccatgtgctatgaccctgggagggggatgcgctgatgtctgtactaacttgcactcgtgagggttgagctcccagtaggtgccgggccccgtgagggctggctgcagccccaggtaaggtagaactccacatcacactgggtttgtcaccagggcccagcactcatgtatctcctctgacgtcctgagtgccttgcctgctagaaccccagctctcatgcccacctgcaggcagcaagaaggggacagagtgaaagagcaacagcacttctattcggggtccctcacagcagctgccccatgaagctgccagggaggctgaactgtttcttccagctgggcacctcccccaagggtctctgatggaggagggaggggcagtggatgctggctgggtggcactgggtggctactgacctcaggggcctagtgactggtgaggttggtgccgaaacccaggtttttttaattcaagagagtcagagtcccccctgcagcaccatggctggccataaccccttgaacttgacagtggcatgtctgttcttcactgaatggcactttctcgtacatgttctagtaggtgtttttccatggcttctcaagtcattcctgttggtcttaattccttcttttttcagtagcaaatagtaactaaaacagtgtttttgttgaatgtcagccaagagcagggcatctcattcctgtaggggatggtaactgttccctcccaatagaactgtaaggagaatggtgaagctgtaaagatagccctgggccctgtggcgtggggccccacagacacacacatgcatccccttcccgaaggcgccggcttgccccatcttgttcttgggtcctttggacaaatgccttgtggagccagaaccccagtgcttccctcatttgtccctgtggcgttctgagctgcctgctgacagtcactccatcctctgtgcactggcagctcagctatcagattgcttaccagccttctgggattgattttttttttttttttttgtcttccacctgtgtcattgggtcaaggtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgtaagtgaacttactttttgggtgaaatttgtggtttgtacatgaggctagcagaggctgagcctgtttagatgctgatggcagagaccacagcacatgccacgtatgccatgatacacagaagtgggctcccaggggtgtgcagagagagggagggctcccccacccagcactcgtcctccccaggccctcagctgggcatggatggttcccacaaggaagggccctgccctaggatgatgtgtgcctgtcggggattggggcaggaatgtccctgaccgtgtaaccaggcaagcatctggggctggaggtgctcattagagaggggagcctgcagggcctgctgttagctgagccaccaaagtggcagaggaagggagcttgcgggacatccagattggtctctcctagagacagtgagggcagtgatgcgcctgcaaagtgacaaacggttagaagactgaaagatactttgtggaagaaatgtgccagaaatgcggcaggctttgggtgtagctggcagcatctcagaggcccatgccgtgcatgcgccccgccttaggcacccaggccttgccaagcctcctcacttctcccttctgcaagacgggggtgtgccggggccagcagcatctgagggttttgactatgaatttgaagtaggagagccacctggcaggtctggagcatctgtgatgcccattttcctgccccagctttgtaggagtgaggggaggagcccagcagccagtctcagcacaaccccacggctctgccctggctttccccatcccgcttgtgcttgcgctgaggatggacaagaacaatggacccggaaatgcacattttagggactgttgatgtccttggaggaggttgtgtttgcagattggaccaagttctcgggactcctcttggaaccgtcagtggtttcactgtctgcctcatggaggattaatgagatcatgtccttaaagtggctcagtgaggagcactgtccattttagtgacatcatgccatgaatcataaatagcctgcgcagtgcagctggaaagggcgaggacgggacccacaaagtgagcagaatttccagagactgttcttggcttagggtacaggagggggctttccaaggatgccccgttcgtagtgaaacaggcttcattttgtcacggaaccgcaggctgagctgggcctggctgggcaggtgaaagcatagggaggctccctgtatgcagctgaacacgcggcagctctcagactctgctcttgtggctaccacctaatgggtaggtagtggagacctggctattttgggagctgtattgaaggctgtggcttcaggccatgtttcttcgctagggtggaggcactgcagagcagggtgagtaatgctgagtcagctgcacaccccatctcagcccagggcaggaggaagcagctcagagacttctgtggtagctagaagccggctgtgggtgggggctccttggcctgccctgggagggatcatttccactctgcagctgtgcattaaacccagcacagggtgctcagcagggtcaggggcaccagtttgttccaggggtgggctggagcctgtcttcttcaccaggctgctgtgcccctgtgtgcttgcttggggacttgtccagaacattctttctctttagttgtcctttctaacttcagaaaggacttcaccccactgccctggcccaggagtgttgggtacaaatgtctgcccagctagcccagctccagggtgggtaccaccatgtgtcttgaagtcttttgtggaacccacaaccatgggccctgcctgaggacctgggagaaatagaaagggctgtggcctggcacagagctaggtggctgtgcccccctcgggtgagtcatgcctctgggccctcccggaaacagggtgacagtgacccttgcgtgctgcaccctcagccacagggagggtgtgagaggcagcagtgaccatccacatgctcaggagacatgtgcggactcaactgcccacgcataggaaggacaggaagggtgctcagggaccccacacctgcccccaaataccttctgagttgcagatacactttggtgtgtatctgcacttaagccctccggaccccagaggaaagctgcggtcgtgctctccatgaccaaccccaagacaaagggagcgcgtgcaggctgggggaagtgagaggaggtgtgagtgctaacatgaggcccagccacagtcagctttgaggacatggtgggctgagcatcgctgggcttcctcccgtatgtgggctcttctgatgtggtcggaaagcctgggatgtggaagttctcaggaattaattgagcctgttatagtaaaagattttaaaaccatatgtgggcattttttattttagagggaattaagttccacttgctgtgaaatccacatagcagtggtcttttttccccagatctttcattctgcagcacatgacggctgagtctgggctgcctttgcctccgcaccagcgctcaggccttggtggccttgcctgccgcccctcgcctcctgagaatgagcagctgtggtggcaactcgggcctgtcttcatctgcgccttctgcacccactccctgcagaggccccctgtggccgggaccaggaagctgccctgagcttgggggtgcagcgctggggtggcaggtgcttccctagttacccaggtgggagagggactggcgtatgactgcggagggaccagctgggtcgtgttggagctgctgccttgaaaaggaacaaggcatgttctgaaggcgtttcagtacaagctgaagcagaactccatgatgctgtgcctgagctgaaatgcaagcagcattccctgtgtgcccctcgtcctgagggaccgtagcccagctttggtcttcatttgcctgaatgaggctccaggaagatgggagtggaggaacatttggcctggaataagcctgggtgccggctcattcctacccagtgacattgaagacgcggtaggtgacctgcggaagtaacttccggggttacaggagaacggttctgaaaggagaccctgggcaccgtggtctcgggtctccagcactggcattttgcgaacccaggggtaggttcccctcagagggtctgaccgtggcctgaaaaagggagggtggcgagaccatctccctgccttcccccatctcacccatggggatgtcttcatgccaggcaggctcctgggataggtactcctggatgggtttaaaggccccactgagtttctctctgttgtctgccttcgccatgcgcattacttgggccaggttctttgcctctctggccatccgcttcctccggtcgggtgagcagttggtttggtggtctaggatgaccacacgccccctctggagtgtggctcacagctgtgtgcatgtcctaggtcccaggagttggtggtgcactggatagtttgtgtctaatgaaatggttacttagagcagcatgtcgtcctgggggctcagccttatgatgcagaactgagaactcactgccagatctaacaagctgtgattgtaggtggaaaaatgttcagcacggaagacttctggcttccctcactggggtgccactgctccctctgttccattgcctctgccctgcggggacctcatacctcacatagttctcccacttgaggctggagccaagcagggctggaaacctcagctgtggctgttaccggaagtgctgccttcctgatagataaggaaaatttgagctcaaaacaggcaaggtttctggtggtttttctttttcatatttcctcactcaagacagggcagagagcagatgtttcagcccttctggcatgtatggtggctgcctgggccatgcccctgtgatgggcatgcaggaccgcctcccttgtcttcagcacgcgccacccctcctgtcgactggccttgctcttcactgggctgatggctgactcctgaaaactgggggctgacagcagggagggtgacctggcccaggtcacatggccagtaggtgccccaaggacggttagttaggatgagcctcttgtcccttcatatggtccttgttctccagggaacatggtgactgagctgacccgtcccgggtgacgggagaggcagttgggtgggtagctccttcgtgcccctcagcccaactaagtggaccgggctgcagggctgccccagggcactttgcagggaagtttgctgcgggggatgggtgggctgaaggatggtccagagccagcctcgcaggtcacggtgtaaaggtgttttgggaacacccattgaccaagggtcgtggaggcccgtgctgggcttgtgtggggtgggactgggcacaggggaccgagagcctgtccccttctaccagctcataggcatgtgaacagcctaagggtgggcttgtggtcctcttgtgtacagggtcagctgaggctggggggaatggggtgggctcccagagggttcctgagctgactaggtaggtagtgagcatgtgtgtgctggagacaggccagctggggcctgcagcgctctgtcgctctgtgatgttgacatgggtgtggtacttaattatgacctcagtgcttcaagcctcggtttcctcggtggtgagagggagcatattggtgggagggagtgaggactgtggggaggggggctcgttgatacaggtcagtcttggctatgtgttggctgcaagggaggacaggcaggagtgtggaccggacaccgtcagttgtccaccagggatgaggctggactgagactgctgcagccccgctggttggctggggtggggcagaggcagggggccggtgagggcagcctcaggaagctgctgcccctgaactccccgggaggttccccaatccctctccctctttgttcactggccgggcctccgtgtggaaagggctatttttagccctcgctttttttggttaatgggcttttcgcggcttctctctttgaaggggctatttcaggagcagacatcagtgtctgcatttggactccttggctcgaggtgcaggaaaaggtgatggggatgagctactcgaggggcatctgtgtccctggactgtgccgggcccctcccttgcccctgctgggttctggggccagggagggacacatgacaccaccctgccagagcctgtgggaggcgtcggcagaggtgaaccacagacttggatttggggtcctggggtttgcgcgagcaggaatgtcctcgcttctgggacctggaactggagtaggaatgtccatgttttgacctcagggagccactgaaatgggcacttgtgacaggttggaattgaacagtggctgattagtttcctccattttgtagcaagagccatcagcgtccactgtcccacccactcatctgggcttgggtgattcgggcatttggggtgagctcttttctcttagttcttaactcattcgtcagaaggacccaggggtcagccaggcccagccatctccctggcccactgcacttcaaggaagctcaggctggcttggaggagccagtgcgaagtcagcggcaaggcgaggctgtgctggccaaggaagcggagttcggcagcgagagaactcgatgtgctggtcagaggtctaggattcgagctgtggttatgtcatggtcaaggttgtgtggcctcatctggaaggagtagtggtgcatacacccctgtccaccccccgcccaacagggggtctagaagtgctttgcctcaggccctcccaccactgccttcactgcagccggctccttcctgcagctctctcgggaactgccctgtgaggccctttgacacagggaatgtggaccctatggactgacatggacaagggaccgtgggccatgttgacacagataggaggtggaccccatcggctaaccccgacgggaacaggccctcagtgcatgacggctccctcatggtgggtaacagcagaaggggggatgcaaatgggcctgcggagttagggatctgacctctgggatgactctgggctggagcacccccaggcttgctgagcagctgcccaaggcccaggagccagcgcagctgagacgagagctctggacaggaaactggagaccagattcgtgcaggtgatgtggctttgagttacccgctgctccaggcctggtgttctcctgtgaagaatttgcccgcaggctctccatggcccctcggggggtaaagcgtctctggagggccctggagccccatctggaaagttggttttcactctcagcagctgagtggatcgggccttctggggaaactgctttccccaacttcacatacctagaagtgctagaaaacttagaacacagaccatttaagcaaagaagaccagccttagaactagtgaaaaaggtacaaaaggaactaaagaagcaagatgcagaactgcgcttaaacacaaggaagggtgacctctagcaccatagccagagacgaccgtccagtcctgtgttccccgttccatctcctagtgagccctgggcccgcctgggtactgcacgccttgtagtttggcactgccttgcctggccaagccttgcagcacccaggtgcggggggcaggcaaagggctcgccagccccatcgctcatgagctgatcacagacctgagcccaagttcagactgagccagcctggtgcttccatccctgtcctcttgggcggtgaccacaacctacagaggacgagctcttcagtcatagaacggaatgcaagcaccatgacagcactccctgaaatgaggcagggaggacaatctgctcatccactgggatggaaacgtgactgtcgtcgccctcagtagctcccgaggagcactgggactccccttgtcagaatgtgtgatttctccggctttcatctaagttaaaacacgggtcaatgaggtgggagatcctggttcaggtgcagggccagggcctgctgggcctgtgtccagcctgaccccagccgtgagcaggtcttggcagcaccctgaggagggcttacctgaggcaagcaagtttgggttgttggctggaggaaatggtttaatctttgaagtgcaggaagcccagggttgcttttgtgccacaggtctggggtcgcatcactcttgggcctagagagatttctggggcggggagtggcctctctacgagaactgcctgccctggggacattgccagactgaacggtgtctgtatcttctgctgactctgacggactttgtggggacatcgatttccttgagtgtggcccttgggacccccaggcacctgattcctctttctgggcctatgtttcctcattggtgaaatgggcacagctcaccttggtgggttattacatgagtgtcagaggcagcattgatgacatgtgttagtgtgccgcagctgccataacaaagtttgttaagccacagattgggtgccttaaacaatggaaatttattctctggaagtcagaagtctgtagtcaaggtgtgggcagggacgcactccgagtccttccttgtctttcccagatactgacagccctgggggttactttttgtgagcagaactcccatctctgcctccagcttcaccccaactctgtatctgtgtccagatttccctcttaaaaggacaccaagtcctgctggatttacagcctgccctaatgacctcattttaactggactgcatctgcaaagaccctgtttctgaataaggtctcattgggtcccagggttgggacttcagcatgtcttttggagaggcacaattcaactgaaaacattacacaatcaaacacaggcaggtcccccacacaggtagctcatgctttaaaattaagtccgtgatttacttagagcgcggggcagcttatccgccttggggttgaattgcttttcctgaaggttagtgttcgtacctgctgagcagcgagcccttcctgtgccaagagagttgttagcactggatgtgcatttgccgggttagcgccgcctgcaggtgggcagcaagagggcagggcaggtgttggcagctttacaactgcttatttaaggatcagtctctgatacaaactcttgttgactgcggaaagaatgcattcatttccttattcgagtaacagagtcgcccctggaagtcatgtcatttccttttagtcgctcaggctcttgttcttgatgaaggtcataatcattaactttgtttaaaagttaattattggccaggcgcagtgacttactcctgtaatcccagcactttgggaggccaaagcggggaaacatgaggtcaggatactgagaccatcctggctaacaaagggaaaccccatctctactaaaaatacagaaattagccaggcgtggtggcgggcacctgtcgtcccagctactcgggaggctgaggcaggagaatggcgtgaacccgggaggcggagcttgtagtgagcagagattgtgccactgcactccagcctgggcaacagagccagacagggctggtgcctccaggaagaggcctcctggtctcagccatcgtgaagcttaaggattggggcttgagctctttcagagcccagagggaagagggcagctgctgggggcacctcactggggggggcataactggaggtggtctgccttcgctcgggctaatcagctttcccagcaggtagagcggtcagcatggcaggcaggctggagcagactcctgcccctccactaagggactgcccaggatgtttttttaagctctgaaattttccagtggactaacagttcacactgatgaacagctggagctgcaagctgtgtttcatagagagcattcttgaacctagagtcaggcctgcggcccctcatcaggcaggtaattgttttcctgcaggaccacagccgctttgtcaactgtgtgcgattctctcctgatgggaacagatttgccacagccagtgctgacggccaggtaagaactgggatgggttttggggtggggaatggcttgtctgcctgctcccgtgactgctcagagccgcaggctgcctaatgctagtcctgacatgcagaacttagacatcgccctccccacatctgcagactcgtcgtcagagcccagtaaatgcatgtctgcttttaaaccacactgggagcttagtctgtgagccccggttttctacagccacagtccatggagaaactgcttactccagagggtgttcacacacacatgacccacatgtttttatttcttggaagatatacatctatgacgggaagactggggagaaggtgtgcgcgctgggcggaagcaaggcccacgacggtgggatttacgcagtgagtatgagcgtgtttcccggcctagtggtgggaatttggccgagtccacgtgtcagtccatccacactcactccggagttagacaaaaacttgaaatgaggggctataagtcggggcggttttatatctgcccagaaaagctttaaggtcgcaataaggtgatgggagaaggtagtggctggaacgggagacctggaggcgggtgttgtccttggcctcactcatgtcccaccctctctctgggctccttctgtcctactcaaacagtcgcagtggacaagctgctttttggggtctctctccagtctgtagtcctctggcacatgacacactgcttttttctgaatagattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaaggtaaggcctgccctggggaaggctctgcccgctgggtggacagggaagagaccagagtggccagcaaggaaggggaaccgaggggaagccaggtggaagctagagaggtgtcctcaggcctccttggcccttggggttttggtggaaggctgggatgctggttgctttcttgggacatgagtttagccatggtggcaggccaggtgccaagttccccttgagctactgtgagaactggagagtcagggcctagtgattcggggcagtggccatcacccccagctgttgagagcggttacttcctgcagggctctgccttccctgaattgggagtgcacagcctgtgctttacccgactgcaggcaagagcagaagctcactgagcaccagggcaggtgacggggcatcgctgaggtccaggggcaggagggaggagcaagagcaggtggccttgggcctgggccttggcgctgcctggagtttgaatgtggtgggcagggtgtgaaggagatactggagttccataagggagcgatgggagcaggaggaaacggagttagaatcatccatgggtcccaggtgtgaaggccccaaatgccaacctggggaggagcaaggtgcctgcttctgaaccctaacccggaagggttcacttgagccaaaggctccctgtgttccattggctgggggggtcctgccttctccctccacccacaccagccaagttgacgcctctgggaatctcgcagctggacaggagccagagcaggggtcccttctgtatcctcaggtcctcctctcacagcagcgccctcgcctgcttcccacactgcatctgctgggaactccaagtcaggttcccccagcgctggtggcccagggtgggtgacccctcctgctattctaagctgtaatatcaaggcaggtggacaatgcacttcatcccagcagcccttctcgggctcctgctttaagccactcggggagacaaaccctagcacttccctcacccattgcatcctgctgccgtggagctctgggggaccagcctctgcagagggtctgaaccctgcagggctagtgtgggccagcctggagcagcccccgggcctgtgcactcggcccgtgctgtgctgtcagtggctccttcacaccacggcttctaggaggggctgctagaatcaccaaatccattctacatgggagtttgcccacgaggaaggggcctcgttaacgttgtgtgtgtgactcctacggaccaggtcacctcaacgctcatgcatagagtcacggttcctttgtgccggggcagtgggggcagcagcactgctgagagggggaaggctgaaccataaaggttcactagacgtggcctcgaggatagaggggaatcgggagcgcctccttgctgggctcacagcccagggtgatgagtataaaaaggaaggcacgcacagcatggggccgaggaggttgttgcctgggggagctgagggctcttgtcgagaccatgctccagtgggcctccaagtgggatggtgagaaattgtacacgggtgagtaaggcttcgctactgcccagaaaaacagtttcccatgagccatccccgacagtgttctccaggtgtcagccctcaggtctgccgtcccgtttctgttggcagggctgccctgagagtgctcttcctaataccactgctgccaactgtctggggccagtgcacccggcctgccaccgtggctaaacttatgtcccaaaaaagcaaccagcatcccacccttccaccaaaaccccaagggccagttgtcaaaacccccatgtcccaactctcaaatgccacacctgtgtgagtcacgcagatgctgatgttcggtgctgatctgggctgcagtgggatggagcagcaggtatcagcccaggctgcgtgttagaaccacctgggagctctaaaaagcgctggctgctgacgcccccagaggcactaagtttacagggaagtctcagggcagcaggagcttgcaggcctccagaaggaacacccgtgggcatctgggcatggctaggagtgtttctggtaagttcaaggcattgagcctgcacacaagtctcttggcctcttgccgagtgcacgttctgatttggcaggaaggtgggcctgagccctgctggtgggggctgtgctggtctgaggtccgcgctgtaagggactggtgggatgccacattggaaggaggccgcccagctcagtgtctcttactggggcatgtgatgatttttccccacgtctctgtggaaaagatgaaagtagctgcattcgttgcccattctccagtcccactggtaactgtgtacctgtctccaaggagacctgcatccaaagatctatgccatattgtggcaacatgtggcataccacagagatcaagaattcctgcggaaaagccctgagctcagaggagaggggccagccaggagctggcctccctttgcaggagaaaggcatgaggagcctgcaccctagctgttatttttgtctcaggctcagatatggagggggctaaacgccgccctctggaagcagctgtctggttgtggaccagccttgtgtgccctccactgcagcagtcagggaggttagggtaggagcgtcagcgttcacggacagccttgggcttttacagtgatcagagagacccctgccctcagcagggccagcactcctgggcagggagagagaagaaacctcacaaaccagggcctgaagcgaatgtggccagcgaagtcctcctggaccgacccccttgtggctccccgcgacgggtgctggtcggcggggtgcaggccacgtgtctgcacacgttaggtgctcaggtgctgacgtgctgggccttggttagacgcaggtctgggcccaggtctgggttaggtaccttggagggaggggaatgaagggcagggtctgtaggtgactgggtagctttggaaaggtttcttagggctcgtgggccgtgcattcgggcagctggggctactggggcctcagagcacctgcactgccatggattgaggggcgtctgccccctccattacccagaagcttcgttggtggaaagcgggtggcagagggcagggcagtgtgtcatcagcttacccgcccagtgtgtctccttcacagggtcacagtaaatcgatccagtgtctgacggtgcataaaaacggcggcaagtcctacatttactctgggagccacgacggacacattaatatcctttgactcaaagagctggctccggagccgctggctctaggggggaatttcctgttcccatgatgccagaggccaggccagccaggtggctccagctgcagccacagccacacgctcttctgacccgtgtggcttctaggggtggcctgtctgtacatggggacaggcaactgtcccctggagttgtccttggcaactccagggcttatgctgaggaaaagccatgggcggctccgacctgatcagtcccttcttgtcgtgcaaccctgagagtgtggcttaacggccctgagcttgggctgccactacctctgccaatggcacctggcgccagccttggccctactccacatggtgggtttcttgattcctagaattcacaagcacctggacacccttacgttgggtccccttgttttaaaaataggaaaaccagagcccagagagctgatgtgcccgccccagagtcatgcagcctgtggtccacagagccagggctggagctcctgcgaggtgccttgtggcccttcggtgatgttccctggaggtgtttgtgtcccccttataagtccttgtctgggtttctttaaatgagtcctggtttctccctgatgatgggggcttctgttgtgtttttcctgcatggcctggggctggtgacaccctgctcacgggtgtgtcttgaaccttggagccaccatctgcagagtgcctgggcagggatgcccacacacgttgctgatgatggcacctgctgtgcgttgttctgctgccctccctgagcaccgtgctgtgttggagactgccttttgtgtggacagctctggtccgcatgtgctgtacctcccaaagggactgtccgggacccaaggaggtccccccaggctgggagaggagggcagacatgccaccctctgcccccaaaacataaagaaatgtggggttagagggttgcgcctacccgataactagtagcagaggagacgccggagcctccccagcttgctggtccccagtaggccttcagcacggctccctttctgcctcatcccaatccctgtgtggtgcacccacacttcagataccccttcctaagaacgtgtcaacagtggacactgcaggcttcccagggggaatggttatgtccgtttgcggcgagattctcattcttgatgtaaatggagaatcttaggactgaagccacacctgagaacacccagcagtcctgggagccgggcttttccttaaccccaccctacattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacaggtgagagcactcgggtctgcgggggttccggatgagcctcagctcccctcggagggcttgtgccctccagcagttactgttctggaggacgcctcacttgctcctttcatctctcccaccccgtccccagcattgttctcctgttgttgggccctgagcccagcactgtgttacagatccaggtggtctgggtaatgctcttgcccacagacaacgaccaggtgtggactctgccctggaagcaggggcagcagatcacagccctgttctccaggaacctgctgcggtctctccctgtgtccctttcctcatcagtaaaggcgggtacagtggagcctgcctcaggctgttgtggattaggtgagcctggcacagggcaggtgctgagtacaagacagcattccccttctgctcaagggtgagatgggcacacagtgatctggttaaaagacaatgtcttgtttgtttttggtcttgggcctttgattggcagtcagtggagctaggagagtagcagtttgcaagtgatctgaagtcctaaatgcagttggagggacttgaaagagaaatgttccaggacctgacgaggccactgcacatccagtgtccccatgcccaggtctgacccctcctctggccctacatttcttgtgtagacccctttgtcacccggtagtcctgcctaagtcgtgttgcctgggagatggggactcctggggcctgttgatgggagcctggcacagggtgcagcacgcaactcctagcaggtgtgccgtccttgtaggtaacacaggccctgcctgcctggcagactgggcatctgtaggtaaattgggcctcccgatgagtggcagaagcggccccagagcccaggcatctgggccctggtcctctttctactgccctgtggtgaccccactcttaacacgtcccataaaagggtcttccctgggccagataacccaaggcaaggcccttacagagccagccttggcctggtgaccttgctgcagagcctttggggatgccacacttggccgagtgacacagaaatttccttgattatctcagttttcaagaagtttgtgtgtatgagtctttctagaacaagttttgatagcattggccaaggctaaaaataacatgattttcacccattaaaggtaacggattcttaaaagttacccatccattttggggagcagagctcaattctgtctgtgctcagtaaactccagtctttagccaacagacagggggacaaaagccacatctgggtgtaatgagggcttaccacagataaataggagcataatcaacgcctttcaccgcctcccgcccctccttcccccccccccacccctccccgggcccccattatgacttataatctctttgcaccagagtcatggatcgttttttcgctaccatcccatattttagcaagtctctccagtataggtggcaatagaattgccttctaaggagcaaaactgtggtttaacagtaaatatgtatgcatacctaccctgagctgctgcattgtcgaagtaatgtgcttcctttctctctaacagcggacaaggagttgtgaaactggacgttcagccaaagtgcgtagccgtcggccccgggggatacgccgtggtcgtgtgcattggacaggtagggacctggcttagtgtttgggtgggagcctgcagctgtgtggtgcctgcttgctgaatttgactcatgtcccgtttgacagttgctctagccagtgttttggttgagtgctcatttgcactgcactaagggatctcacatatttaatcctcaccaccatcacatcagttgtacagatgaagaaatggaggcacggaatggataaattggttgtccaaggccgcagctggtcggagggcagagctgggatttgtctctaagcctcagaccacgctgcctgcctgtcagcctgtaaagtctatgagataccctgtggggtgggcctgcctttgctcctgttcacatcccagccctgctgcattgtagctgtgtgacctccggcatttacctcaccctctctgagccttagtttcccatccccagcactcacagatccaggtgattatgaggaagtacatgtaagtctccttacaccatcttggttcctcttacagatgaggaggctgaggcctagagcagcttggtactttcccacatgcagaagggtggcacctgacttcccggcctggcttctaaccccagacagtggggccacctgcacacctttggaatatctggaccaaagccacctgagacccaagcctgacccactttatacagaattctgccctgcagaagatattatctgttggcgggcctaggcttgctggcatgtagaccggggaagtcaaggggcacctgttggcacgagtggcgagccctgctaaagaaagctgctttcagcaccctctggccctcctttgccttgtgaacttaattgcgttagggacagtggatttctctgtgtcctagataataagaaatccctgccaagtaattattgcaaacagcctggacagccagtgggggtggggaggtgcaaagggaatccacacatggagcgcctcggggcctgggggaaacgctacaaagcggagttctagaaggctggcaggtggcctatctctgcacagcagggctcttcccagccaaggggtctgcacatggggctttgtgggtgaggggatgaggcctagggcagcgtgccctgtgtctccagacccaggtttcctcatctgtaaagttgtggtcatcataggccaccctttcccctgaggctgagaggatgttcagactggcccagctggcgcctgctgcccaggaggttagaaaggaccccggtagggttgtggtgtgcaggggacaggctccaggtctctgcacctcctcatgtggcatttctctgtgatctgctgttacctgatcctcccagggcatctggaacccctgctctgggtcagaattttctgcagagctccctgtcaccagtcaaagagttaggagggtgctaggaggggcctgggattttagatcaggaaacaaccaggttcaagtctcatgtcggacgaagcttcaggcaaatgcttaggccctcattcttcacctgtgagtaggtaaggccacctccagagccgggcagatgacagaggtgcctcttcagtagtaggttttagtcagggtgctgctaccattcatcgcgatccacccacaatccacgcagaaacagaagcccagacggtaggggcagaggctgccttccctcatgacagctggtggcttgggtaggggcacactgggataaaggcaaaactcagagatgaaggccactgtctgggagcagttgagtaagttagaaccggaagaattgacaaggaagggagatggaaggaaggcccccgctgcagagcctctgctgcatgtaccagaggcaaaggcccagtgcgggtgccgaggcttggattctgggcgagtcccggctcagcctgtgggaactggagccttgggcgtgcagcataagcaccgtaccccattttcttctctgaaacggggaacccgatccctgccttgtggggctggaacactcacagcagagcgctggcacgtgcctaggggctgtcgctgtttttgtttactgttgttagtacctttcttaccctgaacgttgattcccatcgaggccaagtgactttccaagaggtggtgctgtggtgactgccttggaagtaatgtagtgatgacagtaatggtcacagttagttgtgtttcctgccccacctgactggctagagcaactgtcaaacgggacatgagtccaggtggtgtggctcagagccccaggtggccctgcaaagaggttgggtatggagccaaacccagctccagtgagccccgacagggacgcgcccctcctaccactgagggttttgtcccgaagggctggaccgcctgaccagctgcctgtgtgtgccacagattgtcctgctgaaggatcagaggaagtgcttcagcatcgacaaccccggctacgagcccgaagttgtggcagtgcaccccggcggggacacggtggcaattgggggtgtggtaagtcgctttcctctcccccgtgctctctgtccttggtatctgggtgatttggggacagtgtgagctgtgtgagtaccggggctgtctcagggaaggcgaggggtcaggggaaggatgggggcagtcggggcgtgggacctgctctggggcccagccacgccatctcctgccacccagggctggagccttcccctcccctcctcggcacttcccccacctcactgcccgggtgcccacaagactgtggacagtgaggtagagggagtgccgaggagggcacagctgtgcctcagagccagccccatgagtggcggcaggaggggagcgcaagagggtagcaggtcaggaaatcaaggaatggcatcccctggggctgggctcggctcacaggttgaaggaagagtgacagaagtttcccagcatcttcaaggtgcggtactaaccagacattttacagtttcccttgagttctgcctcggcataattctcatgcccttgaatttgtgtgtgtggtctggtcacagtgtgcctggccaagtcctgagtgctctgtagaagagctcatttcccctctccagcccaggagggcagccctctgataacccagtcctgcagcaggcgtggcagtgccctccatgctaggggctgggtgggtctatgtgctgccaggtccttcaggtgccggatgtgaccagggcatggagtggcttcctccaccagccagcttgagggcctcatgagaccagcggtgccccgaggtaccaacagctgttttcatagagctgcgtaggtttcaggcccatccacgggaagagccatgcccagctcctggcatgggcccagcagagcagcagtcagtgggaacggcacagtttcttaagccctcgacccccccttcacaaaggatgggtgtggtgtgtgtgttcaggggtggctcacttcctctctgtccctgccgtaggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggtgagtggcggcgggctcctcctctgtccccgtgctgggcggtgcaggtggcagtgggaggttatctgtgacttggtgaccttgagctgagcctgtctgagctgtagttttcttgcctctacaagtagcaggtgcctcgtgccatgcttctgaggagtcagtgggtttgcaggggtcgctggcatagagttagcgcgtgagaaacctcggtccttattgtcgccatgagggataagcgaggtgatatgggcaactgcggcctgaacctgacctgccacctctcttgttttcaacctgcaactaggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaaggtgacttccgcccccaggccttggcagggaccacccatggttcggggctccatgggccacctcacaggctgtcccctggcttcagtccccagggctaagtagcctctgtgcttctagacaggtggcccggaagagttgtgggtctccttccatccagcaaacaccagctgcgctgctggccgtactgagggaccacgggggccccatgcacaggacacctgctgagctgagtgaaggcctcacttttgacatcttcacttcccccactcaccccttaaatcccacctgggaccagggtctccccctccctaagacagccacgtccagtgtataatgtgagcctcatgtggcgttgaaatttcctggtagccacatttaaaaaagaaacaggtgaaatgatttgtaacagtaggttttatttagccccgcatgtcatcatttctccctgagggggttgtgatgtccccgcgtggccatgcacgtattgtaaggcagctctgtgttgtccaaaccctcccctccccgagtgcccccctaccactctcctcctagtgtgtagtcaagtcccctcatccattctccttgaagacatccttttgtgttaaacattaatggggccctttcctatttaaaaatgtctgagcccacccccagagcccattccccagctgcaggcttcaggtgcaggacaggcaaagagggaaggcagcccggtctggaagggaggagagacaaagcaggtttcaacgtccgtcctggtttataaggcaatcgccagtctggtagtgagaatcaaacaagttcatgaatgaaatggatccagaaaaaaatacagcaagagctagtcagatagagattaggaggtcggggtctgtgtcttcactgtgaggtcacaggccaccaaacatgaagtgacctcagcatcgggttctcgtgcagatagttgagttctgcatctggaaaagagccagcctggtgatgtggacagagtgctaaagcctggcctcacagccaagtcatgcttggtggttgaaggcgctcctgggcacctgtgccacccgcaggccaaggcttccttcatcaggatgtatgccgtgccaggcaggggtgggggctgaatctcaccctgtctaggtggggctgcagatctagaggctgggggccacccggacctggggagcagagagctggtgggaacccccttgcctgcagctgggagcctccctgggcttcatgggcagagctagccacagaggagccataagcgcacaggcaccgtctcactattggcatctcggttgggtggaggcaagattatggggaatcgaatctgttcacccacggtgtgactgtcacagaggggaaagtcagtggcccccccagtcctgtgtgttccagcctcttactggttgtcatgcctgccccattttaatagggcatggatacagtgtagctgtttgtgtggtgtctgcatgtcatcgcttttatacataagaagacattgttatttcactcctgtggaacttggttgtcaagacttggagagagggagccactggcatctgtaggtggagccagggatgctgctaattaccctgcagcacacaaaaaagaggtacccggccccggggttcaggagtgtcacgtggagaattcagccacactgccaccgtgccaggctcctgagttacaacgattcgtggccattttcttggccctggagatgatttaggcacaggttgttccatcttcctagtccaagatgtacatagttgcagagaagtttggcttttcgttaaattgcaccctttcttcccagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttc

SEQ ID NO: 35608 - DNA, 9752 bp, Homo sapiens
ctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggtaaacggccttgagcgcgagcgcagacgtgtaggcctgctttccgaggggcgagcgcggcgccgcggggaggagggcctgcgcgcagtcccgggcgcgttctagggcgccatgctgcgggaagtctcgcgcgattagtggggaggtctcgcggcttctggctacttggtggcgaggtgaagagcttctgcaggtgctgggggcggcgaacgcggcgggaaagacagagtcactgagcgcggggagggggcgctgggcctcggggtggagagatgagaccaaacttttgcgacgcgtacgagctgggactcgactcctgacgcacgtgcccgggagcgcggcctgccacgtgggccgcgccgcgtgggtcctggaatctccagagggaccgggtgccttgggccgggaaatggcggtatcggccctagtcggagtcccggctgcgctcggatgtctccgccccggcctggcaagccgacacgtggtgggccccggaaggtggctctgccgcgtgccttttgcgctgtgtttcgggcacgtggtggcctaccaggtacccccacgtggccgcgccgcctctttaaggggcggggttgtctcgctgggaaaggcataagcttcatgagaaaatcaaggtagtcatttttttaagtgccttaatgatcttcaccgttaatttggattcagatgagggtggtagaataaagtaccgggatttgtagtattaaaacacggttgtgcttaactaaggtaacgggaggagaaatcatttcctcaggttgactttttaccttagggcaggttttctgttggtaaagcctgggaggaaaaatgtgggcggttgagagtagtccctcttgcattgccatcaggagtagtttctatgttagttgtggtgtttggcactatgagaaatggatctgaggacggagatgatggcgtatgaacactaatggcaaaatatgaatggcctgaaatgtcgaggtggaggtgtaatgatctatttgtgtccattttaggcaggtaaaaatcaaggtgaccccaagaaaatggctcctcctccaaaggaggtagaagaagatagtgaagatgaggaaatgtcagaagatgaagaagatgatagcagtggagaagaggtaattttatccaacttaatgcagaattatgttaaaactacaaaatggagagttaagacatgaaattggatatctgtggcaaaaataagattttattcaggtatgtcttattgtagtggttgagtgtttcacaagctcttcattgacatgtcaagatgtcatttggctaagtatttgaatgtgagtgtaagacgagatctgggaatttcttttacatgttcctctgcagggcttggagtgtgatttgttgtgttaaatcattacatttttccagtttcaacatgttagcctcacccccacatgtagagctgggcattgtattcagagctgaggataaccttaccagattcctttcctagcctccaattaaaattaattggtctccattccattatatataaactttgtaatactactcactgtgttttatagttatctctggtgtagactgagggctgccacctctctttgtgttaccattgaccctctttagcactcctggccttttatttgctcactataaagacagctgagcactgaattgtgctcaggtttctcgttgagaactgaatgaaagttttactcttccacacattgcctgataaaactacgggattttaatgtagctaaatgatgacttttatcaaactaccatgcacactctttgatgtgtgatagttttgtaaggaatatttatatttagcctattcattttttgtctcaggtcctaagaattgagcttcactgggcttggtaccgccacccactgtaggagccccaaatgatttaataagttaatgcttggagcctcctatgtgtaaggttctgaataatttacacatagcaattcatgatccttaaacatgtaaggatgatactattaccattttcagatgagaaagttggggcttgggaaagtatgaggtgtaagaattcagagggtctggttcagaggtatttttaagtgttcaaaagagttccttatgtctgggtattcaccttatgataggggctctgacttaagacaacataacagaagcctggagtttaacatgctaatgtgtctagtgcatgtggtcttgaaccagaggcattgccagagtctaacatctcattgggaccatggttatctttttgggtgtggggctggacttactggtttggttttcatttattctcaaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatggtaaggagttgtcttggtagttactgggcttctgattacaaggtatcttgagattctgggatcaacatattccttccacgacaacctggagatgagattagaatccttgtgggaattctctgggttgttgtggtgtgctagacttaattacccatgaatgatttttgtgcctcttgagaaaatttcaatagcacattctattagtgttttttataatgtaggattttgtttctaagtgattttttttttttttaaatttttttgagatggagcttttgctgtttcccaggctggagtgcaatggcgcgctatctcggctcactgcagcctccatctcctgggttcaagcagttctgcctcagcctcccgagtagctgggattacaggtgcccaccaccacaccctactaatttttgtatttttagtagagacgacatttcaccatgttggccaggctggtctcgaacttttgacctcaggtgatccacccaccttggtctcccaaagtgctaggattacaggcgtgagccactgcgcccggccccaagtgatctattcttgccatgactgttaactaaacatggtgacaggattgcattttctttacattagatttgaaaaccgatgttggttttgggagattgctgcaatttttaggtgacttctctttcagactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaaggtacttaaattagattctgacatacgacatgagttatgtttaaaggaggcacttaagtgtttgtggctactgatgtgtgatacattgtttgacatcttgtccagagcctgtcaaagaagcacctggaaaacgaaagaaggaaatggccaaacagaaagcagctcctgaagccaagaaacagaaagtggaaggtaacttgcagaattaggggatatgggggagataaacagcacaaatgatgaataacaaagggacttaatactgaaacctgatgttacattgtagtgtgctgatgtgctgtgtatagaaattttgctttggaaactaactttttaccacactacaagtagactgagttgagctttttttgtgcaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggtaagtgcttcactgcacgttacatacacgtgggtctgttaatgcttttccttcccctgttagcacagttactttagcctgctactgttaaacatgaatactgtaaacatcttcaaggattagcattagtgaactaagttagaattaaactgtagatcccctaagttgcaatttccataatcagtcgtaacttggtatagcacagaataatttttagtaagtttttttgttgtttttgttatgtattgagacggacgctggcttttgctcaggctggagtacagtggcgcaatcttggctcactgcaacctctgcctcccgggttcaagcgattctcctgcctaagcctcccaagtagctgggattacgggtgcacttcaccatgcctggctaatttttgtatttttagttgagatggcatttcaccatgttggtcaggctggttttgaactcctgacctcaagtgatccacccacctcggcctctcgaagtgctgggattacaggcgtgagccaccctgccagtaagttttaataatttggtgttaggtgggagaatcgcttgaacctgggaggcagaggttgcagtgagccaagttcgcgccactgtactccagcctgggcaacagattgagacaccgtctcaatttaaaataatgtttattttcttggaagtacctgaaactattagacctgtctagtcatcatagtgaatacttttatccagacaggattctcctgtattagtgcttataggtgttcttttgtcagctgctactgtgaattcttataagcaatttagctccatgatgaagacctcaaacgtgaatgtgcatgtcatatcttcatgctgagaccttgttctgtagctgcagtttgcagagccttgactttgttttgctaatactaggggtgctttttaaaatgtgatctttgtttgcaccatcacatttgtctagaatacatattgtggattttgatttgtgttttcacctgttgtaattttgccctcctctccaccttgaaggaaatttggttatgtggattttgaatctgctgaagacctggagaaagcgttggaactcactggtttgaaagtctttggcaatgaaattaaactagagaaaccaaaaggaaaagacagtaagaaaggtatgtaaggctttatgagattatgcaatgaactcaggagctagactgctagggaaaatgctttgtaacccatttcccttggtttcctcttatttttttaaatcatttttttcctttggtttcctcttaatgtgggaattaaatgagctacagtgtttacaagagtacttggcactgcttgtcagtgttatagtgtaaattcctgagttaggcaagcaagagcacttttatacagaacaagaattattagatgcacctaaattaacgtaaagggatctttcttcactgaaactagattaggtccctaattactccctatatacagttgtaatgttttgaattggtacattcactttttttgttatgcgcgtctactctaggttgaactccagtgtacctaacagagagtttgacatcagctgtgacaacatggagggaccacttgtgtgttgacactgctatatctccatatttagcaccgagccttgtacattataggatctcaaattatttgttgaatagagctatgtgtgtttttcccctctttttgttgttgccccccacctttggtttttcaggccacagagctcatttttgtttttttaatctagagcgagatgcgagaacacttttggctaaaaatctcccttacaaagtcactcaggatgaattgaaagaagtgtttgaagatgctgcggagatcagattagtcagcaaggatgggaaaagtaaagggtatgttctgtctattgaaatgtaagggttttattaacattaatgcactttcctgctttataaaagaaatattggtttgatttccttaggcgtgtaatcttggacagtttaacctgtaagtttgtgcctcagtaacccatctgtaccatggggataatgtactcatagggtgattttaaaagacaagctaatacttacaaagaagcaagaaatgtgcctatcttacaataaatactttgtaagtagtagcagttctttcagtgaggtgaggttactatgaaaaaattccaagtatttgtaaaactagtgggaagtaagagggaagctcgagttttgattgaaaagtggcataaaactaagggcatttattgtactcagatctgaagcaagttctgtgttgctgaggtaaaagcatttgtgttaatatggttttaaaaaccatgagttcttctccctccattgcaggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtaagaaattaggcttgttacaaggtttcagaattggtggagggaactcctttgtgtctttgtatttcataagtttataaatactttttaatcaaagttactcaaatgtaggtgaagatcaaggacatgataccccaagtcatactcttatttggaatagtaatttccaatcttgaatgagagctctaaaatcattttgcattggaatacagtaggcaaatcaagcttcctttgtaggcatgttttatactttaaatgacttgaccatgtgcgttttgaactcagatgattctaggaaaacagaccagtcatcagcctatgtaagaacaaccagcaggacattgcaacacgtactaggtacttaatatgttgagtaacagaaatggatttagcttacgtcatgagtatttgtatattaactcaagcactgaaattcttaggaataagatattactgttgtgaccgaagctgggaaccactgtttcagagtcttaggaatgtggcatctctatttgcaggtgaatcaaaaactctggttttaagcaacctctcctacagtgcaacagaagaaactcttcaggaagtatttgagaaagcaacttttatcaaagtaccccagaaccaaaatggcaaatctaaagggtaagataatacctttgtatcatcagttataggctatatatgtcttagaggtctaaaggaacgtaaggtcatgtgatcctgtcagaaaagccaaataattttagctacgtaaatgagtgtaaaataaagatcatcatttaggtaccaacttgagagaaggggcttggcagcatcatgtgacagtgaaggagcatgtgcctggtaacttactctaagcattaactgttcatcctcaggtatgcatttatagagtttgcttcattcgaagacgctaaagaagctttaaattcctgtaataaaagggaaattgagggcagagcaatcaggctggagttgcaaggacccaggggatcacctaatgccagaagccgtaagttcacctggttagggtgctgtggttgggggtagcactctcggtgctttgtttattttttgcacaaattctgtgtttcctgttgctactgagtgaacaataactggatatgatgactgattacctgagaaataattgatgaaatctcaagaaaattcctctagatagtcaagttctgatccagctgtgtcaactcagagtagcaagtttgcccatgatttcctgccccatccactgggccccacctgcttgggttgcttctcccactttccatagaagatctggggcaggatatcaactatgcaatggcaattaaaaaatgtaaacccagaatagcctttactttaattaaggactagttggcttagttgcttttaactgctttttcactataacaagtattcttggctagtagtcatactaggcattgtgcaaattcagtgttacgaactgtgacttcacataaagtcacatttttttttccttcccagagccatccaaaactctgtttgtcaaaggcctgtctgaggataccactgaagagacattaaaggagtcatttgacggctccgttcgggcaaggatagttactgaccgggaaactgggtcctccaaagggtaagggaaggaagcgtgagtgctgcttccacttgaaggggtttttgttctgtgcagaccttgagtctaatgtgtcttctcattgagctcctttctgtctatcagtggcagtttatggattcgcacgagaagaagagagaattcacagaactagcattattttaccttctgtctttacagaggtatatttagctgtattgtgagacattctggggttcaagctgtcacaccagttagttttccatagagagctactctgtcactggtatcttttcccaaataaacaaggctactttctgtgggatggctccccagcatgtacagttaacttgggacatgtgtagtaggtgctttttataatgggcaatttcatttggtgttctaggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggaggtaaggcacgcagagataatgacaccacatagcatgtgctcttcagaccctgtgccctgtcacggttcctaatcactggggaggaggagctttgtacccattcttttaacagtgtcttgccttcctcctgtagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccag

SEQ ID NO: 35609 - DNA, 42610 bp, Homo sapiens; identical to SEQ ID NO: 35607

SEQ ID NO: 35610 - DNA, 139136 bp, Homo sapiens
ctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgagttcagggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtagttgggggcaggaggggaagatgtgtttcggaattgagggtttagggggaccagaggccaggggtgtggctgatagagcctggaggccgtggggggaaccgtctttcttccccgctcggcgtcgttcactgagaggctgagacgtgtccagcaagccaaagggaaaagggattccctcaaaggtttgctcattgatgggcgaacgtcgtctctcgggtaacttgagggtaagagacaacctcttccctgctccgtaatggaggagcatatcgctagaatcttgaccacctggggaaagaagaggcattccttactcttggaggaaggaaagagtaacctccagaattgacccgatgtaagagagggggaagcaaatgggggcaaatcttaacccagcatcttttttttttttttctttttctgggctctgcagtaatggtctggtttgggaaaggctgtagattaagctgaaagtaaagaaactggaacgtcctgttatttccttatcatttgaatccaaatcatttgttcatgctgcttgttttcaagagtagtcttctattggaggggtggggtggggggggacaggcctttattgaactcacgcggatgcttcattaaacttttgacttttattttattttatttttgtatttttagtgacagggtcttactgtgtagcccagtctggtctcgaactcctgggcccaagcgatcctcccgcttcggcctcctaaagttttgtgattacaggcgtgagccagcgcgcccagccaaacttgacttttgagaagaaaaaatgttttgaaaactgccaaagacttatcataaccattgtggtttaaaagaaagtaaatgcattaagcttagaaaggcagaatgactaagaaagaaggtggtctcaatgagaatcaatttaaatgattagttaccttccttgtatacttcaattgcttagcctcagggtacacttacaaagtagtaatagaaagcagcagatgaaggaggtgcagctctataagaaaacgtgttaagacattccagtgatgactaagcgtgctggtaaggtgagaactgtttgcagtatcttagccgttgaaactttcaaggaagcagaaaggatgatgtataatgcaaacatcctcactaaaagctgggtggtaaaatcaatataaatctaatattctgactgtgtatgaagaaactcaaggaagtccagttctttcattctttctttccttaaaagatccatattttgaaatactaactttttaggcacaggtttgaacgaagctgagcaaggaatatattaaatagggcacgttctcctttctcttgtcctttctttccttctagccttaggttttccagagtttaatgttattttggttaagaattagatgtaaaacttttgaactcctttgcttcgttataatattaagaagctactttgtagtctgttatgtttaaatagaaatcacaggtgattttagcttttgtgtctcataatttcttatgagcaaggtaatacctgatgatgctattgtctttgcattattactgaatatttgattagaaatgaatttggcacctctcacctttataataaaagattactggaatgacatttctgctttataatttggttaactttggccagtttttcactatgagcactgagctttgtaaagtcccactttgtgaaaagaagggtttagtgactttacaaactaatttagcttcccagagagccatttgaattaagaccctattaatttttttctgaccttattctacccaaggtattaatcttattttgctgctcagtttctcttttggggaactggagggagatataggagaggagggactttgacaacctatatttggtagaaactaggttatgttaaatctggatatatagtcctgtgcagggaggccttctccgaaatgcagtgacatcacactctggtcgagggcaagtaagagtgattatgtgctttgactctggcagctttgttgtttaacagtggccttaggccataccgtaaatcctcagaacagccgttacttgtctggtttgatctggtagaaaggtagtgtgagttcaaattccatcatggctttgcttatttctctggctcttctgaaggaacattttctccccccataggagcagcttgatttttgaggcacttcagcaaatattagattttttttttctttagctctattttgtttactttttctgtaacttctttttttttttttttttttgagacggagtctcactctttcgcccaggctggagtgcagtggcgcgatctcggctcactgcaagctctgcctcctgggttcacaccattctcctgtctcagcttcccgagtagctgggactacaggcgcccgccacacgcctggctaattttttgtatttttagtagagacagggtttcaccgtgttagccaggatggtctcgatctcctgaccttgtgatccgcccgcctcccaaagtgctgggattacaggcgtgagccaccgcgaccggctgtaacttctaatgaagacgtcagtttttgccatcctgtattttggagactctggctatgtccatatctagcatgtgattaagtgtatctctcattatatgaggtgagaactcattatatgagagatacactgaatcatatatatatgtgatttttttttgaggtgaaattcacgtaccataaaattaaccaggttaaggcatacagttcagtggcatttagtacactgacagtgttgtgcaacaatcatgtcttctgatttgtttttatttacactattttcatttttcttggagtttcttttggcttaaggcaagaaccagcttggcaccatgtttctctgccaatatggttagggaatattttgttactattgtttacaatatggttactagagtgatatcccttctctttagagcagcagggactcttaatttagaatctatcttataggcttctaaagatacttgaccctcctctcttccctgaaattttgtgggtgggtgcattattttctagttaagacaagaacacttaatgctcacagtgaacaggatagtaatatattccttgacattgaaattgttaggggagataatgaaatatgtgagctactgataaaggtatgacttaagacttaggttaatttattgtttaatagaatgtagtgaaaatgcctgttaagaatttactcatgcctgtaatcccagcactttgggaggccgaggtggatggataacttgatgtcaggagttccagaccagcctggctaacaaggaaaaaccctgtctctactaaaatacaaaaattagctgggcgtggtagtgggtgcctgtagtcccagctactctgaaggctaaggcaggagaatcacttgaacctgggaggcaaaggttggagtgagcccaaattgaaccactgcactggagcctgggccacagtgagattttgtctcaaaaaaaaaaaaaaaaaaaaaagaatttaatgggctgggcacggtgatcccaacatgtagtcccagctactcgggaggctgaggcaggaggattgcttgagcccagaaggcagatgttgcagtgagtcccagctgggactacaggcatgtgctaccatgcccggctaatttttgtatttttattagagacggagtttcgccacgttccccagactggtctcgatctcctgagctcaagccatccgcacgcctcgtcctcccaaagtgttgggattacaggcgtgagccaccgtgcctggccaaaaaaaatttaatatgtgtatgtataagaggcttttcagagaaattgggtgacaaattctaaggaggttttgttttaaaatcttaaacaagttttaaaggacatagcatagcatagtaaatatcctagacagattgtaatggatttgagctatagtccttctttgaggctcaagtaatcgtttctgtttactggtttttctgtttgtatatatacattcataaataacttcagatttattccaggtcttttatgtgaagaattcctttcttcatttgcccacttcacatttagtttacattatgaatggactaaatgattataacattctttgaatttttgctagaaacacattgtaaaaacattgcataaggcaagcttcagtataatttttaattataacaagtattaaaggagaaatttctatattctgtaatgatatttgtgagtcctagctcacttcttttaacaagatcattctgtgaatttctggtacaatctaaagagctattaggatcaagactataaatagtaattagctggttggaaagatagcaaatgagtctaatttccattaaactgtacaagtagcacgttttagagatcagatttgaaccagaagtttttcattattttatgtttatctggctcttttttcttttctttaattacattgatttgtttggtgcttaggtcttttctcctagatccatatttactattgtttgccaaatacattatgtcatattgacctgataataatgagcaggtgccagcatgtcttgtcctgaagttggtgataagtattattagtgatggtgataaggaaaaagatactcattttgagtacagaaggaatattattaaaaaatatatgtatatttatatatttttttccccttgagacaaggtctctgtcgctgaggctggagtgcagtggtgagatcatagctccctgtagccttgatctcctaagctcaagcgatccacacacctcagcctcccaagtagctgagactacaggtacatgccaccatgcctgagccaccgcgcctggcccaaattcctatttatttatttatttatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggctggtcttgaactcctgacctcaagtgatccacccggcagcctcacaaagtgctgggattacaggcgtgagctactgtgcctggccccaaaattttaatatatttaaagaagtctggtacattggacaaagtcttatagtttctcaaatcagaaaaagtagtcttattatttagtaaaaatgtgaccagactgtgccgtttttgttagtagagccatttgtcatctggattacttcttctggaaattgggatggaagagttaaggttgaggttgagatccacgttcttttgtttcaacaccagtttgattctcgtgtctgaacggatgtctcagtcttttgccttgtttttaactataaactggcattatttgggaatactcttgggctaaatctggattgttggaagtaagaaagccacatttttttttaaatccaaaaatatagttagatacaatgaataagatctagtatttgatagcacaaaagggtgactgcggtcaacaataatttactgtacatttaaaaataactaaaagaatgtaattgaattgtttataatacaaagaaaggataaatgcttgaggtgatggatatcccatttacactaatgtaattattatgcattgtctgcctgttatcaaaatatctcatgtacctatacgcacctactaaatacccacaaaactaaaaattaaaaaaattccatgcataagtcatggttgcctctctagatgtttgttgtgaaagaatattgtcctactaattttgaattttttttttctgaaagagattctttttattgaaagtttcatgtcatagatcggcaaaattgttttttcttttgaccttacactgcttcagaatatatgttttggagtgattccagcttgaggcaaggaagttaccagattttcctgaatggaaagtaattgcagatatatttataaaaaggtccagctttagctcttgaaagctttgaggagttactgtggataaaatcacaaagccataataggttcatacttttacccagttgcatttggcctttagatttttgccccattagcttgaggagttacattcttagtttttcttgaaccatcaacggtggtgataaaggaagatgatactcatttttagaaattcttaaatataagtgttcctaaaattaattggatgttcttaaaattaattggatgccttgttggatatctataacctgaatgaaggaattcttttctcttgctataggtgcacattaaagatccaaagtcatgactgactccaagtatttcacaaccaataaaaaaggtaagtatgagaatacaatcaaatcttttgaaattttcaaaagttgtagtgtaagattgccccaggcagaatgctgctgacctcttccttcagacatacatgtagctgacaatctcactggacatctactacttctatagatgaatgtattcaagcaagttattaaagagtaggttttaaaagagagggctgtgatgcacattattatgacttgaaggttctgtttagtgaaagagactcctctttgctgtttgagatgatccattggagattggttaagtgtgaggaggacaaaagaagcagcatactttttcccttttattaaataatttttacttggaaataaacattttataacaaagaatacaattaaagcaatacagatatgtatgtaaaaggtaaaaatgaaagttctcccttcctgttcctattcccaagggaacttggtgtatatcctcaagtctttttctctgcatatgagtgcatatattaatacatatgatttaaaatttttttatctttaatgaaaaagcaatcttgcaaaacaatgaatagaaatgagttattttcatatccgtccatatacatctaccatgttcttcgtctagatgtatatttaaaacggaatctctagagccatctatggtttttaggtcatagacggaattacttgagggactttgcacttattactctcatcatctttgttatcagtaatataatgcttgtttttacctatgagtttgggtctaggaacaaaggattcttctggggaaagtccaacccttcatcttttgtaaaattgttcctaaataaaatagatcatttctagaaatgtggagggtcttcccatcaaagacaaacattttagcccatctcagcttattgtgcctgtagcttagcttgctttatttgttgcttaggatcagaattctgtgcttttgtgttcaggagtccttacatttaccaaagtattccagacatggcgccaactaccattcttctttttctcttgttgcagtgagttgcttaattatgtcagtttgttgtctgtagctttcagtcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctctatgaaaaaaaatttaaaaattagccctgtacggtggtgcacacctgtagtcccagctatttgggaggctgaggtgggaggatcacttgagtgcaggaggttgaggctgcagtgagtcgtgattgtgccgctgtaccccagcctaggcaacagagagagaccctgtctcaaaagaaaaaaattaaaaagaaagctccccagattattttaatgtgcagccatgattgagaactactgctagctgctaacagtgcttggtagatttgattggggggaggaggagggagaaaatataggaatttaataaagttgtagaatatatgactttgcctcttttagtacccctctttggtcctgcccaactttttcctccttatttttattacttacacctcacaaaagccattagccacttgtcattcagtctcagctttttctgattttcttttggaaatatgtttatttcttcttctgttagcattttgtgtgctttgacgaacaaaatgtctataattatataaagggatacaattacaattaaatagttataattttaaaactctcctaattcttcaaacctactcttgaaaagtgtcctggtgacctttttttaattcaggcatttgtaaaagtttgagactgcagattgaatcactgctaataaacatcatacttaaaaaaaattgatagattgtgttccctgtacttcctgcaacacccaccagaactgccactgaaacatattctttaaatttatgcttttggaattggaataatttctgttacatcctgctttgattctataacacctgctgctgttcacaattcagactttctgaaaccccgccgtttgtccttcactgttcccggaagtgaatgagaggaactctaagagctggatttggcaggatgggacatggtgaagagtcctatgaagaatgactctttaaagggcccagcttttcttgctatgctacttttgtagctgttgattaaatagaaattttggaacaatttttttgccttattggccatggatattgaaacgaaaaagtgctctacttctgtgtcttactaatttcatcctttccacataatggtttcaggcaaatcacgtagtgtttgtccccactatttctttcttttttttttttttggaggaggggaggtcaggttttaatgtcccagtcctcgggcgccgtcatcccgcgcctgccaggcccggcggccatgtcgctcactcgggtggcggccagcctgcctcatcagggccttccgcggaggccgccccgtcgccctcgagcaccagcttcacgtccagctccagctgcccggtgtagaagcccacggcggcgcacacccagagcgggctggtggcgagtacagcgcccgcagctgcgccccctagcgtcagctgcatgggcccccgcagcgctgccaggccccgcaggcgctgccccacaccgcacacaggccgcccagcaggaagaagccatatgctgcttcgtgatccatgtcactctgcatgaaggagataaccccgatgccctatgccaggaggccattgtggaaccaggagaagaaagctgtctcgtgcgcctttcggagaggagcctggcgcctgcacggtccagctcggacacaggtggcggcgaagccccgttgtgggggccgtggccgggggcgaaggacccctgggcgcccccgctccggggccactgaggcagcagtagcgacctccggaagcggagactgtccccactgtttctatgctggtaaatgagatctggttgaaaggaacgacaggaacagtcttgaaggtggaggaaagtcttttgaggcagtatggtagatgagctggaggatgtagatggaaagttgagatgggagtagtcaacctctttttcatggacttagtgttttttttccgtttcttttaaacaatattagggttgttactttcttttttattttggttccggcttcttgcagataggtgagcctggagaccaggccttaaaatagtggttacagtccctgacagtttacagtgcggagcctaagcagtcattcaagattgtacctttggaaatgactccattgtgtaccattcttggtttcaagattattcttgtttgattgaatagcaagggccttaaagcccactgatttattaaagtactgattaaagtagtgattctcaacattgggtgtgcgttagagtcacttggtggagctcttaaaggtataaatatgagttctctttgacattatgatttatttggcccagagtggagcctgtactttgctatatttagtatttctcaggtaatattagtgtgtggccagggctgagaacctttgcattcaagagtcaggagacacagtgctaagcccaactttgtcactgactctgtgaactttgagcctcatttcttaatctgtaaagccgagcgtgggtaaatgaggtaatacgcgcctgctccctacctacgtttatgttctcctccagactttaacattctgatggaagatcatccttcatatactgttctctccccattgtagctagatataatgagatttggtttttcccactcttgtggttcttgaagatctggattgcaccttcctctctggccataatttaaaagatttttaaaacttactgatggcttccttgtcagtgagtcaggtaatattctagggctttgaattttatatattctataattttaaaatcttattttagttgctgccctgctatcctggtattggttattacatagtgtagtattctgctctaagtctgtggtactggaaccttaccagtttgctctcatctcttgcaggagaaatatttgaactaaaagctgaactcaacaatgaaaagaaagaaaagagaaaggaggctgtgaagaaagtgattgctgctatgaccgtggggaaggatgttaggtaagagtaatcacccttgccattgatcacttcagaggtccataccccatcttatggcctttactgcttttcctttaaaagtatcataatcatagaacctctaagaatgggtttgtcccactaaaaacatcattaggaagtgcagttgcctttgtattaatgctctactttttgtttgtttgtttgttatggggtgtgtgtgtgtttgtgttagaacagtgaaacgagtttgatttcattgcattcagatctagcataacacctcctgagagctggcacagttacaaatctttttgctgaggtcgttttagaagatgataaaaatacactgagaagcataagttcacatgatctttaactggctcaagccactgccctcaactttacaactgtacattcaattgctggattcaagatgaaaatcaatgttaaccaaatccatgtagtcttattttttatttctgtaattaagaccatttggaaataagtaaggactatatgcaggcccctaaggattatcctaagaccctttcggggggtccgtgaggtcaaagctgttttcataataatacttagatgttacttgcctttttcactatttggatgtttacagtgatggtgcaaagcagtggtgggtaaaactgctggtgcctcagcatgaatgaaggcagtggtgccaaccataatggtagtcattgtattccttaacaccatgtgctaaaaaagagcagtttcacttaggaatgtccttcatgagcagtaaaaatttgttttattaaaacttgaacctttttaatattgtgtttgatgaaatagggattacccataaatctcttctgctgcgtagcagtgcaatggtcgacttgagaaaaaacccttgtgcagttgtttgaactgcaaacaccatttttatgtgaaagaatgattgacagacaaactatatttaatcagactttggtatttgggagatattttattcaaaaatgaacaaagtgaacctgtcacttcaagggaaaaaaattgacaatggatacgtttcaggttttaaagtaaaaaattagaattttggaaaatttgtatctcccatcataagcttgacagcttcctaatgcttaaagacttttctgaggagattggtggtgaaattaatgattgtgattatttgctgttttataatgaaatgtgtcagcatagctcagtgaaccaatatttttccaaatgaccagagcatatgtatatcacaaaattatgcatggataaaagatctattcgaaataaagtgtggaggccaggcgtggtggctcacggttgtgatcccagtattttgggaggccgaggcaggcggatcacttgagggcaggagttcgagactaggctagccaacatggtgaaattctgtctctactaaaaaaaaatacaaaaaaattagccgggcatggtggcatgtgcctgtaatcccagctactctagaggctgaggcagtagaattgcttgaactcaggaggcggaggttgcagtgagccaggattgtgccactgcactccagcttaggcaacagagtaagactctgtctcaaaaatcaaaaaacaaaaaaacaaaatagaatgtaaatgaatggattttaatacaatcaagtacaaaaagtttatcgatacggcttcagattctatattgcaactaacttttaagaaactacagtgtgtggactcagaaagaggaaaacaaccatttgtctagttttatttatttatcattattttttttgagacagagtcttactctgtcacccatactggagtgtagtgacgttatcttggctcactgcaacctccgcctcccaggctcaagcggttctcctgcctcagcctcccaagtagctgggattacaggcgtgcaccactaccacccggctaatttttgtatttttagtagagacggggtttcaccatgttggccaggctggtctcgaactcctgacctcaaatgatctacctgccttggcctcacaaaactgctgggattacaggcatgagccactgttcccgggctgtctagttttagtgtaacatcaagaatttctagttataacaaaaaaaaaaagaaaataaggaatatgtagttatatgaaaaagctattaaaatattatttccttttccgagttatatacgtgtatgaagctggattttcttcttatatttcaaaacaacattctacaaaaggttgaatgcaggaacttatgagaatctagctgtttttatttcaagtagatattaaagagagttgcaaaaaaataaaaaagcagtgtcaccatctcattaatttaaaaacagtacattttacctttaaaatgttatgaaatgggtttattcttattttaatggattaactttttaaaaatttctcagttttaattcctgacatggtaaaatatcaataggtatataacccacatgaacaaaaactctttgggatgtcagtaatttttaagagtatgaagggatcccgagaccaaaaaggtgagggctgcttccctaaccagacggggagcccagatagaaatggcagcgtaggaaatgactctgtatcttctcttgctccaggtgctgctcttctgaggtgaatttttgttatttttcttttgtttgttagcacataaagcacatttggtttttaaattgctgtcctgtgaccatctatctaaggagttggcaaacgtttttgtaaaggacaaaatagtaagtacatcaggctggcatagtaagtactctttgcttagcaggcaaagaggcaaaattgagtttggtaggtaggtacttacataacaagagagaagacaaatttccacaaattttttattgaggatattcaaaataaaataatagttaagtataatgttttgtaccacaggtatactattaagtgggattctttttgggggatgataacattttgcgtaattaggattcatagtatttttcatcatcagatttgttttatttatttattgttttgagatggagtcttgctccatcactcaggctggagtgcagtggcgcaatctcggcccactgcagcctctgcctcccgggttcaagggattctcctgcctcagcctcctgagtagctggtactgtatatgcacctgccatcactcctggctgacgccaagtgatccgcctgccttggccccccgaagtgttgggattacaggcatgagccaccatgcccggccaagattcatatagatgaacacttagttcatctataaaaaccacttttagctcatggattgtacaaaaatccagcattgggctagatttaacccacaggcggtagttgcctatctgtgatctgtctagtcactgaagggctgtttttgccaaagaataaatctggattgaaaacatcagtacaaacgaattggtaaaaattgtcataactcttttttttttttttttgagaccgagttttgctcttgttgcccaggctgcagcgcaatggcgtgatcttggctcactgcaacccccgactcccgggttcaagtgattatcctgcctctgtctcccgagtagctgggattacaggcatgtgccaccacgcccggctaattttgtatttttagtagagatggggtttctgcatgttggtcaggctggtctcaaactcccgaaaaattgtcataactctacaggggctgttgtggttttgccaagcttatttctgtatcctgcagaaaagttaaaactcttgatttttttttatatgcttgctattgctgatactttattatgtacttagcactataccacttatcattattcaaacaaaaggctagtggatgtctgtttgccttcatgatttttactgtctagttgatgaaacccaaaacttgaaaaattagggaaaaataaaatatacttatgtaattaggcactgaagtgtatattttaaaggcaatacgagttctaccaaagagagatacaggttaacaggaatagttgaagaacccttcttggagatgaaatatgagctgtacttagaaagatagtgcaaagaaataaaatggagattagctatttgtagattgtgatatttcagcctttcctgcaagtaacctcaagtgcagcactggccagtggaaatacagtgtgaaccacatatgtaattttaaattttctaatagccattttgaaaaaatgaaaaggaacagatgaattaattttagtaatacattttatttgacccagtatatctaaaatatcctttcagtatgtaatcaacataaaaattattaatgagatattttacattatatttttcatgctaagtcttcaaaatccagtgtgtgtttcacatttacatcacatctcagttcacactcgccacattgtgtttagtagtcacatgtgactagtggccaccatattggaaagttcaggtttctagtttataggttggcacttaacactttttacttcttgcttgatctttggctattaagtcttcttgaccttgtgtagattgctagaattaaactatttaggatcttgaatttattattggttaatgtttaacatttactggttatcgttgttttgtgcatgagctagtctaggaaatagaaaacacatttttggagagtatttactaaatatctacaggtgcatgaaactaccgtaggtaccatgcatacaagtgaaacacatagtttgctttccaggacagaagttactggttcactggagatatggtggattctttgacctgagtccagcttcctttctgtgaataatttctacttctgtacccttttgtgtatataggaccattgtatataccctgtgaccagctatttcattcccttttttccccttattttccttgtggaaatacacctacatttgttttttctttcttctatgctagtagcaagatgtttagcagtattaaaaatgtataaggtactttgataaagcattgtggggaagatttattgctaacttcccataaagttacagttatcctatattgtaaagatacagcttacactttagaatctgacaagctcaacccttccaagctaatggtgctcctttaaatttgtttcctgtggcttataggagaatggtaaatcatgaaataactagaacttaggaaaggtataaactccttttatatttgattactctcaaattttcatttgtctgaatatgtaatgttaaaaaaataatttcactaaaagggaatcaggacatcttggaggatgactgattctaggtctggaattagaaatgtacaaaatgagcctggatggggcatcttgtcataaaggaaagtatggaaaataccaggtcatatcacaaggattcaggagctcagttcccactggtcaagactggaagaatatgaactttaaaaagcgtaactgaagtgctttgaaactgtagtagatggatatgaagaattattgttccttttgccctgtcgcactcctgaaagcaagatgattcaccagcagctctactggagccacccgcgaaaagtcagccagggttcttgctattgtgtctgctgaaactgggcacagtctgatctggaaattgagcctcgttacatgccaccagtgtttccatcatacgtgaaggatatagatttcattaagttggactaagtgatcttccacgaatggattatctaaggcacccacccaatgagagaaaccatgttagctttttgtacataaaataaatattttaaaataattattgttattttttatttttatttttgagatggggtctctctctgttcctcaggctggtgtgcagtggcatgttcgtggctcactgcagcctccgcatcccaggctcaagtgatcctcccacctcagcttcctgagtagctgggaccacaggcgcacaccaccatgcctggctaatttttaaaattatttatagagacgaggtctcactatgttgcccaggctggtctcacactcctaggctcaagcagtcctcccaccatggcctcgcaaagtgcttggattacagacgtgagccactgggcctggcttttttgtttttgtttttgtgtgtttttttgaatgtgataaaggtagtggaaaaaaaaaaagacacttgcctgtgcgtggtggctcacatctgtaatcccagaactttgggaggccaaggcaggtggatcacctgaggtcaggagttcgggactagcctggctaacatggtgaaaccccatctctactaaaaatataaaaattagccgggagtggtggcgcacgcctgtaatctcagctacttaggaggctgacacattagaattgcttgaactggggaggcagtggttgcaggaagcaaagatggtgccactgaactccagcctgggcgacagagtgagactctgtctcaaaaagaaaaaaaaggattcttaagatacacattaaaatattatagatgaagctgggcacagtggcttatgcatgtaatcccagcactaggattaacattttttcataataaaaagctttttctaaaactatagagaccttgttgagaacagcactacaatttttttcttgttttttttggatggggacaaggtctcactctgtcatccaggctagagtgcagtgacgtgatcatggctcactgcagtctcgacctcctgcttcagccttctgagtagctaagactacaggtgtgcaccaccacacctagctttttaaaacaaatttttgtagagaggatctcgccatgttgtccaggctggccttgaacacctggtctcaagtgaatccttacaccccagcctcccaaagttctgagattgcatacctgagccaccatgtctggcctacagtttcttttcttttcttttctcttttcttttctttttttttttccttttttttttagacacaggagtctcgctcttgttgcccaggctggagtgcaatggtgtgatctcagctcaccgcaaactctgcctcccaggttcaaacgattctcctgtctcagcctcctgagtagctgggattacagacatgcaccaccatgcctggctaattttttgtatttttagtagagacggggtttctccatgttggtcaggctagtctcaaactcccgacctcaggtgatccgcctgccttggcctcccagagtgctgggattataggcgtgagccaccgtgcccagccagtttctttagtaattcatttctgtgacagttaccactgtggggacatttgttcttgcatcaaatcactgttagttaaggctattcatgttctgtccaacagcttggcaccaacacctgcttactttccttttctcttttaccctctcttctcagttctctctttccagacgtagtgaactgtatgcagactgacaatctggaactaaagaagcttgtgtatctctacttgatgaactacgccaagagtcagccagacatggccatcatggctgtaaacagctttgtgaaggtaacttttcccaaggcctcaataacagagtttgaattgcaaataagtaacctctgttcacaaggaaggagtgtagggaagtgttggcaatgactaggaatgttcatgttttaagcattctgtataccagtgtgtgtcatccagggaaattcaaaccatgtgctgagctttctgttagtggggcttggtgcatccttgccagatgggtagaagaaaacctggtgaaaccccactgttttaccttctgaggctgacaaaggtgggcatatcattgtactatcagtaattgggggctttacctattttatctttgtagaaattatacttatgagtcagcagtagtggagactgccggagtttctactttcatttcatttaatacgtcttacatcatttgattaatttttttttttttttgatacagagtctcactctgtcaccgaggctggagtgcagtggcacgatcttggctcactgcaacctctgcctcccaggttcaagtgattctcctgcctcagtctcccaagtagctgggattacaggtgaccgtcaccatgcccagcttatttttgtatttttagtagagacagggtttcaccatgttggtcaggctgatctcgtgctcctaacttcaagtgatccacccacctcagcctcacaaagtgctggggttacggacacaagccaccactcccggcgtgattaattttttttaatggaaaattttaaacatattcaagaaaaaggactagtataataaattcctaaatatccgtcttgcagttttaacagttaccgacacataaccactcttgtttgtaatcctcatacatattttctgacctccaaccccctctcctgctggataattttaaagaaatcctgaacatcatatattaaatagttttgtctttatatttgtcaagataagatcttttatttaaacataaccacaatatcatcatgtctttaaaaatggacaaaatattttcttattattgaatatccagtcaaatctttcctatcatagatttaaagaaaataataatgggatcattcccattaatttttttttttttttggtgacagaatttcactcttgttgcccgggctggagtgcaatggcgcaatctcagctcaccacaacctccgcctcccgggctcaagtgattctcctgcctcatcctcccgagtagctgggattacaggcatgcaccaccacacctggctaattttgtatatttagtagagatggggtttcaccatattggccaggctggtctcgaactcctgacctcaggtgatccgcccaccttggcctctcaaagtgctgggattacaggcgtgagccaccatgtccagcctaatatttttttaatagttgttttttctctgtttggaacttagtgtacatttaaaaaaaacagacagcatttctaaaattagcttctatttaaaatgttttgaaaaataagcaatatgctttcttctttctcatgaactttttgttcttttcctgtgtttagctacattatagagtcagaacgtaacagtttgttctccatgactggtggttcatagagggaatatatcattgggaagaatttagtttacattttttggaagttagagttgtgcatagatttacatgggcttaaagacatttttttagtgtaaggcagtttaaaagagtgttctttctccatattctatttactatatttggaagcacttgctagtaaaagagaatgtatgttagccaagagctcagagggccttctctgctgcttaactccaggtacttatttcaagcccagaccagctcctgtgctcccctttgttttcttggctgcaggccacagaaatctagctctcttttctatttgatgtttaggaactcactgtggagtagggcacggtctttacagctcctcttttttttttttttttttttcctgtgccggaatacaagcccaaaagcttttcctgtttttagggtagatcctaatggctgtgggatggtacgaactccctaaacctctgcctggcactagagtgaatcctgctgagctgtttctcattttgtatttaaaacagttaaatgacttcttcacctaaactcttaaatagggcagctaagatttgtacttaggaaaggaatagcatggaagattggagctcatgtagaatgtatctggaagcttaaattaatgaggtaattcttttgcagcttacataaactggactgtttacttttagccaccatgtatacctacagttgttggtgattgttttctgcaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtaataagcttctgcttttacaaagagagcagtatttaaaatgagtcccttgttaaagcgtgtttaatatgaaccttgtctttggaatactgggttatggggtagctatgggaaacatgactttgtgtgtctcacagattgtatatttcatatcctaggtgtttttgaggtgagaaccaagtactaaaatgcagggatcttaaagcaaatctttgtattgtacttatgctcatatttgcccatattgcccatgatgaaaactttcatcattttcttcaggaggtttggccgtaaatttatatatatttaagattattttcttcagatcaatatttgtggtattttctggtggtgtgggactagaaactgaatgaaaatgatctttattacctaattattatcatgcatttctctataggggaatttctagggcaagattatttttagccaacttggttatgttgtaaatgtttagcagccagaacatagcttaacaccttaaagttttgggaccttttccttattgacattttaaactttgcttatataatgaagaaggtcaagtcccaagtgatatgtttgactccagtaataactaaagctcatttgaattgggtactaattgaatatattggatgggtcattaaatattgttgccaggaagatggaggaaaatagccactttctttaaagtgctacctttttggtctaatgcaatgtttactgaaaggtgcataacactaagagttaatcagtggataacctttgaatattcccttttaaaaattatttatctatctatttatttattttttacagataggatcttgctctgtggccaagctggagtgcagtggtgcagtcatagctcactgtaactttgaactcctgggttcaagcactcctacctcagcctcctgagcatctaggactgcaggcacatgccaccacatcccgctaattttttttttttttttgagacagagtcttgccttgtcgcccaggctggagtgcagtggcgtgatctcagctcactgcaagctccgccttccaggttcatgccattgtcctgcctcagccttttgagtagctgggactacaggcgcctgccaccacgcctggctaattttttgtattttttagtagagacggggcttcaccgtgttagccaggatggtcttgatctcctgacctcgtgatccacctgacatggcctcccaaagtgttgggattacatgtgtgagccaccgcacccagccttattttttatggagatggggtcttgctatgttgcccaggttggtcatgaattcctggcctcaagcaatcctcccaccttggccttcctcagtgaattactgtgcttggcctgaatattttcttagtgaactttaaatggagaattagaatttggctggacatagatgctgtctctcatttgtaaattacctgttcacttctctgctttgacattttgtttggttcattttattttacaggtagccttggcttctgtttattatccttcaagattagtattaaatccacaggatgaagcaagtcataattttttaaggtttttatggtagtaactaccattagaaatctttcaacctaggcataagggtgggcgtcggtgtgggtgtggaagtgcagatgctttaaccatgacttctgacagagcatcaccaccagtactagaagattcaaccctgccttttatttcccctaagtaacaccatatggtaccttttatttattttttatttttttttgagatggagtgtcactctgtcgcccagtctggagtgcagtggcatgatctcggctcactggaacctctaccttctgggttcaagcgattctcctcctgcctcagcctccttagtaactgggattacaggtgcccactaccatgcccggctaatttttgtatttttagtagagacgacgttgcaccatgttggccaggctggtctcaaactcttgactcaggtgatgcacctgccttgacctcccaaagtgctgggattacaggcatgagccatcacacccagccccctttttaaaaattacataaagaaattagttggctaggcatgttggctcatatgcctataatcctagcactttgggaggctgaggcagaaggatcacttgaagccaagagtttgagaccagcctgggcaacaaactgagaccctgtctctacaaaaatttttttaaaaaattcggtggggccgggtgcagtggctcatgcctgtaatcccagcactttgggaggccgaggtgggtggatcacgaagtcaggaaatcaggaccatcctggctaacgcggtgaatccccgtctctactaaaaatacaaaaaattagccgggcgtggtggcaggcgcctatcgtcccagctactcaggaggccgaggcaggagaatggtgtgaacccaggaggcggagcttgcagtgagccgaggtcgtgccactgcattccagcctgggtgacggagcgagactcttgtctcaaaaaaaaaaaaaaaaattttgttggacgtggtggtgcatgcctgtaattccaggtacttgggaggccgaggtgggagaatcccttgagcccaggagtttaaggctgtagtgagctatgattgcaccactgcattatagcctgagtgacaaagacagacccttcctcaaaaatatagaaaaataaatattgtctaaagttagtagtatctactttacagaatgtttagctggcaccaacttgtgtttttggcattgcttttgattcactgttattctgagcaactatctataattctctacctgaggacagatgagatgaaaagtgtttgtgctgcaaccgtcaaccaggtgggcagaatatcatgtaccccgtggaaacttattaaatattcagtggtgctaagaatatggaatggctcaaagggaaaatgagttctaacttacaggcgactccagtttgaggcagcatctctatgctaatgtaaattctttaatgcagaacctatacagttagatggtcagggataaggcctaagggatgtttagcagtaaagtcgtgtgtgtgtgtgtgtgcgcgcgcgcacgtgcgcacacacactcaagtagcacatttagagatctttatccagataaaccgagaagaataaaatgattctggaacaagcttagtttgtccgatttattcaaagtttacattgcaaaggagagagctagttttcatctagtccataaaatcaggtggcatacgtatgctatttatgtatttgtgttttttattgtgggaatcttcaaacattcaaaattaggacaaataaatgaatacaataaataaaatgaattcatttatcatcactagattcactagtcatcaatacatgccaatcttgttttacttattttctttccccatcccctagctatataaaatttaagcaggcagcacatgaataggtctctatttgaatttagtatatcataatattatagtaaactgtatagtgttcttaatttttaacctgtttttactacaacaaatcaaaacgtgacttggggagattttcataaatatttttgaggagacttttagagaaaatttaaagctacttggtagatttttgagaaacagtttcaggaatacctcatattttgttgtctctttatttatagattttcctagagcagggtgtcagcattagatagcaaattattggaccaactgctctctgaatagaagatctttgctgttttgtcagaactcagtagcagaacttttctgatattgtttgacttagcctaaagaggtgcctggagtgtaaaatttaagaagacactcattctcaggtgcgaactctgtacctcacaagcctgagaacagagtgcctccttagttttgtgcctggagtgcctcacttgccttactcttgtcctggccttgttacacatactcatattaaaatcattttttgagctcttcattcttgttttagtgaagaactgaaaagcttgggcttaagaggtagccaacacacatagatacatacctactttttattttgaatttatacttttcatctcaactgtattccctacttattaccttagagtattacaactgtcattagaacacttaaatttaagtgccttctatgccatgcacagtggtagatgcttttacttacaatgtttcacttagttctcacatttctccttaaagcagaggttattccatgttacaggtcaagaaatgtttactcagactgaagaactcttcctaaaatcatgcagctagtagtaatgtagctaggatcccaacctagttctgagtcccagactccattgctggttactaccttcatggatgaatgtataccagagaatttaggccaggtgtggtggctcacgcctgtcatcccagcagtttgggaggctgaggagggtggatcacctgaggtcatttaaatgtgtatgtgcgcacacacacacacacacacacacacacagaactgcttcattttctcaaagtgtttacgtttgaatacataaagactgagttatctgaacactgcttcattatagaaatctcaaaaaagaaaaaaaaaatgaaagatacaaaaaaaaaagaaatatcaatcctcttattccagtgatggatatgagtccttattttactgctcttgaggagtgattttgttccactttttcagaggctactccacatggtggcagcactgcaccagcacatattagattctcttagaaaagaaaagaatgaatgcttccaggggttgtgccttagtagttttcttgtagctcacttcagaagggcatcctagatttgaaagcactagaatatctgcagaaatgactttgaaatcttctaatatgagagataaatgttggtcgagggctgaaaattcttggtgttatattgacctcaagtctggttcctagtgacactgtgccttgctgcaggtaacaaagctttaccatagttttgtttcctgtgttttgcagagaatcacatacatcttactttcctgcagttgttttacaatttatagtttagttgaagctaacttttgatgaaatactagttaagagagaaaagatgaatttagaagtaaaaaaatctcactctattaagtcctagctttatgttcatgttgtttaacttacccaagtctgtttcctttcctggaagatgaaggctactatcttagagagttgtttggattattaattgagcttttgcatgaaaagtgccctgtaaagtgcttggcttatgggagctcataagtggtggctgctactgtaattatgaagtaggtattaggcagaggttaacattattgctacaatattaatttaaaaggttctgattcctttaatatttgtatggactatctgttccaagggaattaaacttgtcgtcagatgtggactttattagttcattattttgaaggtaaacctccatccagaataaggaaacattttagagctatagggaaatagcttttgtggttttttttacaaatgtcacaagtatatatttgcaagaaaatgtgtatctttttggtatatgacttgttttattgagatatgcacttttgaatgaatgatagtattctctagcttcgttactatggttttcttttttgctctcagaggcatttaggggtattcaaacctcagttaacttacgtatattagaatttgcaactccagagatgctcttgacagccccaccatatgtgctttgctttttgtttttatttattttaaaaatttactttttattttttgagagacctggtcttgctctgtcacccaggctggtgtgcaatggcttgatcatagctcagtgcagcctcaaactcctgggctcaaacagtcttcccgagcaactggaactacaggcatatgctaccatgcccagctaatttattttattttattttttgtagagatggatcttgttttgttgcccaggttggtctcaatctcctagcttaaagcaggcctccagcctcagcctctcaaagtactgagattataggcgtgagccaccatgcctggcctgctttttgtcttcttgggttcagtcctcgtaagtccctttggtttactgcgtagcccctttgatcttcatcttccagactgtctatcactctcacagctgcccatgagaatacctgtgcttcattgttctgtcctctctgcaaaattgcaaactgttgaattagtaaaaaaaaaaaaaaaaaaaaaaaaatttctcatttgttaagtgttcttctgcataagcagcatgctctcagaatagcctcaattcaggccaaatataatctttaccaaaagttgtagttaaacttccagcttcttttaatttgaacttttgcttgaaaaccattttatgaaaaataacatttttcttctcagaaagcagtatgtattttgactatgtgctagccagcacgtagacacagcatgggattatgatggtggttctcaaccaggagtgattctactctccagaggacatttggcaatgtctagtaacatttttttggttgtcaaacctgatgggaggagtgctactggcatatatcgggtagagtccagggatgttttcaacatccttcagtgtacaggacagtcccccgacaacaaagaattatccagcagtaaatgttaataatgccaaggttgtgaaaccctggattatggaaatagcactgaggcttcagagccagagtggctgctgtttgagtcctggcttggctgcttactagaaatgtggctttgaacaagttatttaaaatgaacttcagttgtcttatatgtaaaactgaggtaataatgccgattttagtgaattattttgaagatgaaagaataatgtatttaaaattttaaactttgcctgatatatggtaaatgcttaataaactgcagctattcttgaggaagtggcctaacattatgcaccttccggttgttataatcttcatttaggcattaggaagtttacttgtgtggtgatttgttgtcaacctaagatgataaaatattgaaaaaatgccatctgtctagatctctttctaagaatttttgtcagaatatatttggtattcatgtaggctatgttaaactgcctattaaaggtaggcccagaatgcatagaaaaacttaatgacttaactttatttagtacgttaattataggattgttgttatccttaaatatatattagtaagtaacaattacaaaattaaaatattatacataaatgaaatttaaaatgtgtaatacttttcatatcaaatgtccatgaaggagttagagctggcagaattttaggcacatatgataatgtcagtatgtggtgagcacttgataagagtaacattgaaggtaatacattcagtctgtatctgagttcctcaaattgtgtttcatattataaaaggagctgctgttaatttttgcaggattgaagtttgggtaagtggaatcattgggggctgctttgatatgaggccaacttcccagctcttgaatttcccaccagttggtctgagtgtatttctgtctctacttatagagaaagcaaacactttttgttttccttttataatgtgctttgtggaaatcattttctgtgtattttcacttttaaaaaatcattacgtcgttttatattattatgaacttaggttttaaaaaatatctctttttttttttttttttttttttttttttttttttttttggagacggagtctcgctcagtcgcccaggctggagtgcagtggcgcgatctcggctcactgcaagctccgcctcccgggttcatgccattctcatgcctcacacttctgagtagctgggactacaggcgcccaccactacgcctggctaattttttttgtatttttagtagagacggggggtttcaccgtgttagtcaggatggtctcaatctcctgacctcgtgatccgcccgcctcggcctcccaaagtgctgggattacaggcatgagccaccgcgccctgccaaaatacctcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaaagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgctctgtcgcgtaggctggagtgcagtggcacaatctcggcttactgcaacctccatctcctgggctcaaataattctcccacttcagccttctgagtagctgagagtacaggcacatgccatcatgcctggctaagttttgtatttttagtagagacagggtttcaccatgttggccatgctggtcttgaattcctgacctcaagtgatccgcctgcctcagcctcccaaagtgctgggattacaggcgtgagtgagccaccatgcccagcagaaacatatattctatattgtacagtgattgtagtgccggatattaataattttagaagggttagtatttcagtggcaaaatttactttttaattttataagattaaaattttaaggttaagattaaaacttttaggatgaagaattttaaagattaaattttttaaagctctgagggcaacttacccacaaatgaagctaaatctaagagtactacttactacttttacaaggtaattattcaagggtgtacgtttaaagtagttctcaacagcaacttcctgaaagctggatctgttgtgtgttgttttggtggtttgccagtatatcaaggctcatttgtcactttaagatgacctcaaggctgtaatttggctggggaatactttactcttagaaatggggagatcataagtggtgtgataataagtgttttattttgttcaagttgcagcttgctttaatgaattttaggggccatggtccaaataactgtgatggttataggcatgccttttatttgtttatcgatatttatttgtagtgttttggctttgagagtacttgaattttgttaaatcatatcttaaaccacttaagtaatgaattttattttttgtaaaccttgttactatgtaatcagactttcttttcataatgagatgtgttggctcactaggtagttttacctctcattctaaggaagaagatggggaaaaaatggaatattctagattgtaatgtagcaggcatattaacagttggcattctagacagtgttttggattaaagtataagccctaagttttacttgtttgactggtactgcagtcattgtctccttaaggagataataatgactgaaactctcagaacaaatatgttgtcctatgcctcacatgtcatttgaggtcattctgtaaaggagatagcaatattctaacactgctaatttagaagagaacaaaaatatgtaaaccacctgtgtatttcctcataatagttttggtcagttactctacttctttcactttattcaagtcttcagggataccagccaaaataattgtaaattgagcagaaaaactgaagcataaatctgttcatagtgtgtgaccttgaaggtcattgctggaaatcaaagtcctgtaaatagtaatttacttaacaggaagaagtcactgaactggaaagtggtaagtttctaaggttccaaggccacgaaaatgagtgaaattagagtgcaaggtgaaaatcattttaagggacagggaaatgggtgagagattcctcataagtgagcttatgtgtgtgatattccactcccagtttatatctagatttcctttgagagtccttttttttacagggtcatttttattctaaccatacctactgtaccagctcactccttttttaacaaaatgaggtcaaatttattatcctcaactgctgcatataagacaggtatagatcataaatcatattttatagctaggtagtaaatctttccctccctaagtactgtaggatatgattatctctgaaatgtataaagtagaatacatttttctccttgtatataaatctacatgtcacctttgctggaaataatgtttggattatattatcctcccctactctgaatcttctttcccttcccttggttgaagttcacaagtcttggaagctctataaatgctggagaccaagtattagtactcagacactggaatcagatgcagaccttgagttcagattcaagcaggaatccctttctggctgtgttgaccctaagcaagtcactgaacttctctaagtcagttttgttatctgtaataggtggcttttagtagcagctacttcagagttgttatgaggattaatagcacaaagtaaatattcaatacattttagctattccagtcttttatctctgtaaaactcattctattagtataatgtaagtaaaaatacaaattgcttatcattaaaaattcaggctgggtatggtggttcacacctgtaatattagcactttgggaggccaaggcaggaagattgcctgaggccaggagtttgagagaagcctgggcaacatagtgagaccctgtttctatttaaaaaaaaaacaaaaacaaccagcagattccacaggtccataaggaaatatcatattgaagagaagtctgtaattaaggcggagaaagatttgtctaggattgagtatgattttacacatctacatgtgctgcttttatatatatgtttgtgtttaatatctatctctgtaaagtatacataattgggttagctctttgaggggatgtgaggggtggggaatgtttagtttcagtctccccaagaatagaatttaccataattgggaggcaagatgaataaaggattttttttagttttttattttacttttatctttttggagacagagtctcattctgttgtccaggctagagtgcaatggtgtgatcttggcttaccgcaacctctgcctcgcatgttcaagtgattctcgtgcctcagcctcccgagtagctgggattacaggtatgcaccaccatgcctggctaatttttggtattttaattagagacagggtttcaccatgttggccaggctgatcccaagcttctggcctcaagtgatccacctgtttcagcctcccaaagtgctgggattacaggcgtgaaccaccgtgctcggccaaggatttatttttttaatgctgcaaatgtgtccctttgtcacctggatgccaactttttataaatcaacttgtgctgaggaagctctcttaagaaaccctatttgtaggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggcatgcactgtggtcccatctgctagttcaagattacagtgaactatatgattatgccactacactgtagcctgggtgacgggcaagaccctgtctcttaaaaccaaccaaccaaacaaaccccaaggaaatcctatttaaaaattcatttttaaagcgaaactttctctagaaacccccctttttggctgggtatggtgactcacatctgtaatcccagcactttgggaggccaaactgggaggattatttgagaccaggagttcaagaccagcctgggcaatatagccagccccatctctaaaaatttaattaagaaacttgactgggtgtggtggtacaagcctgtagtcctggctactcaggaggctgaggtggaaggatcacttgagtccaggagtttgagattacagtgagctgtgatcagtgcgactgcattccagcctgggcaacagagtgagaccctgcctctttaaaaaaatacaatttttttcttggaaactctaatttttctgaaatggtagctaaaggccattgttctctttctgtcagtatttcctaagagaaatgccaattttttgacaggagaagtgttacacatagttgtgttaacagttctaaatcaaagtaatagttcaaatgaaagaagcacacctttgtcttagtatacaggtgagtcaaggcagttattgtaagggttggatttgttcttttgtgatattattgtctagagaagactctggaggaagaggaagtaaatcttgagtttcaatctattattttaaaagtttattttaaaaacggaacaatatatattcatagtacagaattccaaagaaacagtataaacattgacaagtgagttgtcatgtactctctagccacccagttgctgtctcaaagttagtctttttctttaagatactttagattcagtgcgactgatttattttaagttttcattgaagagtgagagaaactcggcttacggaccaggaaaactgagagtgctgcctggtgagcctgcctcagtatgttgctaaaaatgtaacagtctgactgtggagattaggagatgaaagtgtagagataggatggaaggaacttcaagaaattttagagaaacattagagttttggtatagaggggtaggatagcatctcctctggacggtcaccatttggcagtgatctctcttatttgtgcaggctttgctaaacaatcatctaatctgatctttctggatccttaagttagacttacttttctccatttcatttcttgttttaatgtcatgataagtggcaattgcctatttaaacatcagaccatacacttcattaggtgcattatacacttggtttaatttccagttgcctataataacagaggatttctaattgctcattctgtttagcattcttctggtctttttctccccattgctgtttttaattctcccccttctctcgttttctttgtctatatttcctattactagaccttatatttaatctttttgtttttttaaacatgaaaagggtttcactgacagaagtggtaatttatttcagacaactggtaaccaagactgggcatgtgttggcaacaataaatcaaaacaggcatttggccttctgatatgatattttgattctttagactataataaggtcaactaagtatgttgtgcaagggaaataaaatatcttgcatgtgaagcacatggaagggattattatttctctctttatggcttttctcatgcttgatgatagagttagcaaacaaaaattaagtcagaaaagagcctcatacatgttaccatccagtaggtgggctagataagttttcctgatttgtcttaacaagtataaaatagtatatctgtaaccatatttaccaagtgagtctctgatttttcatcttagcatctttgttctgatcaccaaagtatagcttgagatgattgcatttgtggcatcattatcctttacataataatggacatttttgtaagtatattatttgttaaataaatcacattctctagacatttatcttctagataaaatcatatgctgggataatctgaagattacacagatgatgtgaatactaaaatcaatagctagattgtagtcattatgtttcttcccttgctaacaaaatgataatcatacaaatcttaatttctctagtttttattaagggacttcagtaagaactaacaatggttttacatttttgagaatatttccaatatatataattgctgaagcttgtctcctatcacatctcatttatacttggagaatatttatttatttatttttgagacggagtctcactctgtcgcccaagctggagtgcagtggcgtgatcttggctcactgcaaccttcacctcccgggttcaagcagttctcctgcctcagcctcctgagtagctgggattacaggcacacaccaccatgcccggctaattttttatatttttagtagagacagggtttcaccatgttggccaggctggtctcgaactcctgacctaagtgatccgcccatctcagcctcccaaagtgttgggtttacaggcgtgagccaccacgcccagccaacttatacttggagagtatttatattcagcctcactttgctaatctttcatcagcatctgggaacctcactgcaaaacatggtcttaatttacttgtacaaagccacaatatatagtatttgtatgtatgcatttttttttttttttagtatttttgcaacttttaaatgactttagatgttcttcctttgtagatttcttaaaattaatttgtaattttgataaagtgttgacttttcttcctgcagctaaatggattcccagatctgtgagtcaggatacaagtgtactttctagtataaggtagcaatttttcagccgggcatggtggctcacacctgtaatcccaacactttgggaggctgaggcaggcagatcacctgaggtcaggggttcgagaccagcctggccaacatggcaaaaccccatttctactaaaaatacaaaaattagctgggcatggtggcatgcacctgtagtcccagctacttgggagactgaggtgggaaaatcccttgaacccagtagatgaaggttacagtgagccaagatgtgtgcctactcagaaagaaggatacatttgaaatactgtatttcattgaatctttaatgccactgattataagatgtattattattttctgtattactaagaaagaaaaatgcttcctattgaactgacaggccattgattataaaatgcaacccagtttcaaaggtgttaatgtgaaaaactgtagcttacagttgatgaattatggtaatataaccagccaccttaaatttacataaggctttgtagaaagcacttacacatatgtcatctgatcttatccttaaactaaaactaatctgtgaggtggattaaattatctcgttttcagatgaagaaactgaacttcacagagattacatattctctcagcattgtatactagtgaactagggtctcaggcccacatattctcactctaagacttgtagtatgattaatggtgtcacctcccccaaacccatacatatacagctacacaactataagattatttggcctagatttttctctctgttgcctaatgtacatatttcatattcagactttgtcatttttcatatgctgttcatatgtcttgattttgaaagttttgagtgctgttaacatggttaatgtatgttttcctattaaataacatgtgactctgctaatatatgaattgttttaattctgggttgccttaccactatatataatatcattggtggtttaatatatgttttgaagtgatttatttgtttctatctgactaggtaaaatgttcaggaatggttatgaattgagatccgtgaaatgacccagagaaggctgatgaagtgtttgtctatagctgtgctgttcttggtgaatcaaggtcatacccccttcttttccaggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagaggtcagtctgttttcctggctactttctggtagtcttgcctgatgcagtaagttctggagtctgctattagaataaatctgttgaggaaggtcagtggcttctggggtagatattgctatctccagggtattttctctctggatttaggaatattttaggtggtagaataaactatgcaaaactatttctaagaaatgtatgtttttcatacagttacttctgctaaaatctcttttatcgtcttacgtctcccatgcacagttcttggccatttggccagcaaagattattgagtatctctctttggggtgacagatttttcattctattagatatatagaaagtggcttcatattagttattgagctgacctgtatatataattcagtatgagagagagtatgttaaagtcagcagaatatatcctcctttccagtagatatggaaaccatgtcagtctgaatttgaagattttagaaggcacacctagattgttctgctcagcctgttaccatgtaatgttgcaaattttctttggttattagaaattgactactaaatttcatctacacatacatacattttagtttacaaagttggaattatccctaatttttattgagcattttgtatatgcaggcactgtactaggcaaagtacttctgaagaaatgttggctcttcattaaagttggtatattttaattatggtatttaagaactggtctggctgaagctgatttccaagctactagaatgtaagtgatcttcacttatctgggaaattgtccctctggactgaactaaagctcactctgatagtttctttccatcactgaaagtacaaatatagtctggaaataactttactgagaattttattttcttctgttggccattgacatcacattcattcattcactcacttagcaaatatttattaagtgcatactgtgtgccaggcagtgttccaggctctgaggatacagcagtgaacaaagtcatggccctctgggatcacttattctgaaggatgggggtaggaatatatataatatgtatagataatataatatataatatgtatagatagtgtaatatgtaatatgtgagatggtgataagtactaacaagaaagtaaagtagagaagaaatctaagaaatgctgggcatttgggggtgaggggttgtattttctttttaaaggatggccagggaagacctcactgagaaggtggcattcatataaagacccaaaggaagtcaggaataggaggaagagagaagtacagcctatttatcttctttctttaatacagtaagttagctacttgtgttgcccaagctaccaaaattggattaatttctaaagaaccctcaacagataattaaatatcaaccattttatgaggcatgtaagtgtaggtggcaggggctaggagaggggggagacaggaaaatatagtagtggtgtcctgctatttaaaaaacaaacccttttcagagagtcccttattctcattatccttaagagaggaggttggattgttttccctaccagcctgcctcctgctgtatcttacaatgaaatcttcagccacaactgcgtttgctgtctcttcctatgaaataactctcagaatgcttaatttgacttcctataggttgagtagaaatgggctgagaggcagggagccttaacataatatggggagacaaagaggactataaaacaagaaggtaaatggtgtgagctcaagtgtcttgggtattgctaggttctttccagtttgaacatcccttattactggtttcctgaagtcttcttatgtccctgctctgcctgtagtttgctgagaatgaggcttctgcattgttggatcccaattttacctaagcatggagctttgacttttctaactaattctttaattttttgatacttggccattagactctgacatattaccttatagaatgaattcagcaaataaattataattcatgatattaattttcattctccaccctcagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggttgggaaatagcgaagtgttgattaaagtgtttgtaattttgcattaagcttaataatgtcaatgttaattaggctagtgttaatctctttttaatatatggaaatgaaaatgttatatggcagaaaaacttgcttgcctagcaccaggaggctaacagttgatattacagtgtttctataataaatgccatgcgttgctccacaatccagtttgttttctgaagggtctctttctgatatactgtctagtgcctggttgatatggttcaggctgtagtttagagccagattgttgttctagcagttcttcatggcaacatgtgccctgatgcttaaaaaggataaaaataatctgccaagtggaactgataagaatagaggcgtatagaggaagtttatgcttttttttttttttttttttttttgcctgagtggagcgagaggagagcagagaggcacagattaggtattaatacagtctcagaagggtatatcagtatatgccttcaccttcctttcttctgtttctgtgtaccctaggcctgaaatcttgaagcaggaaatcaaagtcttctttgtgaagtacaatgatcccatctatgttaaactagagaagttggacatcatgattcgtttggcatctcaagccaacattgctcaggtcagactttatgcagactcaagttgatgatgatttagctcttaaggtctggcctttaaagaagctaggctgtgagattgctatttgagaatccttaatgattaaccacttcctgggtttaacaggttctggcagaactgaaagaatatgctacagaggtggatgttgactttgttcgaaaagctgtgcgggccattggacggtgtgccatcaaggtggaggcaagtgtctgatggtagttaggatcatgtattggggattctgagagttctcttcacttttttctttaaaataatttttaagtttatcaaaataataaagcacacagtttcaatgttaaagaatttttaatggaaagcagctgtctctggttcctcccttccctacctagactttcttctcagagggaatatttttaactctgattttgcttttagttattcttttgattaaaataggtcctccatatccatgagttccacatccgtggattcagctaactgcggatcaaaaatattcaggggaaaagaaaaaggatggttttgtctgtactgaacatgtacagacctttttttgtctatattccttaaaaatataacaattatttacatagtatttacattgcattaggtattataaataatctagagatggtttaaagtatacaagagaatgtgtataaatgcaaatactataccattttatgtaaggcacttaagcatccatggattttggtatccacaggggcccaggaaccaatctcccatggatttggagacatgactgggctgccatatctctaaataatattcttggctgggtgcagtggctcacacctgtaatcccagcactttgggaggccaaggtgagaggactgcttgagcccagcagtttgagaccaccctaggcaacatagtaaggctctgtttctacaaaaacttttttaagttagctgggtgtggtggcacacacctgtagtcccagctacttggaaggctgaggcaggaagattgcttgagtctgggaggctgagactgtagtaagctgttattgtgccactgcactccaacctgaaaccttttcactctgggtgacagagcaagacgctgtctcaaaaaaagaacaacaataatattcttatgctattatttattaatttacctatcatagactttttctgttaactatctgctataagaagtttacttcatacacccaccattcccacttccgtctcctgttttccagtgtagttacataatgaaggtttttgttcctatatccattatcatggtagattgaaataatatgcctttgtttcttattctatcaactgttggcttgcaaaatttatgcatattacgactgtgtaaatatttagggccaatgtaatgcaaatgattacattttctttcttatagcatcttttttttttctggaggttttttgttttgttttgatttttgagacagagtctctgttgcccaggctggagtgcagtggtatgatctcggctcactgcaacctctgcctcccgggctcaagcgactcttatgcctcagcctcctgagtagctgggattacaggcatacgctaccacacctagctaatttttgtatttttagtagagacgaggttcgccatgttggctgggctggtcttgaactcctagcctcaagtgatccgcctgcctcagcctcccaaagtgttgagattataggtgtgagttaccacacctggccctggagtttctttaattgcctctttttttcttgcatgtgtgtctttatcatgcccctatattattcctgttccttaagcataatatcaaatctgtaaactttcttttgtcttagacccttctcttttgcagtcctctgtcttcttgttttttctactctgactgattgcttttctggcttctgcacatcattccatacagcctccctatttcttgttattggtatatttttccttgcattgctctttttgtggttgcaatagcttcttgaatctctgaggatatgaatgattcgtttttttgtttctgcactttgaatttaattatcggatattttttggtgatgattgcatatctatgcatataattttttaattgagatgtataccatgcatacagtaaagtgcagctcgtttctgtttaagaaagaggtaacagaaaagttgattaggacttctgtatacataggcaaggctgtcgactatcaggtttctgctttagggaagggggtttatctttacatggaagacctcttgaagagcctatctggtcttagagggcagattggtttctagcttggctgcagccttccggtaagtattatgggctgtaatttacattgccctgcttcatcagtcagcagtcctccatttgtttgtcctcattcagaaatttgttgaaattaacagtggcttctgttcactgtttttatgggttcagagccccatgtttgttcttgctacttgattatatgcagttctgcctagagtcagaggattggaccatatgatttctcaggaatacgaaaacaatttgtacagtatgaccagtactttaccggaacaaaaggaggcagatgtgtgtcagagaatcttctatgaaatacctgttcctaattggccttccttgttttttttcagtttagtgctgcttcatgtagtttctgttgataaataatttaatagaaaggctgttaacagcaagaagttagctagtcctgggttctattcctggttctgctagctcacttgattcagatatttaatgtttctcttcattggagaaatgttaaagtctttttgttggatcttgatatgttaacattgtttttattaccactgtcaccacacgtcacaacttgtttttcttttctttttacgttaacatatcttactagccgtctacttagtattaatgtagataattttcagagagattttggtagcataagagtaaggtggttttgttctcttcactagtgtacatagccatcttttccacaagactgccattgtcttatgacctacctctctgacaaagctgtaaacagtaatacaaaaattatatcttattctgaagttcagagactttctagccctggaattactagaaagtgttctcaaagcatctagattcctcaaggctgttagtcatctattgtgactaatggaaaggttctccataatcttctggaaaagacttctgatggctttcacttcttcctttgactaagcgtgctttgatgggagtatgacaggatgtgaggaatgaactttcccaggaaacttaaggtcacccttcaggaatcctgtcttatctagtgctgtcatttcagattacccagatttaccttagaacttttcctgtaactgtttcagccatgaaggttttcagtttgacagagttgccaagccaaacagttaattggaccaggagaggcaatgattgcctgtttgcactaactcatccatgggacaggaatcagcagcataagaattgtaatgaactttctgtatagctttgggaagcaacaagctgttgagcaaataaatagcactgaaaaagcaatcctatggtgctatttttttgttcaataacttttgcctatttctttcaggagtaaacaaactcctggtccttttcagttttaaaaaggagagaggttgaggcactaggttaagaccaggagttcttcacttcctggtcttctggttattttctgtttactatttctgatttttatatattagaataaaatattggtttgtgtgtcatttcttaaagacaaaaaacatatttttcctattaggaaaaccatatttgtttactatatataattatagaacaagttaaacaaaaaatggggtaccccgctttccccatcttctgtttcactctctcagatatgcagtggacataatctggtagacatcattttatatcattgtttatatagtgttctatacaaagatgtatttttttataaaaatgaaatcattccacaaatgctatttatttactttgttttatcctctacttttttttttcttactagtaatatcatggacattgatccacattataaagaaaaatttatgtcatctttagtttctggtttatagacataacgtgattacttgataacttactgaatttgtaactttatcccttattataggaccttaaagttgtttctactctttttccaaatggtggtataaggagtatccttgcaactaaatctttgaactctagttgaagtgaacattttttcataacagttatgcttattagccatttgggaattgctcactcatgtcctctgcacctttttccaatatgttatcttttccacattgttgttttaaagtcttttgtaattgagatgttaacccttcttttagttagcatttattttcctagtttgttgtcctttagatttcttctgctttcttgatgcacagaagtttagatttttgtatcagcttttctcagtcagtgtttttcctcagtggcacacttagaaaattgtgcttcacctaaagttatataaaattcactattttttttttttttacttctatggcaatgattttgttttatttgttttttggggggtggtggggaaatggagtcttgacttgtcgcccaggctggagtgcaaatggcgcaatctcagctcactgcaacctctgcctcctgggttcaagtgattctcctgcctcagcctccagagtagctgggattacagacatgcaccaccatgcccggctaatttttgtatttttagtagaaacagggtttcaccatgttggctatgctggtcttgaactcctgacctcagatgatccacccgccttggcctcccaaaatgctaggattacaggtgtaagccactgcacccagcccttgttttatagtttaagggtaattttaatcaaccgggaaataattttagtgaaagatatgagtagagtggatcaaataccagaacaaattgttctttccttactgttatgaaatgttgtctttatcatatactgaattttgtatgtatttctgtttctggactttttgtatatacaatgatgggatgtttacttctgttcctctgccatactgctttaatggtagttttttttttttaatcaaaagcagtatggttgagatgataattttctttgaaaattaatatccctgacataaatgtttttcaaatgtttatacatcatgagtaacatccttttatttgtattcattttaatgataatactacggatttactaaatatgagctttatatcaagcactgtgctaagcacttacttgtattattaatttatggtaattcaatgcttacagtggcccatattctacatactacataatttattaatataacaattataatattaataaatatagcatatttaaatttttccaactgttttgctgttgcaataacagcaaaggaattaatagctgaaaatgaataaaatagaggacataaatagaatcagaagaaggacagaactacataaaagactgcagaatcggccgggcgcggtggctcatgcctctaatcccagcgctttgggaggccgagttgggcggatcatgaggtcaggagatcgagacatcctggtcaacatggtgaaaccctgtctgtactaaaaatacaaaaattagctgggcttggtggcccatacttgtaatcccagctactcaggaggctgaggcaggagaatcacttgaaccagggagtgggaggttgcaatgagcatagattgcgccactgcactcagcctggtcacagagcgagactgtgtctcaaaaaaaaaaaaaacagactgcagaatcatttcatggtacaacagaaccatcctatatatgacctcatataaatgatctcaaggtacagttttgtttttattaaattgcttatagtggtttagattgttatagtacttctaaagatcttattacagaaattttcaggtgtacaataaagtaaaactgaataatgagatcttgtgtagtcatcatccatcttgagcaaatactgatatgttaactgtttccgttttatcttctccctcttcctcttccttcgggtgggtgggatgcgaatacaaatcccatatatcatcttactcaagtagtccagtgtgtatatctaagagataagatactttaaaaaatatattgtcacattaccatgcccagcaactaacaataattcttaattttattgaatattcagtacatgttcaattgtccctaattatgtaaaaatgtctttttacagtttgtgcaaatgaaaatctaaatatggtctgggccaggcgctgtggctcacacctgtaatactagcactttgggaggccgaggcgggcggatcacttgaggccaggagttcgagaccagcctggccaacacggtgaaaccccgtctctactaaaaataaaaaaattagccgggcatggtggcgcacgcctgtaatcccagctactcgggaggctgaggcaggagaaatgcttgaacccaggagacaaaggttgcagtgagccaagatcatgccactgcattccagcctgggcaacagagtaagactctgtctcaggtctgcacattgcatttgaataatgtgtctcttaagtctttttacttacttattttggtgccaggtattgaagaaactaggtcattaggcttatagaatttcccacagtctggatttggctgttgtatcttagtgatgcagttttatctattcctccatcctctttaaataattaaatctagaggcttggtaattttcttgttcagaatttttagcaagaatacctattgggtgattctctgtacttcctgttgcatcttatcaggaggcacataatggagtgacccattatagtacattgtaatatatgataggctggtccttgacttttaggatctctgttctggtatctctctcttttaaaaatgatcacttatagtttctgtacatttgttttttcacctgtattctctcatattctcttcattaataaaagattaacagataaaactccattttatagattaattataggctatggaaaattgttgtttatctaatgccatagacttttaagtttcatagccccaatattggtaaattgtcgagtactacagttctttggagtgttttggatcatgtgtaactttgaaaatgtaatggaagttgtagacccactcactggaaaatatgcttgaaagctcctacaaaatttggcgatttcatttcagtaggtttaaagacaccctctgctatctccactcatccatgaacttcagttaaagacctcctactttggcttattctttaattcttattctttcctcctacgatggcttattcttcttacttctatctcctggccatccaagatgggtgtgtgtgtttctctgtttctggactttttgtatatacagtgattggatgtcactctacttctctgccatactgctgtaatggtaggtttttttggtggggttgggggcatagtctcgctctgtcggccaggctgtagtgcagtggcacgatctcggctcactgcaacctgtgtgtctcccgggctcaagcaattctcctgcctcagcctcccaagtagctgggattacaggcatgtgtgaccactcctggctaatttttgtatttttagtagagacggggtttcaccatgttggccaggctggtctagaactcctgacttcaggtaatccacccacctctcacctcccaaagtgctgggattacaggcacaagccactgcacctggccataatggtagttttttgttttgctttgttttgttttgttttgttttttgagacggagtctcgttctgtcaaccacattggagtgcagtggtgtgatctcggctaactacaacctctgcctcctggattcaagcaattctctgcgtcagcctccggagtagctgggattacaggtgcctgccaccacgcccggctaatttgtgtatttttagtagaaacagggtttcaccattttggctaggctggtcttgaactcctgacctcatgatccagctgcctcggcctcccaaagtgctagtgctgggattacagtcatgagccacagtgcctggccttttgtttgtttgtgttttttgttttgagacagaatttcgctgttgttgcccaggctggagtacaatggcgcgatctcggctcattgcagcctccacctcccagatgcaagcaattctcctgtcaaagcctcccaagtagctcggattacaggcatgcacctggctaatttttttgtatttagtggagacggggtttcaccatgttagtcaggctggtcgcaaacccctgacctcaggtgatccacctgcctcagcctcccaaaatgctgggattacaggcatgtgccatcacgcctagccttggtagtatttttttttttttaatcaaaagcagtacggttgagatgagaattttctttgaaaattaatatccctgacataaatgtttttcagatgtttatacatcatgaggaacatccttttgtttgtattcaaaggattcatttgaactgattcacctatcagttcaaataataaataaaactgtatcatatagcttggtatctagcctgtagtacagcttggtcaaattaagtgcctgatcatttagtttggtttagttgatgcacctgcatgtttcaaaatttttatgttgaggtggtgttatcgcatagatcatctgacttctcattttttgtatttttcttcccagcaatctgcagagcgctgtgtaagcacattgcttgatctaatccagaccaaagtgaattatgtggtccaagaagcaattgttgtcatcagggacatcttccgcaaataccccaacaagtatgtccaaatacctttacccctctttctcaaattacttaggaaatgtttaaggcactttgaaattgcctaggtaagaattactcttttgaatgttcctggtcataataggatactttatcaaaaatcggaaacattaaaatggttagcacagggattaaaacctgagttttcactctgctttctttctttaggaagaattgaagctctgcctgaatatgcattgtctattggcatattttaaagttaaccagattctttgatggcaaagttactgttaaataggacatctatatattctaggttgttcaggcataatctcagtttatacctgttatccagacataattaatgattgtgcaccttttcttctcagaaatgtataagtttggatgatatatcgtatagcaccctaccataaaagccaggaagggaacagctgtgctatttactttgcatgttacctactacattgtggagaattacagaacatgtaacattatcagtctcatgccttttctgaagtattgtagttattctcatacagatatataaaaaaaaatctgcatttttacttcacaagtttttcagattgagggcctcttagtatatgaagcaaaaatactttttagatttgatttttgaaaacaagtaattaaggaatctgaaaatgaaataaaagcaggttttataagcatcttaaatctcattttgccttacactcatagagcttctgattgtcttttttgagatggagtctcactctgttgcccaggtgagtgcagtggtgcgatcgcagctcactgcaacctccgcctcccgggttcaagtgattctcctgcctcagcttcccaagtagctatgattacaggtgcatgccaccatgtctggctaatttttgtatttttagtagagacggggtttcactagccaggccagtctcgaactcctgacctcaggtgatccatccacctcagcctcccaaagtgctgggattacaggcatgagccacgatgcccggcccacttctgatcgtctttaaagatagtgttaaatgaagcagcttgtagtaagttagcttagtggtgggctcaagaattagtagatatattttggcaaggtagtggtttattaagcattgtgtatatttttaaaattttagaaatagttattttggaaagagaaccacatacttttactactctcccaataaagaagagggtcggtttctaaatttttttttttttttgagacagtctcactctgttgcccaggctggagtgcagtagcgtgatctcagctcactgcaacctctgcctcccgggttcaaacattctcctgcctcaatctcccgagtagctgggattacaggtggctgccaccacacccggctaatttttgtatttttagtagagacagggtttcactgtattggccaggctggtctcgaacttctgacctcaagtgatcccccccacctcgccctcccaaagtgctaggattatgggcatgagccactgtgcccagcctaaactttttttaattaacttttttgtttgtttgttttcagacaggatctcactgtgttgcccaggctggacacatactcctgggcttaagtgatcctcttgcctcagcctctccagtagctaggactacaggcctgtgccactgtgcccgacatttaaacttattaagggtgaagatgtgtatctgaatgtgattggtagagaaatgtatccatttctggtttatggttaataaagagttaggacggtttatgtttaagaaagcaatcaagagcctggtttaatcagtaaaagtaggcagatacttagttaagtgtgctatttagttgtccacatctaatttattatacagggtcattctaatcgttaaaactacattagccaaggagatggattcaacatggtaagcctgagagagctgtagatatgtaaaaataaatattttaattacttctttctttggagaaataagtcagtgcaggtacctttagaagaactaacataaagaaagatctctttggggccaggcgcggtggctcacgcctgtaatcccagcactttgggaggccgaggtgggcggatcatgaggtcaggagatggagaccatcctggctaacatggagaaaccctgtctctactaaaaatataaaaaaattagccaggcgtggtggcgggcacctgtagtcccagctactcgggaggctgaggcaggagaatggcatgaacccgggaggcggagcttgcagtgagccgggatcgtgccactgcactccagcctgggcgacagagcaacactccgtcttgaaaaaaaaaaaaaaaaaagaaagctctcttttataaaaagcagagataagtggattaagggacagatttaccatttcttgtctggacactgttgttgtctaacttcatttgcctaaaaataaagtggaatttctgttcctctctaccatgaaggcaaaatggaacaataggaaaattttctaatgtacttatatgaaagattgttacaaatacaaggtagtggtattatcttacaccacaggttaatttttccttgtaaaaatggcagtgtggctcgcacctgtaatttcatcactttgggagaccaaggtgagaggatcacttgaggccacaagtttgagaccagccggtcaacatagcaagacccccatctctacaaaaaaatttttaaaatttagctgagtgtggtggcactaaattgtagtcctagctacttaggagactgaggagggaggatcgcttgagcccaggactttgaggttacagtgagctatgatcatgccaatgcactctagcctgggtgacaagagtgagaccctgtctccctgtctcaaaaaacaaaacaaaagaacatctgatgaatttttataaaggttttaaggtctaggtcttaaaaaataattgaagggaaatttaagtcattaaaatcttctgacttaaaacctattcattctcttgactaaaagcttttacagtttggtggtttggtttagggtcccttgtttgtggttttgcctttagccttcactgttaaattagttcttagttttgccctcaataaccatagttcattttttttcatcaggtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtaagttcttgtctcttgtctatcctagtagttttagatgtctttggggagatttcagagaaagcaaaggttataggcagtttcttctgtgtctgtatttacatatagtatgttcatttttctcccaacagggatgtctcttctcagttttactaattttttgtttttgttttcgagacagagtctcgctttgttgtccaggctggagtgcagtggcaggatcttggctcactgcaacctttgcctcctgggttcaagcgattctcctgcttcagcctcccaagtagctgggattataggtgtgcaccaccacacctggctaatttttatatttttagtggagacagggtttcaccatgttggccaggctggtcttgaactcctgaacttaggtgatccacccgcctcggcctcccagagtgctgggattacgggcatgagccactatgcctggccagttttactgattttttttttttttttttttttttttttgagacagtttcactcttgttgccaaggctggagtgtagtggcaggattgtggctcactgcaacctctgcctcctaggttcaggcgattctcccacctcagcctctcgagtagctgggattacaggcattcaccatcactcccaactaattttttgtatttttagtagagacagggtttcaccatgttggccaggctggtctcgaactcctgaccttaggcgatccacttacctcggcttcccaaagtgctgggatcacaggtgtgagccaccttgcctggccagttttactgatttctaatgttaaaaacctacataactcagaccagtagttctcaaacttcagtgagcattattaacacctggggggcatttttaaagcacatgttgctgggcttcaccctgagagtatctgactcagtaggtctgagatgtgcctaagtatttgcatgtcttacaaggttcagggtgatgctgctgctggcaatccggaaccacacattgacaaccactggcttagagcagtagttaccactacttttttattttctgtcacctaagaatgactacacatttctgttagtaatggctgtggctcattacagcagggattttcgctagaggctgtggtgaggtttgaaaagattatctttggatgaaaattctgagactgcttctcactttcccctaccaaaattagagccacagaaccaggaagccaataaattattaagcccttttttcttggcatttgtactcaaagcaaatagaaaataatgtatgtaatctactatagcaattttaatagacctaattcaaggagtatgtacaagtcaatagctttgtggtttagcagccaactcctaataggctgtaatctgacataattctactgtcttggctcttgccccagtacgacagatgattccataattccccccaaattgtagcttttggtagaagtaaataatgaaagacttgctcaggagccaattttatcaccatcagtatgttaacatatactttaagaaatacaagccaggctcggttactcatgcctgtaatcccagcactttggaaggctgatgcgggagaatcgcttcaagccagggctatgagaccagccctggcaacattgcaagactacatctctacaaacaatacaaaaattttaaaaattagttgtagtggcttgcacctgtagtcccagctacttgggaagctgaggcaggaggattgcttgagtccaggagtttgaggctacaatgagctatggatgtgcagcctgggcaatagagggagaccttgtctcaaaataataatagtaataataataataataaacacaggtaactatctgtcttagaaacaagcaatattttgtgccaaaaatgcatttcgaggttaaaagggtagagttttcggttgaatacctttgtatttcccacgaatacttttgactgctgttgttgatattgattgagtttcagccttttgtctcttaaccaaaatcagaaaggctccatagtaattcatagttggggaaacaccactttggagatgatggcagggaataatgccagtgccattctttcacactatcacaaattatgtctgtttaggtgcagctcactctgcttactgccatagtgaagctgtttctcaagaaaccatcagaaacacaggagctagtccagcaggtcttgagtttggcaacacaggtaagaaatctggaaaaagcaagatgttgatttgtcttgtttcaaattgtaggaaattatgaaactcttcctaggggattcatttggggaagctttatttgaaggaagtatggcctttagatcctgttaaaatattaaaacaatgcctttttacgtgttcaactgaattgtagctaattctgtggcttttaaatgagttgactgattccagttttcataattcatgaaaattgaacctagactcttagtttagtgaaggacatacttagatgaaaatgacgtgatctgatagtacctgcttcactgtgacttcatttcagctttcaaatgaaagtaccatgtggagataatagatgcctcagtaaagtttcatgcattgttctaccttccagagtagttgcctttctcacagaaattaagtgtttatgctgcttccttgtattatttgatatatttggatctccttggaattatttgtttttttaggtcagaagaaaagaagtttagatggattcagatctcaggaaagtggcagctggctttaaatatcaggtcattatattagatccacagaaatcaaaataattaggttttctagtgtaactagtataatgatcatcagtccattgatgatttagtaatgttcataaatggatttgctaacaggccggctttttagcaggctgtcagagttacgatgtgtgtctgcaaatggaatatgattcagatatccagtttaccatttttctgtctttgtcatccctttatactggtgtgtaatcaaaatttaaaaccctttcacagtactttgcctagttctgagccataatttttcctgttactacaacttaaaaaaatgtatttgtatgagctttttgaagtattttaaaaactttcttaagcatcttcctctgcctgaagcaaagcaattataaacatcagtggttaatattatctgtattgaattgagcattctaatttcctggatcccatttgcatctctaagatgaattcaaaacaatttctttattcctcccacaccccccacagccttttttttttttttgtactctgtttcatgttttaattttaaactcctaagtcaggagtgtccagtcttttggcttccctgggccacattgggaggagaattgagaattgtcttgggccacacataaaatacactcacaatagctgatgagctaaaaaaaaaaaatcacaaaagaatctcataatgttttaagaaggtttacgaatttgtattgggtcacatgtggcctcaggttggacaagcttgctgtaagtggtcacatagaatgacattattagagcagctcacattctgtcaaaacaatttctaaagagaattttggcctttcttcctctctgcttactgtaaatattcaagcaagtatgtttagtagtttcctctgttttcacaagttctcaaccttatcatcattgtctgttaaagcctatgtgattgtatttaacaggcaccataggagagctgtattacgaattctggccagacttcaaactcagtctcattacctcttaagtatttatcaaaatttgactgagataaagtatttaggaaggattgcttaaaggatacaaggtagtgctgttcttacagatagtctgaaattcacctctgaatcaagcattattaatagacatctggatacctggactgcattgtttttgacccctaataaaattgcttttactaaattacgctgatactaaaatactatcagtctgtagtaataacagtcgtcatgggaaactaccctatttggatctgttgttagcttgttatcagagtcattacttacttcattatgttttcttctttatgaagccccatcaaatttctaacaagttttggatttttctgtgtatcagtgtagcatgcctgatcagctttcttttccatattggttgtttgaaaccttagaatcacatttaacaatctcccatggaaactatgtaggccactgtggcatgcagtttcctgactctgggtttaattaacgctctttagccttagatgcatttttcataagcttcctagaacaggacaggctagaaactcacttaatcctagtaagggttagtaaacgatttctattttatagatgaggaaactcagagaggcctaattattatggggcagaactaggactcagactcagatagtctggctctaggtcttgcccatggtcttgtccactgtgctatgcttcctctctagtctgaaggttaagaatgacttggagaatacctattccctgcctgaagcaatattgagcataagcccatatgtatatgtgtgtttgctagttttaaggtctttgtggatgattatttcatactataaataataagcaacttctcgaggcttgccttttttcaagactgagtctagctctgtcacccaggctggagtgcagtggcgtgatctcggctcactgcaacctccacctcccgggttcaaacaattctcctacctcagcttcctgagtagctgggattacaggtgcatgccaccacgcccagctaattttttttttttttttttccagtagagatgagggttcaccatgttggccaggctggtcttgaactcctgatctaatgtgatcctcctgccttggtctcccaaagcactgggattataagtgtgagccacagagcctggctgaggcttgctttttctgtccaattaattaatgaagtctgagaagttatcataaaacagtaagtatgctgctgggtgctgtggctcacacctgcaattccagcactttgggaggccaaggcgggcggatcacttgaactcaggaattcgaccagcctgtgcaacatggcaaaatcccatctctacaaaaaatacaaaaattagcggagcatagtggcacacgcctgtaatcccagctacttgggaggttgaggtgggaggatcgcttgagcccaggaggcagaggttgcagtgagctgagatcatgccactgcactccaggctgggtaatacagcaagactctgtctcggaaaaaaaaaaagaaagaaaaaaagaataagtatgcctatgtaagtctttttacctggaagttttctgttttttccccaagtttgtgaaataagaacctaaatatttatggctagtgagtaccaatttaagtttaggatgcaatgtggtcggctgaattgtgttaacttaaattggtatatgtgctgccgaagcgagcacatgttaacttaaattgggtagtgaggttctgatgatgctacttccactgattctggacatgactgagcaaatttctttcatactgcttttcttctgtctctatagtagagttaattaatactgttctttacctgtgctgagaattaagtgaagtatatgtgaaatcttagtgcttttaagtaaaatgggagtataattaaaaatattattagttagggggaaaaacccaacccttgaatctgaggcttcatttcaaaaatttatctttttctcttacctgttacacagaaattcaatacaatattcagttcaactgagtaaagaatacaaacaaaggccgggcatggtggcttatgcctgtaatcccagcactttgggaagccgaggcaggtagatcatctgaggtcaggagttcgagaccagcctgaccaaaatggagaaaccccatctctactaaaaatataaaattagccgagcgtggtggcatgcgcctgtaatcccaactactcgggaggctgaggcaggagaatcacttgaacccgggaggcagaggttgcagtgagccaagatcgtgccattacactccagcctgggcaagaagacctagactctgtctcaaaaaacaaaacaaaacaaaacaaaaaaatgtctagacgttagtaattattctttgtgatacatggaatagaagtcttcatgtttttctgtctatgaactaggggccaccatcatcagaatcatttgggctgcttgttaaaaatactaattactaggccctacttttgatgtaatgaatcagaatctctgaagtatggcccctgggttctgcactttcagtggcattcctggtatgttaaaatgttgatgcacattatagtttaagaattactgttttagtgctggcctggtaagtattgttttgggacctcttcccctgaggaaggcctatgggtctagcagtacagtagatccaaagccaaattatctgagtcaccaaacatttaatggcaacttaagattacaaaaaggtcctgtatttttatttatctcggtcttgacggtctgaattactgtggcctccatgtaaaatgtgaggcagttggtgaggactggcttacagtaggcctaacaggtcatccctcagaacgacagagtttgagcagttaggagattcttccctactcctgacttttcagccttgggagatttgcactcatttctcataggattgtatttttcaagttagtgtctgtttagactttgatccagtaactctatctccagtagtttgccatattgcagcattttgaataatctgtagaggaactctcaaatttttttcatatatatataatttttttttttttttttgagatggagtctcactctgttacccaggctggagtgcggtggtgcaatctcagctcactgcagcctcctccgcctcctgggttcaagtgattctccctccttagcctcccaagtagctgggattacagacatctgccaccatgcctggctaatttttgtaccctttgtagagatgggattttgccatcttggccaggctggtctcaaacccctggcctcaagtgatcagcctaccttggcctcctgaagtgctaggattactgagccaccgtgcctggctgagatttttgaattttgtgaatccctataggaatttttctttttggtcatttggttaaattgtttacattacatatgggagaaataatttgaagaaaaagcattttattttgatgagtatattattaaactatgtattataaagttgaatacctttaagatattactagtccataaagacaaactgaattttctaagttaataagataaatgcagtgtttaattatgtaataaaaaccatactttacaaattctaaagtacatgtgccttaaggactgcatatataggttaaaatttaacgtttaagttacatataaaaaaatgtgggagagaggagttgcttccctgacctgatattttgagaaacttgtattctgctcttttaaaaatatcaacttgtttttgttttataatgttcaagctttgttttcaaatgaagatctaaatgaggaggtttcaggctgctatttataaacacttaggagcaaattagtccctcagtgccccccctccccacacacacacaaacaaaatcaactaaattagatataattatcactgtttcttttttttaacccgggcatttcaaatactagagacattttgataagacattcatatgtatacatatacatatacacatacacacatttctattagaataatgcaagttataaatgtaaagattatcttgagataaaatttactgttttaatattttattaatttgctgtattgcaatgttctatatgcttttcgtctttaaccaccaatccattatgagtgcaatttaaacaatctgtgactgagaaaaaccatttaaatctatatagtcaaaaacatcagggtaactactgctattgaactggatgataagggccttaagtggctaaatcgtgaatcaattcatctgctcgcttagaaactaaaatggaagccctcagattgtcctgttttaaagaaaatgttttttgtttggttatgagttttttgggttttgggggtttgtttttttttttttcttttgagacagagtctcactctgtcatccaggctggactgcagtgacttgatctcagctcaatgcaacctccacctcctgggttcaaatgattcttctgcctcagcctcctgagtagctgggactacaggcatgagccactgtacccggtctggttatgagtttgaaatatagaaattgaaacagggacttattgttgcctttaataagttgctgttggaacaactcgtgcataaataaatgccatcatatagacatacttttgaggtaggtaccaggatatttattgccactttataatgatgacaaaaacaataaagaaaacaataggccagacacggtggcttatgcctgtaatcctagcactttgagaggctgaggtgggcggatgacttaaagtcaggagttcaagaccagcctggccaacatagaaaaaccctgtctctactaaaaatacaaaaattagctgggtgtggtggtgcgtaccaataatcccagctacttgggagacagaggcaggagaatcacttgaacccgagaggcagaggttgcagtgagccgagatacgccactgtactccagcctgggtgacagaacaagactctgtctcaaaatacatgcatacatacatacatacatacatacatacatacatacaaataaaacaataataaaggtagaaagggaaaaatgggcaacagtgaaaatgtccctcaatagtggactaataattaatggtgcagtgggcattacagtggaaaagtgcagtcgtatatatcaacatggagagcaacttcagaacagtatatataatatgaaactggttttatatgaaataagtgtgtgtgtgtgtgtgtgtgtgtgtgtgtgacccatctggacagatatataccacattactaatcatggctatttgggggattgggagttgagatggagaagggttggataattgggggagattttttttttatgtcacacacttaaaaattgtgatgtggtatgtttggtaataatttctttttagccatgaacatgtatacaattatttaaaaaccaccatagcacaaaacaagaccaccaaattcaagtgttactccttttggaagcagttatgtcctctctttagcagtttttgattatttagataatagtacctttcatactctattgaaatagttaatattacgtgagctccttaaagtcaggcagtgtattgttacctctttatttccagggcttagccagtgtctcaataggagatacttaataaatatttgaatgaaggaagaaggtatgggtacaatatatggaagatataatatatgttattaataagcctgctaatatttaaagcagttaaaaaaaatttcttttttttggaacggagttttgctcttattgcccaggcgagagtgcagtgaaacaatctcggctcactgcaacctccgcctcccgggttcgagtgattctcctacctcagcctgttgagtagctgggattataggcatgtgccaccttgcctggctaattttttgtatttgtagtagatacggggtttcactgtgttagccaggatggtcccaatctcctggcctcaggtgatcctcccgcctcggcttcccaaagtgctgggattacaggcgtaagccaccgcgcccggccctagtttaaaaaatttttatgtcctaaggccgtctcaaccagttaacttttgccagattaaacattgtttttctattctttatttctgtttgaatttgagtcttaggattaacccatcttaatttatagttacatcccttgaaacattagagattacagaattatgactatattaggaccatgttgagttaacacatttgtttgctttttgagacagagtctcactctgttgcccagtctggagtgcagcggtgcagtcatggctcactgcagcctcaacctcctgggctcaagtgatcctcctccctcagtttcctgagtagatgggactacaggtacatgcggctctacaccccgccctgataatttttgtacttttattattattattattttttgagacagagttttactctgttgcccaggctggagtgcagtagcgtgatctcggctcactgcgacctctgcctcctgggttcaagctattctcctgcctcagcctcctgagtagctgggattacaggcacacgccaccaagcccagctaatttttgtatttttagtagaggtggggtttcgctatgttggccaggctggtctcaaactcctgatctcaagcgatccgtccaccttggcctcccaaagtgctgggattacaggcatgagccactgcgcctggctggccctgatgattttttatattttttgtagaggcaaggttttgccacgttgcccaggctgatctcaaactcttgggtccaagtgatccgcctgtttcagcctcccaaggtgttgggattacaggcatgagctatgagctaccacatccagcctgaagtatcttcttaatacccagtctgcataaatcactacaacattggttgatgataaatccagcagtttgggtttctgtatggagaacagtttcatctccacctccttgcctttgccttttctttaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggaggtaagaaggtgtgaactgtctctgagtgagaaatgactcttgtttagacagcgttgctcttctttatgcttttatagtctggaaaagaactgctgtacatttttgcttctttatgcttttatagtctggaaaagaactgctgtacatttttggacacctactactatacaaccccagggagctccatctgaataccagtgaccacacataaaatcggtgaaagactcctctgtgttccaatctaggagtacattatggctttagaaaattgtggtgaagaccttctaaattgataaagtctgaaagttgcttaagtctgcagtaagaagagactagaaataaccccatagttgaaaacttggaaaaaagcctgtgtatacatttagccatcttgatccattactgtagcttttgttgagccttctggatagttagcaggtataacttatgctgtaaagctgttaatgaaataatatttcagtattgttttatttaaaaaaaaaagcctgacttctatgtggacttagtttttcagttacctgtacttttttatattggccatatcagcaaggaaattgttatgaaaaggctcttgggtaacatggagctcttgctttgtagctatcttaaaattctaattaggcagaagaaacactctaataaactcttacaatgggtatctcagaatcttttcagaatctgattccttcatcaatcatagtagaccttgattgaagtaggatttccttccagagtagttagaataattgggcttctattaatgagtgtcttgtaccattgtctaatatatattattgtttaagtggtttttgtgaatggccaaagtataggatttattgctttacaaattggcgtggtcagcattttgggttctatgtaaatagactgtggatacagataaaggaaaaaaaaaacagcaatacccaaggagattattaatctttcataattgagttgaatctttgggtttacagcaggtgctataattttaatccagaggagatgtgagcttcataaggattagtctttatagtaagttagggtgtttctccttgtaggcaaacatgtttaacattctatagatgagactatttaacttctaagaatttctcccagtctgtgcttcaagtttcgatgtagatacggattttctgttgtaacttccctctgtaaccgtgtttgtatctagcctcctgctaacttttaaccctcacatggaagtggggaaatgaatcaacaaacaaaaacaacgctttcttaaacacagggagagaaccaacatttaaactgtctaaaaagaaagtgtcttacataaggcctttatctgattaatagcctttaagttcttatcttcacaatttcttttgtggttcctttttggataacctcctttttgtcatttgtgcatgttttgtgttttttaaaaaaatgcaagtacagggaaaatctgttttgatataaatgggaatgatacgttgctgcaaatgacatgtctgtaatagtattgacattacctagctctcttctgcaatgtgaggttaataagtgatacacctctcataggaaacaaagcaacactttaaaccttattctgcatcttctagaggtttaaaaatactcacttcactaggtcttttaaaatcatctgggaaagagagaagtgatttttacttggatattgcttactatgcttatacttgtcagctgctctatgggggtgaggtagtaaatagttgtctaattcagaaaaatctcacctttaaaaaatattgctttaatgacagttatgcagttatttcccttaaaattggaaatgtctttatattaattttcttatattttccattgagaaagatgtataataatgatgtatcatattcttgtagaatctataggatcatttatatcttttcattgaactcactttatcttctcatattattcattcctttccattagagtgaagaaaaatatgtgcatgatacctattctaccttctttttagacatactgatagaaccatgtgttctgtcacattttctaaatggtatgtcagaagatgacagaatttcatgtgtagagaatactctgtgaaagattttatttatttcttgtcaggtgtatgaaatcatttcccctttttacttctttcttaaagccttttcatcatggcttcctggacactttccttgtaaattagctttcctagattgtatttctgtctttaatctttgcagttccatgtttcttctcttctctgattattaatcttggttgtatcaaaaggttcaatctgaaccctttctttctgtgtttctctacatattcccttagggaaattacccactgaccactaatatattacagagctttaccatttagaccatgttttcaattgatccttgctttaataaaaccttatgcttcagtgatattgttatcactgaagaaattttgtctcacagaggttgtcgctttccgaaaattatgcagctagtaattaatggagccaacacttaatcccctgtttttaccaccatcctacactgacccacaccctcatgatttcacctgagatgtgtatgtgaatttctaaccaagcttacttctctagctctgactgccagtcccttggttttgtttttgtttgtttatttgtttgtttgttttgttttgtttttgagacggactgtcattctatagcccaggctggagtgcagtggtgcaatcttggctcactgcaacctctgcctcctaggttcaagaggttctcctgctacagtctcctgagtagctgggactacagatgtgtgccaccacacccagctaatttttttgtacttttagtagaggtagggtttcaccatgttatccaggctggtctcgaactcttgacctcaggtaatccagctgccttggcctcccaaagtgccaggatcgcagacgtgagccactgcgcccggctggaatatgaacaggttctgaattatcgaccccagtgctctaccctgagactctgggcatgagccaccgtgcccagcccagtcccttgttgctgtcaggcttctctacttgtttttcttacttatcttaacagaattgaaacctgcacatataatttttcctgtcgtccttctagagtcccctgtgattattagctaatcttttgcttcttagtttttgtttgtgtcaaaatttaactaggcttttttaaagaaaacatttgttttttaattaaatttttacaattttttttactttttttttttgagatgtagtctcgctctgtctcccaggctagagtgcagtagcacaaccttggctcactgcaagctccacctccttggctcaagtgattcttgtgcctcagcctcctgagtggctgggactacagctgcctcctaccactcctagctaatttttttgtatttttagtagagaccgggtttcacaatgttggtcaggctggtctcaaactcctgacctcaggtgatctgccgaccttggcctcccaaagtgctaggattacaggtgtgagcctctgtgcccgcctgtttttttgttttgttttactttttatcatataaatcttaaaatatgcaagatagaatggtataacaaacttggatatacctatcactcagctttagcagttatcagtatcttgccagtcttatttcatttattgcccatacagttgtttttgaggtggctcaaatattttaaatccaatcccagacctcgtatctcttcacccgtaagtactgtacttggtatctttaacagataaagacttgaaattacaatgttatcaagcctaacaaaattggacataattacttaatatcatccaataagcaggctaacctactttcatattttctcaattgccattctctagtctcgtttagagtttatttaagatcggctttactttttccttaaatgtttggaggaattcacagtgaagccctctgagcctggaattttcttggtgggaattttactttttaaattgacatctaatttataataaccttagcattaaggttattgcctgacctttgcacggtcaggataccacggccgttgaacatatgtcactgggcaggcagtgcctctactactggtaatgctagcggtgatgtttttggtaaacaagctgggtaagatttgccgagttccttttactgtttgtaatctttccttagagcatacctgtgttggattaacagtataaataatagggtgtttattatattgtttattaatattaggctgtcagtggattattccggtctgatataagcttatgcagtggagaatatcttcatgttacttatattaacattattgcttctattaagtaatagattagtccaatctgttagtaatagattagctcgctaatcttagcatttagtgctcaatgaatttttacatatgtatacactcatataatcactaccctgatcagatatagaatattttcagcaccctagaaggttcctcgtgttcctttactgtcagtgtgcacactccagagattaccactgttctgatttctatcactatagattcattttgtctgttcctgagtgtgctataaatggaacctacagtttttactcttctgtgtcttgtgtcttttgctcaacataatgtgagattaatctgtgtttttagtagtttgctcctttttattggtgtgtagtattccattccatgaatataccatttatatcttctattgcacctttgggttatttctagtttgtggctgctgtgaatattcttgtatttgtcttttggtagacttatgtatatatttctcttgggcatatacctaggagtagaattgctggatcatagaataggtttctaattagctgtaggagacactgccaattttccaaagcagttgtaccagtgtatactctttctagcactgtatgagttccatacatctatctacattgtcagcaatgcttggtagtttagttttagttttagccattctggtgagtgtatagtggtgtcttgttatagttttaatttgcattttcctgatgagtaaagttgctaagcacattttcatgttactgtatcctcttttgagacttgcctatttttaatgatttgtctttttcttaatgatttgtaggaattccttatataatttggatgcaagtcctttgttagttatatgtgttgtgaatatcttctctcagtttgtagagaatatcttttcccaatctcttaatggtgtcattggaagacatgttcttaattttaatgaagttcagtttattactttttttcttttgtggctactgctttttgttgaaaccattatcttctccaagcttataaagatgctactctaggttttcaactaggttttacctttcacatttatgtctgatttatctcaatttttgtttaccttgtgaaccatagggggccaaggttcatttttcccccacatagctatccagttaacccagcaccatttattgaaaagatcatcgtttgtcctacctagtccttttaacatgtcttgaaactcaccactttctttttatttttattgcctgttgagttgttgttatttcatacattgttgattacagtagcagtttagattactcttagctgatcttcatgtccattctcctaacttcagtccgttatacacacaggtgctagaataatgtttctctaatgttatttttagtttctgttctttgttcaagaaataaaagtgattctgcatttcttatcatataaaaaatcaactcttggccgggtgcggtggctcacgcctgtaatcccagcactttgggaggctaaggtgggcggatcacaaggtcaggagatcgagaccacggtgataccccgtctctactaaaaatacaaaaaaaattagccgggcacggtggtgggcgcctgtagtcccaactacttgggaggctgaggcaggagaatggcgtgaacctgggaggcggagcttgcagtgagccgagatggcgccactgcactccagcctgggcgacagagcgagactccgtctcaaaaaaaaaaaaaaaatcaactctccagactagttttcaaagttttattttccttattctctcttcctccaaattttaccaatcccaaactctgctcctgccaatataattttttcaccacccctaaagtcaaattgttcatttctgtgcctttgtacaaaccttctcttcctctttggaggtttctctctggtagttcctcataaaaccattccgagaagcttttagaatcagcaccgttgattttgttgtgtttctctctcatatcctatcaattatgcagacacacaatacatgtttctgctgttacacagtaaacttgctttttattcattttgtaaatgctgatttttttgttggtgtgtgagccattcagggcaggaaccatatattttacagtttctacagagaaccatagaattctccttacagtgttccctcatagacgtttaattaaaattgaccaattatattatataactgacaaggtttacataatataatttattttcattttagcagctgtattttgataaaaataagaattgctattatctcttcatgaacataaacaaatggttataaaatcagagagtttttcccccttgtatttgatagttatatatagctatatgtttcactgttgttgcgatgttatgtcctaggtgaaactgacttttctcttttctccattttatgtgtatgtgactttagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtaagcatctttcttcccttgttcttttggttatttttagttcttgatatgctagagagttttaaattattcagctttttagaactagacctttccttgatgagcagtagtgtcctttgataaaggacaggattctttgtctttagtaagacaaaattataattaatactgttcatcatcggtaatggggtatgtctgcaagtgtatgggattatttcattgtcctgcctctaaatagaacttttgacatttaaccatcctattgttcagcaattttaatgtttagtatcttttccagagtttattattgttcctagctcttaactctggatagcccacataaattctccttttgacctgaacggcattaaagtgacctcacacaaatcatcctattttgaggctttcaaacctttgcctttttaatattttatttacttatgccctaattctgaaaggttttgaggcagcctttttttttcttcttcttctttttttttttttaagtaaaatgtacctttattacagttgggaagggctgcttgattggttctttttttcccttcttccccacctactccattctatcatacttccaatttaattagcttccaggattctaatactaaaaggctccaaagtccagaatacctgcgaacatttgccaccaatgggaaccaaaattattttttgtttctgtacaagataaatgaattttaagggtgaccatcaatctatgaagagaaggccagaaaaataacaagtctattacaagactgcctacatagtaggtacttaactgtggtggaattagagaggcttttctagctagacccttgcaaaagagatttttgtcaacccaatgactataaagatgcccaacaacgatttatttaccaatatcattggagggctgacatcttagatatgaaaatatgtgttcccagagatgacagacacaaaacaactgcactctctgctgcatatactggcatcttctcttctactttatgaggagttttatgtctgggatttataccagccagtagaggttcatttactttttggctagcagagagtctaaggaaatagggttatagtcatatctctgtgggttgtgcattttactaatggaaaatcactgcttctagaatttatacattgaccaagctgtggactccagcttatattgacacaaatgagcacttctgttgtctttcttgggaatataagcaaatactttttatattcatatctttaatgattgaaactgactgaatagcttcctcatatgatcattctacttatattgctgtatagcctccttatagactccggagagtgacaaatatttaaatgttcatggaggctcctaagaatcccttataaaattaaaatagctcttccttttctgttcacattcaaccacaaattaaatattgcatcctcctcaagtttattacattccctggtggggaagcttagtaaaggtggactcattgaacctaaaaatgagaaacaaagttcaagggatagaggggagaaagaggccctgccttttcatgttgccagacccaggaccctgcttgacccactataaacatagaaaaaaagagacatgttactttcatttgactttgtattagctcatgccaactccaaaaccaatgggttttgtcatcatattttacatagctgcccagtcatctgcattagaattcctgcaagtattgtatcaaagggaaaagctgttagaacctgcttggattgtagtagccaaagttgcacacaggcctatttcctttttttttatataagggatattcttttggggatgggaaagttgttgtttttctaattggatttctaaatatgcaacctttgctagataggcccagttatgtttttatgtaactctaaattttaacatttcctgactttgggatctaaaatggtatccttggtgttacagccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttatgcaaattacctaaagagaagattaatcctcaaagccattttttgaatgcatccttgccttacagagtgcttctcaaaataaattatataccttgaatctcctaaagattttgtacaagagagggtttgttttgttttgtttagtttgtggaaatgggttctcactatgttgcgtaggctcatcttgaactcctgggctcaagcaatccccctgccttggcctctggaagtgctgggattacaggtgtgtgagccagcacactgagcctgcaagagatgatttagttggtctggagtgagacctagagtctgcgtttctaacaaggtgacactgaagctgctggtccatgggccacattttgcatagtaaggacatagaatatcttgtgaccactgtgaactacttcagtttagtgtttgaactgtagctacctagatgctcagatacctttttctttttctctctcttttttttttttttttttggaggtggagtttcactcttgttgcccaggctggagtgcagttgtgtgatcttggctcactgcaacctcacctcccaggttcaagcgattctcctgcctcagtcttccgagtagctgggattacaggtgcccgccaccacgcccggctaattttttgtatttttagtagagacggagctttaccatgttggccaggctggtctcgaactcctgaactcaggtgatccacgtccctcagcctcccagattgctgggattataggcgtgagccaccacgcctggccctttttctcttgacttcagtagtaaacagacttctggaaagagggctcctcctctcccttaaattaattcagagggcaagaaacttattaaattattttgttaaagctctttcttttgccctgtagggagaatagtgtagctaggagtggtagaattcaacccaaacccctgtttaaaatatggccatagttagaattgtgtggtggtttgggaagcagcgtttaggttagctcagtgatcatttcaggaaggctatcaaccaggccactagactgttggttctatttttatcatgggtttctaacagaacctcacccatagaggccagtggtgtactgctaacaaagtattgcctggttcctgatgaccatatggttctcaactctatctgcagaattggtcccacataattaccagtttaaaaaaaaatactctctagccattgaaactataaagaaaaaaaatactatcaatacttgagtccaggagtaattaaataccacctctgggaggcaggacctagacattgctatttttaaaaagttacctgggttattttaatcttgcagccagtgttgagaacattaaaccaaatgaaattccaaatggagttaggtagagatgttaaaaactgatctctaagccaagacagtgaccgccacagaagaatcatattctcgagatcctctttggcacctcctacaaaaacagatatctctgactttacttttgttcttttccccctgaatatttttctgttatgatattctgtgaggttatccatcgtgtcagaagttgactggaagttgaatttgaccaatttagatatggtcgctcagtcccagggtcctttttatccttgcttacttgccataattggagaccgaaaattgagggcattttatattttggattgtctaaccattttctattcttctatcttaaaacttgatattcatgagaagatatttttattcttcctttttcatagcctggtgatcttcccttagatcttgttctgtttcatcttcttttactgtcacactcataaaattcggccagcgttaagatgtagtgagttgtgaccttttcttattaggttggagcaaaagtaattgcgatttttgccattaacagtatttacttttgctccaacctagtagaactgtcacagtcaggaaatacttatcaatttattatttatttgttgatatttctagtcaggaatgttttgccacaacattcctgaaagctgtggccttcctccatcaatagtagtgactctcaacattggtgattctttaaagaggagtagggtgggccattgctgtgatataaagaaagtaaacatactgtagctccccaggtgattgattcttgtatgcttttttaaagaaagcagacatctttgaatggaatgcctcttcatctcaagacttggataaaaatggatttctacctattctttttagtctccttactgaaacatccttatttttttatcgcatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagccatgtatgtggagttttttgggtttgggtttgtttttttttttttttttttatgactctggtacttaatctaagaaactgctcgttctgagtagtgtgatttttctcaccgtgcagatccttctggtttggtgtagtgtgggaggtgacctgatgcccatgtgtataactcttgcatatgtgttatgtgctcatgagtctgacatctgcgaggatcactgaagtaataattgaatctcagttattttcttgcctttacttccaatctgtcagcagaggccttggctaaattacagccttttgttcatccaaggtgctgtgcattattcttttacataaacagtgctattgtgtatatcaaaaatggaaaggaagaattatccaaagtgccctttctctgtgctgatgaaggatttcatcctggagaaatatgctgtgtgcccagcttgagtggtatggaattgaagagaaactgccttttcctgaccctcagtccatgtttttcccactgtttctttcaggtttttacctttcagattattaagtcataagctatttattaatagttttgagattttttagcccacaggaaatccatcatctatactagttttgcatctttatttttcttcctttggaggagctttgcaatgacttaaaagtttagtttttagagtttgtgttatgtggaaagatctttgtaagttgttgcctgttaaatttctcagtgaggcttccataaccaccatctttgtatcagtgcatacgtttagtcaaggctggcctcagacagttttgagaataattactaatttctgagttctagtccctgtgctagaatttttataatttctaatcctcagaacaactcaagaagataattggtattggaccccattttacagaaaactgaaggtcatacagtaagttgcagagttgggatttgaacccagggcttctttaaaacttcaaagtttgtacactttatactgtcctatgattttccagtttgtttgttattgtcatcttgcagaatagaatacagtttcacctaactggtccttctcaaactgggaaatgcagtctctggagtacacagcagagtgcagggtgcatttgaagctgcagaataaatatggctcattgtcttgcagtgtcagtcttacttgatggtaaataatgtaaacagaatatacactggtgtgttaccacttagaatgtaaaattgcatgactttaagataaaaaatacagcttgcttgccctgggcctcttgatggtgtacatcccaggtccctgagtatatgagtttgggttaatgtgtcacatgaaagttggagaaggactacagaagtgtgttcattcatgaagaaaagagactgaataatgagtaagttcatgcacctttcttgcagcaagaggaacagattgttcatcttatccttatttatttatttaaagacagggtcactgcaaccttgagctcctgggctcaagtagtcctcccacctcagcctcccaaagtgttaggatttacaggcatgagccactatgcctggtcattttattttcatttaagtaaaaccacaaaaatctccgtttcccatctcttcaccagtgagctgtaataaagcagtagtactttgagggcagttaaatgatgtgcaggcattcttcttctgaaaatttcctatcaaaaccactcaaacaatacatttcctccctagaatgagttttgacccggctgggagatgtttgtttatttatttttttgagacaaggtctcgctttgtcacccaagctacagtacagtggtgtgatcatagctcactgcagcctcaaactcctgagctcaagtgatcctctaacctcagcctcccaagtagctgggactacaggcacatgctgcacacatggctaatgggtgttcattttttttcctcagttggttctattcatatgtttgtcaatgttgatgcagatattgtgctctaagtaaacaattttgtcaggcttttgtccttttggtgataattttccctaataaaatgattcacttcaagattgtctcccaggaaatactgccagtagccatatatatattactgccagtagccataaatttatatttacgaaacattcattcattcaataagtaaatatttgagtgcctagtattcaggctctattctgtgtactaggcatatagaatggtccttgcaaccttacgaaacagtccttggaagcttacattcgcgtaggggagacaaatgataaagtagcaaatgctgtgaaacaaagtgagacagaataaagaggttctcttgttgatttttactatattcatcattgagttctgtctgacctaagagacctgtggtgaccattctaaggactttttgtcttacatcaggaagtaatccgttccatccccctacttttccactgatagaagccttttcccccctcaggttatggagtcttctgatgatttttatatgatctcaatgcgtttatgctattccttatcaagtctgctcttagccatcagtttattagcttttgcatggttacagagtctttccaccaatttgattaattatattttatgatgctttttggaatagcttttttttttttttttttgagacaggatctcactctgtcacccaggctagaaagcagtggcactatcacgacatactgcagccttgacctccctgggcccaggtgatcctcccaccgcagcctccgaactagctgggtctacaggcgcccaccactacacccagctaaattttgtattttttgtagtcatggttttgccatgttattcaggctggtcttgagctccggggcccaggcaatccacctgcctcagcttccgtaagggctgggattataagtgtgagccactatgcccagccttgaatagctttttgaagatcatattaaaatttgcagcctagtagctaaaaaccatactttaacctacaagatactgtgtgccatctaaaatttaaactctgttagaaagacacacactgatggttttgataccaataggattttgacgatagttaagttttattgtttgtgaagggaatcattgtatactatttttgcaccattctgttgactcctgaataatagagctattggtaagctatatggcttggagcattccttagattcccttcaattcagtaagttctagaaaacagtaaataaaagagacactagctctaaacaggagcatagaaatgtctgagcttaagatatacacctgcagttaagagaatgtcttcagatacctagacagctccacagttttagaagcaaacagatgtactttggactggccagacataggtcaaaggggctaacccagatcagtcattatgataatttgtgggattttttttccagtccgctcagtggttatctcagatgatattcctttataaaatttaaaaattccttttcaaattttcttttcttggagtcaggcggatttattcccctatataacttcaatcttgagttccttctctgtatttctgctgttgtagcacattgccattggacaggggcatttccttttgttatctatagctgaactgagcctgtatgcgggctcagctctgagacttttggctctacctggctctacagagctcatgtaaccatgccgaaatccctttagcccataagttacaataagtcaccataaaacccctgttttctgtccagttactgaacattattgtgcaatgacacattattgtgtagtttaacatgaaccaagttccactcagcattacttcagatgtggtaaagtgaccactctttggcagtagacaaatgttagtattattctcagtgccatttaatgactacagcaattatgggggactacaccactagcagaaaatttggatttaggtatcagttacagatttttaatacagactgttcaattctcagtatttgaaatattcttttcctgaagttgccgtctttcccccttctttctgtatctgatttagttgacctataattgacatcattttcttcatggagaaaatggcagcctcagtaaggcaatcctgggaacaatagtgagtggacacctccaagagacacttaaaacacagtatctagacatttaagatcaggatcaaagccataccctgcactcctattccttttccctcctgtctcctaccagctcactggataacagatatcactctgagttttacaagttctagtttgattgattttgtaccctacctgataagtatgggcttagagtatgtccagacagatgaacctgaatcccaataatctcaggctgggtgcaatgattcatacctgtaatcccagcacttcatgaggctgaggtgggagaatcgcttgagcccaggaagttagagcccagcctgaacaatgaagtaaatttttttctttaaacaaatagtgtccaactgaactgaaatagctactgtctagttcaggctgatatacaacaactttcttgtgtagttgttcactttctagctttcttttttcttgatgagtatctccttcctcctgtttatcacttgtagataggagaggccactcactgggtaattcgcttccattcctgctgacatctccctattagtcactcacacccatcatcatgctgtcaccttgccatggtttcagagagtaggataatctccattagaatatttttcagttaagagggaagttgctgaatagtccgcataagctgtagtcttgctagttagaaaacatgtatagtattgaaattgtcctttccctttgctctctgaacatagtacaattaggtgaacctttgtatccctggctgtgtctctgatatcttttggaccctgtctttgtgtcagatcagagttcatgtttctagctgagttgtatctgatatactgaacataaacagaggaatgtcaagattgcttttcagttcttcatgattttgaataaaattgacaagcactgggggacagtactttcagatcctttccagctaagataatattcatatatcattcaacgataaaaagaatgaaatctaagaaaataagggctatgaatgtgctttctttcctttggtctaaacactacccatgaatctcttttctcaatgccttttattgaatttagcaaaactgctgtttcctttccaatgtgtttttctttcttgctgttctgtgccaagcaggttcataaagaattctatctctttgaatcttggattataagcctagccagaagaggggagaataagttgcggtgagagggggtaagcccatcagaaagtcgaaaaccacctcagagtatcaggacaaatgaaacatttttcgtaggatcctttccatgggttttcctcgctgctcaaattttttttttttttttttttttgagacggagtcttggtctgttgcccaggctgtagtgcaatggcatgatctcggctcactgcaacctctgcctcccaggtttaagcaattctcctgtatcagccttctgagtagctgggactacaggttcccgtcaccaggcccagctaatttttgtatttttagtagagacgggtttcaccatattggtcaggctggtcttgaactcctgacctcaggtgatcaaccggcctcggcttcccaaagtgctgggattacaggtgtgagccaccacgcccggcctctctgctcaaatcctgacttcctttttattcacaagttccaaagtcatttctgagcagatgaagtcttgtctgactctaaataactgattctctaacggcagtgttttcaaccttggctgtacattagaatcaactggggaagcttttcaaaattctgatgcccaggctacaccccagaacaattaaattaccatctctgggggcgagtactttttaaagcgctactctctgcaacccccacacacagatggttgattccattgtgtatccaaggttgaaaccatactactgaaacataattgacatagttattagtattcttagaaagcttagtctaagaaacctccaggtttttatgaaggggaaattaaaaaattaaaagacagcctttgcaaacttattttgtatgagtatttttttaaaacacatatcaaccctgtgttccagtctaactggccttttcattcttccatgctttcttcacctttgttcatgctatttgagaaatggccttcccccatttttgctttttataattccaccctaccacctttttgaagtttctcttcattctttcagccagagggaggttcttcccttcagaacttcgcttttttgctttagtatattctgtatggttttgcatttgtgttttatttctccagctagtttgcaaagcttcattcttatctatgtagtcccctcattgccaggcatctttatatcccttgtaatgccttgcatccagtaaatgttatgtaaatgtttgtttgaataaaaggaatttcagacgtcatgctgcagatgtgtgctatgatagaactagggagaaagcagatgtgtagtatcttttctattcccttcacacttttctagttactcaaattcttggtttggggatgccttttttttttttttttccgagatggagtcttgctcttgttgccgaggatgaagtgcaatggcatgatctcagctcaccgcaacctccgtctcttgggttcaagggatgctcctgcctcagtctcccgagtagctgggattacaggcgcctgccaccacagcctgctaatttttgtatttttagtagagacaggatttcaccatgttggccagggtggtctcaaactcctgacctcatgatccgctcaccttggcctcccaaagtgctgggattacaggcatgagccaccacgcccagccaaggatgatctttttatttatttaagtatgtgattttcatcccctgtgcaaccattaagtagtcttcaggaatcagattctggaaatgttagctctggtttggaatgcttatagtttacaacagagcatgcttgctaatgccagttatgaagcacctaccagggttattttctttcatggtttaaacagaactttgttgtagtcgtcactatttttcaatatttaagattaatttttagatttttgagaatgccattttatgtactactctctgttcattgagaagataaatcctctttccccaatcttaaagatgcaaaataatttttacagctcaacgacctgcaactttctaccactaaatgactataaaggagaatgtgcttagaacagacaaggcatttgatgattcaaggaagtgttttagatgcacagtaagaactagggaagaaacaactgtggaactgtagcaaaaagtagattttgctttttaaacagctccattagttgtgtttatgtgtgttttacattgcctatatgccacctattttcagcttgagttctttaatgtttttgtcaaggaagaccgacttcagagtgaattatatctatcagaatcctgagaaaaaaagcaagactaagaccatgtggagttattttcttgtcagctaggtaattcagttagtctgattctctaatgcgtaacatcctttttaaatgatctccaaataaatccacatttctccttagtagaattgactgtgaaagagatttgaagcactgcatgcttccccacttcctccttagatagttcagatattttcttttttaggaacattccaaactctaaaaatcacttttgttccacctataatttttgcagcttgaagttgcagctcaatactagtttggctcttactttttcagtggggcagcaggttttgtaaattaaaacacattaattgttttgttttttggcttttccttttccaacacctccccaccctttccgtccgccccccactataagtttccttttaaagaaaaaataaagcatattcgaaatattgccgcttggggatagagcgtcttagaatatgcaaactctttaaatcttgtttgggtttgtgcctgtgtaccccagtgcaaagattggatctgaaacatccctgagatgtcccagctccgtcttctttacaagttttctccaaactgatacaccatcactaccaccacttagttcccctagtacatatttctttgtaatctagaatttttttaggctttgggagacaagttgaatggcatgtatttccagcaacttggtagagcaatttacagattctatatgggcatctagtatttagctaaatgaactctacctctctctcctctctctcctttctctctttcagcttggcagtgaccttggcgggggcattggaggaagtccggcagtaagtgccatctgtttttttcaccatgagaagcactgccccctgtttgatgcctttcctatgtacacattatcagaccagccactgctgctgtctagcactgcacaccaaaacctctataacagtatatgggtagtagaaagtagtatagggttacttggaattgttggggtcatgcaccacatggtgtagagacatctttaaggtttaatgttccagtgcctatagagatctttgtctttctgatattaaagagctaaaggaaatggacccttccatcttgactggagaatgcttattccctggtgtcacctagaaagaacttgagagggtcagctggactcagagtgagactctcctcgtaaatgagttagtttcaggggtgtgaatgtccatctccctgaggagagcttcctactaggtatttatgcctaaatgggaaaggaaataagactttgctgaacccaggtggaaatggaactgctgtttaagttggatacttctccctctttctataaaaacaaactcctttcttagggtacccgtaggccttttgcacagaatcatggaagctaaaattggaaacaaatacaaaatcttggatcactgtgttcctgtatcctactgagtactctcttgataaagcttctaaagaatgtgtgttctcatcaatgacgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcagcagcaggagaaaaaaatgcagagaagtcatttctcttattcctctttccccattggtattacgtatggattctagaatgccactgctcagatgtggttttcatggattttagtgtacctttttagagttccaatttaggtttgtgtcactggggctcttcttgtcttgtcttaaccttacttgatgtcactcacattgaagttcaagaggggaaactcccggttaatgaagctcatttaagcccttgggaaaagcaccatccaggctaggccaggcttcatacagtcttacctttctgaggaccaatttggctgaattctctgctttctaatctgactccttatgggggatccctgctatagagatgtagaccagttgtccattccaggagttgtaactgtgataactgagtgtgtatagttattacagtacatagcaaaaccgaagatattcaaaattgagccatagtgttttggcacaactcggtagctttgttgtaaggtttactatatgggatattatcttcagacttttaattattagttatctaatgcactcatttactaacataaaagtattgtatacaaatgaccaacgtaaataatgtaaaaatgtaagaaggaaaattgtctccccctgcccccatttcccatgtatagccactgttaactttcttgtgtgtcctttcaaaagaaaaagatcatgcccatagctgtatatttgtatcctttgaacattccgtgtcagtgggatatactattttgcaccttggtttttctctaccatattcttttgaatccgtatatctactgaattgatacaccataatttatttaatcactcctctgttgatgaacatttaggttattccctggtcctccccaccacctgccactcttttagtatggctgagtacattatcatgattattcaccacccacagatcctttggtattctgtcttaggtggtcagaacagctcatgactcctgatttttttattttatttttttttagacggagtctcactctgtcgcccaggctggagtgcagtggcgtgatcttggctcactgcaagctctgcctcagcctccccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaataggcattcagattatatgagcaatatctgagtatttactatttaccacaaactatagcaagagttaaaaacgtatataagacatagtcgatgcctttaagggaattaccaataatggctttggttggaaatgatgaaaaaaaatcttcaaagattacagccatgctgttttcattagtagatgcagtttcttccctttaaaccattttaccaaaactaacagaaaaacacattatgctcattggaatttttcttttcctcttggtagcagtacttaaaagtagtaaaataaccaagctgaacagaaggtagagcagaagccagggtcgtttaaagactggttttttaaaattattattatttggttcttaaataattgagaacgatctcaaaattcagaaaataagactctatccggagtcttttgcactggcttgatatttatagtataaaaattactataattgcctaaggaagtgaatttgttcacttaattgttaatcttaatttgttttttatttgttaaaaaatgcatagcatcaagataaatcttgtctgattctattgagctttatactgtgtttcaggtctggctacctgcagtaaaggctaaaggcttggagatttccggaacatttactcaccgccaagggcacatctatatggaaatgaacttcaccaataaagctctgcagcacatgacagattttgcaatccagtttaacaaaaataggtaagcaatctgggtccctagcttgatgttgagacaacagtttgccttagaaccaacaagagaacattccatttagcactggttaaaaactcacatattgggccaggtacagtggctcatgcctataatcccagcatttgggaggccgagacgggctgattacctgaggtcaggggttcaaaagaccagtctggccaacatggtgaaaccccgtctctactgaaaatacaaaaatgagctgagcatggtggcaggtacctgtaatcccagctactcaggaggctgaagcaggcaaatcccttgaacctgggaggccaaggttgcagtgagccgagattacgccaatgcactccagtctgggcgacagagtgaaactccatctcaaaaagaaaaccaaacctcacacattggcagatgctgtatgtagagtgagccctggctcttgcaagccttttcagttatcagcttcaactctggaggcactagggagtttgttgggaaactcatccaaatgcgatgaagaaaccagaacttatttactatcttggattctaggattagaacgtttttgataaatttttaactgaaatccatttattcattcaacaaatcattgtttaacattagcatgagccagacatttctaggtactggggctagagtagtgaaccaaacaaagctcctgactgaaagttcacattttggtgggggaaattagcatatttggttggtataagaaatatggaagtatatatgctgaacaaataatcacataaaccttgacaacctccttttagcaatgaattctctgccttaataaggaagagagcatgaagaagtaaaatgttaatgtcttattctttttgaaacatcagtgggttttattcagttttatggttcaggaaaatggctgttagaccttaatggcatgtccattcatttgtaaatacaggatatttagccctgcatataaaaagtagtaattggacccttaaagcagatttcataaaatttgtcaatgacaatttgcataagtgactgtctgatttatttctcatcatttggaaacacttttgtactctggatttgagagcttggcatgttaaaaatcatttaactatctagaaagtctgtgtttctttctgtcaagactaccaatgtttccagccatttttgaggagctggccctgttaaaggccagggctgttgggaaaataaataaataggccaaggctattggtggaattctgttgtaataaaggaaatctgcagatgcagagtctgcattcatctctagcctttttttttttcctttttttttttttgtggggggatggagtcttgctctgttgcccaggctggagtgcagtagcacaatctcggcggctcactgcaacctcttttgttctgttccattgttttgtttttgtttttcttctttggggttttcaattattcatttattgactctttgtttatcttttatatactgtttttctctctaatcgttaaaaaaaatcatcaaattcttttatatcagcaaataaccaattagtgtcagattttcacagttgtctaatgtttttgtactgtttactttgtctgaacagggtcccaataaggtcccatacattgcaattggatgataagtgccttaagtccctttaaatctataggttcctcctcctcctctgttttgttccttaaaatttatctcctcctccttctctgttttgttccttaaaatttatctgtagaagaaattaagtcttttagtgtggagtttcccacagtctcaatcttgctgattctacctgtaaattggaggcagattatagatttaatcagatttaggctcatattctggcagaaagccttcataattggtggtgattgcaaatcctgtttctcttttagttatttatttttctttttctcattttattctctatgtttcttaccatgtttactatgatgtctgtttccttgttctttgtaagtcagtctttttgtcactataattgtaccttttctataattttttataaatgaaattacataatatggaatcttgtatctggtttctttctattagcataatgcttttgaaatgtgtatatcagcagttgatttcccttttgttgttaagtaatactccattgatgaatatacagtttgttgacgtgctcacaagttgggggagtttggttgttttcagtttcatctttatgataaagttgccatgaacatttgtgtatacatctttggttggacatatgtttttgattttccttggtaaataactaggaatgttattgctaggttatatggtaagcttgagaattccagatattccacatcctcaccaattttagccattcttgtcgctgtgtagtagtgtctcattttaatttgcatttccctaatgactactaattttaagcattttttaaaataagcatattggtcatatatatctttcacttaagtatcagctcaaatctttgccttttgttgtttttggggggagagagaggatcgtcttattatggagttgttaaagttctttgtatattctggatacaaatcctttattgcaaatattttttcccagtccatggcttgccttttcttaataatgttttcaaaaaaaaccaaaagggtgtttttgtttgtttttttgtttgaaacaaaggcttgctctgtcacccaggctggagtgcagtggcacaatcaaggcctactattgcctcaaattcctgggcttaagtgattctcccacctcagcctcctgagtagctgggactacacctgtgtaccaccacacccagctaatttttttatttgttgtagagatggggtcccactctgttgctccagttggtctcaatgtcctgggctcaagtagtcatcctgccttggcctaccaaggtatgggaaatacaggcatgagccactgcacccagtcgaaagttttcaataaagtcaggttcatcagttttttttcttcttatgacttaggctttttgtgttctaagaaatctttgcttaaccccatggttacaaagatttttttggcatgtttttaaatataagccttatagtttttgttcctacatttagttttataattcattttgagatcgtttttaaatatgttgtaaattaagagtcaatgtaaaaactttttccgtaataggtcttgaaatcagatggcctaagtcctgcaactttttttcttttcaaagcttgttttggctattcttggtcttttacatttccctgtaaattttagaatcagcttgtcagtttctacaaaaaaaatgctgagatttttattggaattgcagtgaataagtagatcaatttgagggagaattgacatctaaacaatattgagtcttctaatccattagcatagtatatctctctgtttaggtctttaatttctttttgcaatgttttataatttttttatgcacaaatcttaccttttgtcagatttaagtatttcaaatttttgatgttatagtaaatagttttttttttttttttgagacagagtttttcgcttgtcacccaggctggaatgcaatggtgtcatctctgcccactgtaacctccgtctcctgggttcaagcagttctccatcctcagcctcctgagtagctgggattagaggcacccgccaccatgcccagctaatttttgtgtatttagtagaggcagggtttcaccatgttggccaggctaatcttgaactcctgacctcaggtgatctgcctgcccttggcctcccaaagtgctgggattacaggtgtgagtcactgggcccagcagtaaatagtatttttaattttaattttttattattgctagtatatagaaatataattgatttttatatattgaacttgtttccttcaactttgttaaacttactttttctttctagtggcctttttgtaaattccttctagtttcctacataaataaatcatgtcatttatgaacagagacagttttatcttttcctattcaatcttatgccttttattttttcttcttgtctgattgtactaacaggacctccagtaaatgttggataggagtggtaagaaaagtgttctaattcatgggagaagcattcagtctttcatcattaagtgtgacgttagccataggtttttcgtggagcttgaggaagtttcattctgttcctggttttctgagttttattatgaatgggtattaaattttgccagatgcctcttctgcatttactaaaatgattatgtgaacttttttagtccattaatatgatggattacatcagttgacttttcaaatgttaaaccaaccttacattcctgggataaatcctacttgtttaggatgtgttgtctttttttgtgtattgatggagttcattggcagaaacttttttacatctatgttcatgatatatttactcttcatttctgatatgatttacttttttttattatttctttcctgagttagattggctccctttaccttttcctgttgtcttgccctcacctcacattatctggtcatcccttccccagatgttttcttttactgttgtgtggtcttccttggtagctagcattgttgtttgtttgtttgtttgttttgttttttcaagtatgttttgtttgtcattaaggaagttgtactgctgtctttccacttttttataatagggctttgaacagttgctgtgttttttaccattatgatacttatatttgaatgagttggaatttgcaggactagctattagtagacttctatagaaaaggaagctaggcgggtagttttttagactttgctcctcaagaacgtttccttcgttgctctggtgtagccacagcttcttagcctctctgaatctaacttgattctagagggctgatctttgccttcaagccctgtctttcaaggaagccctgtcttccaaggtgtttgttttctctttagaaggtggtgctttttgagctctttcatctccagggcccccttggtagaaagggacttgctaccttttttttttttttccagccttattcatatgctgctcctgtttgatcttggtctactctgggaatggggctgtcttctgagaatgaatatttgtggtcagtctctaagacctactactactggtttcctctgaactccttgtgcctgcctactgtatcaccagagcatctcaccagttctgtggactttctttgacagtagttttggagaaggtgaaattacagctttatagggactttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtcttaagatgtagtttatctaggaaaaggaaaatatttctttagccactctaactcttggaagagtatgtgtgtaaactcttttttttttttttttgagacagagtttcgctcttgttgcccaggctgcagtgcattggcatgatcttggctcactgcaacctccgcctcccgggttccaagtagctgggaattacagacgcccacgaccacgcccgactaatttttttttgtaatttttggtagagatggggtttcaccgtattggccaggctggtctcaaactcctgacctcaggtgatccaccagcctcggcctcccaaagtgctgggattacaggcgtgagccaccgcaccagcctgtataaactctttagttaattttataaacgtcgtagtcccatcttccatcatgtggctatttagaatataaattcaatataaatttgtatcattttgtttgttatcttctaggccaattttttctttctgcttcatctttataaaattttgttttcttcttttttttccacccgaaacagggtcttgctcttttgcccaggcatggtgcagttgaggctcactgcagcctcaacctcctgggctctcaacctcctggactcaagtgatcttaccacctcagcctcctgagtaacagggaccacaggaacacaccaccacactggccaatatttgtaatttttttccagagacagggtttctctatgttgcccaagctggtcttgaactgctgggctcaagtgatccactcgcctggcctgggtctcccaaagtgttgggattacaggcatgagccaccatgcccagtctatggttttggtttttttttttttgttttttttttttttttcagacagtcttgctctgtcgcccagcctggagtgcagtggcacaatcttggctcactgcaacttccgcctcccgggttcaaacaattctcctgcttcagcctcctgagtagctaggattacaggtgcctgttacctggctaatttttgttgtatttttagtagaaatgttgtttcaccatgttggccagcctggtctcgaactcctggccttaagtgatccgcccgctgcagcctcccaaagtgctgagactacaattgtgagccactgtttccagccccagcctataaaattttatccttatgcttctcagaccatctgtcctcccacatatgtatttgttttctatttaacttcagattcagactgagtttcccatctctttaccattcttatattattaaacaagttttcctggataaaactggtagctattcattgcctgcctgaagcttagaaagtggccatgtttggctctacaacttatcctaattgtttggaatttataagccagtcaatgccacttagactagctctttcccagtgattgtgtcctatgtaagtgaaaaaaaaaggaaagtgagaattaccagtaaataatcctctggacttatcagtcaggttatcaagcctgtaaaataatttattatacttctctttacagagtagaaattggttttcgtttttgtttttgtatttttaaagacagggtgtcgctctgtcatctaggctggactgcagtgatgcagtcacaattcactgcaacctctaatgcctgggatcaagcaagtgattctcctacctcagcctccagagtagctaggactacaggcgtgtgccaccatgcccagctaatttgttttcttttattactttttttttggtggggggtgggcagtaaagacacggtctcattatattaagtgaccctcctgcctcagcctcccaaagtgctgggattacaggcgtgaaccaccacacctggcctcagggtggaaattcttaattcttctttctcccaagaattatctaaggaaagatttattaaaaatgatattcatcaaacctgccctctagtgacgttttaaagagaaggaactttcagagttatagcactagcaaagcagttctgcacttaagaatattttctccttcctcaaattcatttaatggaaaacagaaaattatgatgtaaccagtgttatagcaaattggcattgagcaccttgattcctgctatcccttttatttaattgtattaaaaattttgtttcctcacctgtaatcccagcactttgggaggccaaggtgaccaaattgcttgagctcaggagttcgagaccagcctggccaacacggtgaaaccccatctctactaaaaatacaaaaattagcatggcatgatggtgcatgcctctagtcccagctacctgggggactcatgtgcgaggatcacttaaacctggaagttgagggctgtggtgagctgagctgaaatcatgccactttgctccagcctgggtgacagaatgagaccctatctccaaaaaaaaaaaaaagtttcctttaaatggagcaaaatgccattaaaacccaaagatatggcaaaatcctgcctctttttttttttttttttttttttttgagatggagtttcactcttattgaccaggctggagtgcaatggtgcgatctcggctcactacaacctccgcctcccgagttcaagcgattctcctgcctcagcctcccaagtagctgggattacaggcacccgccaccacgcccggctaatgttttgtatttttagtagagacagggtttcaccatgttggccaggctggttttgaactgctgacctcaggtgattcacccacctcagcctcccaaaatgctgggattacaggcatgagccaccatgcccagcctaaattctgcctcttgattaacctctgtgatttatgtatcctctcttctagctttggtgtcatccccagcactcctctggccatccatacaccactgatgccaaaccagagcattgatgtctccctgcctctcaataccttgggcccagtcatgaagatggaacctctgaataacctccaggtcagagatttacttcactcaggtggtacaagttaatatcttgacaattattattattattattatttttaaagacacagtcttactctgttgcccaggctggagtgtagtggtgcgatcttggctcactgcaacctctgcctcctgggttcaaatggtgctcctgcctcagcctcccaagtagctgggattacaggcacaagccaccacgcctggctaatttctgtatttttagtagagatggggtttcaccatgttggccaggctggtctcgaactcctgacctcgagtaatctgcccacatggacctcccaaagtgctggaattacaggcatgagccaccgcgcctcgcccaatttttcatttacatgtaaaaaagtccctctttcttccttaggtttgagttagtcatggaatcggatttgaaataaatctttgtggacgagagttttatgttttgttgttaagaaaaacaaaagtcatgcatgacatagatattcattcttttactcaacaaacacttagaaacttttttcttaacttcttatttgtaaaccttttttccttaagacttttatagcaaaatttgaatgtcattaatataagaagagatttatatggaggttatcattgaacattggaccacaggtagctaggctgtttggatttaaatgccccattagcacctatctatgataagtataacagcatcttagaagaattttatgtggtctacaagagcctctttatcttgaaaatgtcgaattttttagaatgcttgggtgtcagcttagagtttcattcagttttcacctacctcgaagtttcctttgaaatataaaccttctgggcttcaggcaacatgaaggcagagcagtaagctcataagtcagaactgtagcaaccctggaggttgctagcggttatggttttaatgttcacaagaacaggaagaaagccttgggccacccagaaatggggaactgtaatcgatccctgcataaagcagagaccctggaagggcagctccctcaaagaaaggagaactaggaaaatgttttcgccatctcccaaagatgataggaaatttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagagagagaaagatacactgtgaaggatagtcaaaagacattgcaaagaggaggactggtactgtccccacccccactaagagcttaagatagaacagtctgaatgagactatgaaatatatttaaaatgatgaaagaaaaatgtcagctttcctctttccagtcaagacaggtgggatcccattgtttaatctagaaatacctgtgtgagatactagtattgatggtgagacgtcaatagtaaaatatcttggaggtaaaactaaacattcttcagtcatttaaataccagcacagcaggcctgtttgccagttcactaactaccttgttgccacagtagttgactgcctttttttcagcaaagggaataatgatttagagggtagacgagtgagtcacaatgtaacttggctcagacaagaagaataaagcaaggattactatgcagatggaattggctgttactatgatgacagtaatgtgttaaggggcttttccagcacaggatcctgaagaaacttaacccaaatctacatctgttcccttttcattgaaatctaacctcccattggccacagagcctcaagcctaatatttgaggacagtcagcatgcacgcaagaatgctttacctcataagtaggaaagagaatttgggtcacagaaaccagggcaaattttctgctcttaaaatgaaaagaaaaaaaagaaaagaaacagtaaacaaattaatgaatgtcagtttactttcctgttggcatttccatttgactaactcctgaacaggaaccctcacaagagaagttgaatcttagtccaaccctttcctcaaaagtattgatgtgatattagaactagcaagttttaattttcataaacctgatattataagaagcaaactttaaatttttccatctatagttaactactgatttttcaagtttcccacatggattctcttcttttggggatgtcataattgtggctattttctcattaattggcatttcccaatggatatgataaacaaaacttgaaaagagaaaaactttttccccctgtgagcagctctacttagtgtatgctggtgagagttggaactaatgtaatggctagcttagggatgtgtagggtactttagatttcagcttccattctgcccttttccccgtatgaacaagaagaaaatcaaaacatcattccaacaaggttaaactatatatacatccagataaagccaggtaaagattgatctagcttttaaatatatttgtataatgtttagattcaagagctcatgtgggaaaattagtatttttctagtactacagaccataaaattgggaaaaaaaaatgttggggattgaggaaatgaaattttgaattccatgtggattttagctattttggctaatttaatatcaatgtgtagaacaattaaatcaagcccagctgccagaactgtagtataaaacttattataaaaacttttcatcagaacactcattaaactacttattggcttatagactatttgaaacactatttaaaaatttaaaagataccattcattctttttttcttctttgagatggagtttcattcttgtcacccaggctcgagtgcaatggtgcaatcttggctcactgcaacctccgcctcccaggttcaagcgattctccagccttagcctctgagtagctgggattacaggcacctgccaccacacccagctaatttttgtatttttagtagagacggggtttcaccaatgttagccacgctggtttcgaactcctgacctcaggtgatccacctgcctctgcctcccaaagtgctgggattacaggcgtgagctgccatgccctgcctattcattcttaaaatgtaaaatacattatgccttaaatatgggaattaaatacctagtagagatttgaacctggaagaatttttctactatactgacatcgactgtaaaagcttttgtgaatcagcttataaacattatacaaagtaaagttaagcttgctcctactgggagcctttcttgagtttatttatatcacgtaattatattccttaaaaagagaattgattctctctgtttaaatacagcagaaaccttaataagtgtctaaatgtgtttcctctaaatgagttttctctgactcttgatgtccttgtttctcatttcgtgtgttagttgtgcttagaaacattttcccagtgaacttcttcaaacttggactgctttttcaagtcagtgtctgcaaggagacagtggaattatgatttaacgtgttcatctccagggtaatgctcatggtctttatgtagatgctgcagggttcccacagctgcttggcctcctttttccagggccataaactcttttgagaacattgatagcatcattctttcaagttttcaggatgataaaagcacagtttaaagagccaactaattctacaattatttaagaaaaactggccgggcatggtggctcacgcctgtaatcccagcactttgggaggctgaggtgggcggatcacgaggtcaggagatcgagaccatcctggctaacacggtgaaaccccgtctctactaaaaatgcaaaaaaaattagtcaggcatggtggcaggtgcctgtagtcccagctaattgggaggctgaggcaggagaatggcgtgagaatggcgtgaacccgggaggcggagcttgcagtgagctgagatcgcgccactgcactccagcctgggtgacagagcgagactccgtctcaaaaagaaaagaaaagaaaaacccagtcctgagacttttctccctaacaagacctccaatatctcctcccacaaagccaatttcgttcacctcttttgataattacctaaataacatgctcatattgggactcctggatttttatttatttattttttttgagatagggtctcactctgtcacccaggctgatggtgcagtcatgagacactgcagccttcacctcctgggctcaagcaatcctcccacctcagcctcccgaatagctgggaccacaggagcacaccactacacccagctaatttatattttttaaaattttttgtagagacggggtctctccatgttgcctaggctggtctcaaattcctgcggtcaagcaatcctcccaccttgacctcccaaagcactgggattacaggtgcgagccaccacacccagctggatttttctgttttagatattcctgtacatgtccccactcactgccatcatctacatacttttcatgttcccattttttctgacagaactatcttaaaatttacttaaatcagtgttcaatgtttacatcaatttttttttttaagagataaaatcttgctcagtcacccgggctgaagtgcagtagtataatcatggctcattgcagcctcaaactcctaggctcaagcgatcctgctaccttaggagaatctcaagtagctgggactacaggtgtgtgtcaccacgcctagctaattttttatttttatgtagagatggggtctcactgtgttgcccaggctggtctgaaattcctgggctcaagtgatcctcctgcctcagcttcctaaagtgctggaattacaggtatgagcctccacaccctgcccagtgtttacattattatgactgcatatattctttgaagctgagccatatattaaagtgatttttcctcaataaaactttttgtagataattggagttaatacccatttatgttggtgtttttaactgtaattcaatcccaaattccattgagatcagacccttcaaagtatactattggtttccctttcttaaagtctcttctagactgatttacttgaatgcctggaacatagctgtcttcctgggacctcctttcatcttaaccctggagattcattcccttcatcagctctctcctactcaggatctcctgttatagtgtccttttcttggtttactccctcttttgatgaaacacattttccagtggtttcctgagaataggtatgtagactattccataggtttgagcctttacatgtttttaaatgtctgttttagtctgtcttcatactaggttaggaatcattttcctcctaatcagaagccgttctgattcttgatacttgctttagccctgtttttttctcagtgaaagcttgtactttgtccccagtgttttaaatttcagtgatgtgcctcattgtgactctgtcttttcacccatcatgctgggtactcattgggttctttaaaaccggaaactcatgtccttcaattttaggaatttgtctttaacttctttgctgctgctctccccttcattttctctatttcttatcagacgtcttgctatttggatgttgattctcctggactgactctgttttcccctcctattttccatccctttttccttttgctctactttttaaaaccttgtttatgggaacaggcacagtggctcacacgtgtaactccagcactttgggaggccaaggagggcggatcacttaaggccaggagtccaagaccagcctggccaacttgacgaaaccctatctctactaaaaatacaaaaattagccaggcatggtggcacacgcctatagtcccagctaatcaggaagctgaagtaggagaattgcttgagccagggaggcagaggttgcagtgagttgagattacgccactgcactccagcctgcgtgacagaacgagccacaagcctttatctcaaaaagaaaagaaaaacacttttttatgaaacatttttaacattgcagaagtaaacagaatagtataacgagcccctgtgtacccatcatccagcttcaataattatccatggttaatatcatttatacccctttccataaccctactctattgtttgaaacaaatcccagacatttatatcacttaatctgtaagtattttagtatgtctcgtattttgtttgtttgagatggagtctcgctgtgccgcccaggctggagtgcagtggtgcaatctcagctcactgcaacctctgcctcccgggttcaagtgattctcttgcctcggcctcccgagtagctgggattacaggcacgtgccaccatacctagctaatttttgtatttttagtagagacggggtttcaccatgttggccaggctggtctcggattcctgaccttgggtgatccgcccttgtgggattacaggtatgagctaccacccccagctcagtatgtgtctttaaaataggtctcttttaaaaaatttaactacaataactattctcacaacttaaaaaattagcaagaattccttaatatcacatatcgaatcaatgttcagattttgtcataattttttttgttttattatttgtgtttgaatcagtaaagtgcacatattatggtgggttgatagctcttaagtctctttagctacactgtttaatatgatagccactagccacatgtggctatgtacattgaaattaaatcaaacaaattcagtttcatcattgcatcagccacatttcaagtacatgtgtggctaatggttactagatgggacagtgcagaagtaaaacatttacattactttagaaagttctgttggcagtgccaatctgtaggctcctcttccatatttcttttacctttggttttcagcagtttggctattatgcatgtagttgtttttcttgtatttctctggcttggagctcactgagcttggatctgcaagttgatagttttccccaattttggaaatgttttgtcattcttcagattttttttctgcctcattatgtctcttctctccttctagaactccagttacatatgtgttagactactggatatcatccctcagatcactgaggctgctttttttaaatttaatctttttttctctccgttcttcagactggataattcctattgatctgtcttcatgtacactgcttctttcttctataggcaacaaccttctgttaaactaatccagagcattttcatttcagatattgtactttttaattctaggatttccatttgattttttgctgaattttcctcactgggctggctcaattctttccaaagttatctttaagtctctgtctacgatagaaaggctttctgcaagccttgtggggagctaaattgggaaagagggctggagagtcttagcattcagtatgcattaattcatttaattcaccacccctcagccatgtctggcttttacttctaagtgccatctattttatcctctctaaaagaatcaatcttcagttttgtgcagggcctagagacctaagagctgtccagcagtatagaatcggggttggtatctagaaatcctattgacatcttaatcctctcgtttttaacactctcctcctctccccaccatacagttccagaggtgctaccagtcctaagcctttgagaattctgtggtggtattgctaatccatctgttttccaggtaccaagtttttgttgctgttatatctttttgttagtatctctatgaatttataccttgaaaattttttattttcccttagttatggcagaactttttccaggagaaaggaaacttaaatgtgatttttcagtctactgcctctgcctagaggtctgatagcaccttaacattttttctttccttcctgcgatacaactttataattaggaaccttagaggtgaacctgtggagaaagaattgaccctttcccatatatagtttttgttgtccctgtctttattgcctttaaatctcacataaacattgtcgaataagaggctgaatattaattagagaaaagaaatagacacaatgtctcttttttttttctttgaatatctttctaaaacaaggcaatattcatcagtctgttcatgtaacctttgattagggcagaaagtgctgaagacactagctgcaaaggacacgatcttacagtcctgtttattcatgtcttaagatcattgtcagccaaattttgctggtatatggctctgaggaaattctgtcccttgctactcctacatgtagttccagcctgtgagacagtcagttgcagatggtgcttgtccctgatatttcatgtcttgcatatgtccgttcacactcagaaagcccacagctatagctattgtaccagaaaaactggtagacgcttccaagcggaagaccttttcagcgctcccatcaaatgaagcaaaccagcttggcatttgctgacgtttcttgactgttgtgcaagccaaaccagtcagtgttgaagccttctttggtcttccaagatccacaattgaggactgcacactctgattgcatttgtgggaccacgatgctccttgaatagataatgagtccttgaagtggtggatctttcggaaactatatagcgattcccacgtcagacagttggatccagcgttggatctactatccaaatgatccctgtagacctaaaaatattccacctaaaatattccataagcagtatgtaggtactggagtcttcattatgaaagattaaaacattttgctgtcaaaaaataaaatagaaaattacttactgtgattgctacttccagtttgacatattcttcatgtcccatcaggactataaacatattatttaatctcatctgagaaattcaatatattatgtattagatattccttttttgctagattgtccttagtgagaacactcctttatctttttttatcaagataatcgagagtctactaagcagtatcttttgtctttctgtaaccagcactcaactactggtttctgggatcttttagcagtatatctattaataataactgtcttctttgaatggccacacataagcaatcggcaagagttccatattctgataagcaaaggtgtctgatggatcagaaatctgtcctcaaagtcaggagacagttaaacacccaaacttgggtcacattacccaagtaatagaaatctatgctgatatcctgagaaaggataatgaatttcacacagtagttctaaaatagtaataaaagtgatttgtgggcttttatttgttaaattcacaggcatctttttatcatgattataagctaggagttaatgatggataatggcattagttttatgtttctaatttaataaatgattagaaatagatttaaccttgtggtctttagatttagcttgtagtgcagtagaggactttgaattctggacgtaaaatagctacctctttctcgtcccagctgataaaaacctatattataggttgaaattacagagaactcactcagttttttcctcagctggattgaatttgagagccataccctgctctcattcatgtttactctcttatattttgctatagcatgatgtttaatgagatggggaagaaagtacattattcatactttttaatgaaggggttatgcataggctttgtagtattaaggcccatacatatttgaataaaactgcaggaaagctttgagccatgtgaccatgtacacataaggaatgtaaaatctcatagttggaagggatggtctttaattttgtctgtttcaaaccctatctgtttttgatggaattccctctttcttggcagtgatgggaaaatcagtgtgtacatgaataccaccagtgatttgctactctaaatgacccattctgtcttcataaaaccctgttacggagttgtttatttggcgtttttttatgtttgttttctttggcgcggggcggtggggggaggggcggtaaattggagtctcactctgttgttgcccaggctggagtacaatggtgtgatctcagctcactacaacctctgcctctcaggttcaagtgatcctcctccctcagcctcctaagtagctgggattgcaggtgcctgccaccacgctcagctaattttttggatttttagtagagatgaggttttttcaccatgttggccaggatggtctcaaactcttgacctcaagtaatccgcccacctcgacctcccagagtgctggaattacaggcgttagccaccacacctagttgtttatatgaaataaaatgtcttcctttaggttctatctgtagatcctagttctacattttgagatttttataaattaagtttctgaatcaaggcacccagggcctgaaagtcaatcaggtgggcctgtaatgaaaacatactccgtctgaatttattttcttttttttttctacttaaggaaagcctaagtttatggaaaggcatttatataatgtcagttttattgttctaattttagaagaaaatccatttagaaggagggaccctggtaaatgtagttggaatcagttatagtttggagactgaaggaaaatattatctaatcacttttgaaaagtgtgtgaatgaaagatgatccttgacttggtagcagtcttcctttccaggaacccctgaaggagttgaagggcaagtactcagaacaggaaagcacagaacttctcgattccatagctcccactgtgctcctgacagtaatatgtatatgtatatgaccttcttccccagtggaactacccagagacagcatctgtgttcagtggcctgcccatctgtccagtcatcttgacagtcacgtgtcctccttttgtccacgtaaggttgtactgtccaccaggcagaacataggcataacagtgaactcatttgatttttatcttgcagctaactaatctgaggatgtatgcttaatatctagaacctagatttgattctagatcagttttacccctggattgaaaaatcagttatgttcattgacaccaattactgcctattattactgaagtttgttcttttattgaatttctactaggtcttctatgacatattaaattagagtggaattttaatcactttaactgatagttttctagtcttgccttcacgattttttgattcaatacagtatgtattaaatgcttttgtttgttttttttcagtcagggtcttgctcaacttcccacgttggagttcaggggcacaaacatagctcactgcatcctcaacctcctggactcaagtgatcttcccaccttagcctcccaagtagctgggaatacaggtacatgccatcacacctagctgacttttttttttttttaattttttaattttttgtagagttgaggtctggctatgtttcccaggctggtcttgaagtcctgggctcaagccatccacctgccttggcctcccaaagtgctgggattacaggcatgagccaccgcacccagcctaaatgtatttttaaagtttaacagtaaacccaggctgagcgccatggctcacacctgtaatcccagaactttgggaggttgaggcagttggatcacttgaggtcaggagttcgagaccagcctggccaacatggcaaaactctgtctctgtctctacaaaaatacaaaaaagttagctgggcatggtggcacacgcctgtaattccagctactcaggaggctgagacagaagaatcgcttgaacccaggaggcggaggttgcagtgagccgagattgtgctgttgcactccagcctggggaacagagcaagacttcatctcaaaaacaaaaacaaaacaaaacaaaaacccagtaagccctacatagcaaataatagctcaagttgtgcctctgcccccctcttcccacccctcactattaacataaacaatattcgaagatgagacagcagcaaccaagggcacatcagccagtacatgtagctgtgtagctatcattaaagggaaaaagaaagactggtccctttcggcttatctgtcaggcaggctgaaaggcctgtgaaattattgctgactgtttctggcaactggaactatatagagtaattctattgtaggctgctagaagaggagaggattaggggccagtaagatttctgaagagtaactgggttgatcaatatagtatcacaggtgggttatacattggcagaaagcagtcacatatacatttgctgtaagttctggatttattttatttaacttataaaactttcaaaatgagggagctacccaggagtaggaacagatgcagtgtatcttagcatgattttcccttgatcctgggttccctgtgaggcacacagctgccagtgacataggtatgtcactggcatacctatgtcagtgactttcacatactggtgaaagttgcttaattcttgctataccactggcctgttccattcaagtaaccctcaggtaagttacctgttatactcagatatctaacttatagcaaatgtatatgtgactgctttctgccagtgtataacctccctgtgatactattctgaccaatcttttttattggcccctaatcctctccacttctagcagcctacaacagaattactctatatagtttcagttgccagaaacagccagcaataatttcacaggcctttcagcttgcctgagagataagccgaaaggcaccagtctttccttttccctttaatgatagctacacagctacatgtactggctgatatgcccttggttgccgttgtctcatctttgaatactatttatgttaatagtgggggtggggtggggctgaaggacaacttgagctatttgccaagtagggtttactgttaaactcaggtaaccatgagtataactggccagtgctatagcaagaattaagcaactttcatctgcccactcggaagagcttgcattaacagtttctaagcagaaaaggcaaaatcctaccaaaggtctccaagaccttgggtgatctagctatgcctttccctccctcctttcctcattaacttcatctgctactcctcctcttcactatagccattctggtctcctcacttatcttagaatagggtatgctgccacctcatgaccttttaattgactattgtccttgtctggaatgtgccttctcctagtctccatatcgtatagcttacttacttactttaggtttttactaaagtagtacccaaaaaaagagaatagaatgatagttaccaaaggatgggaggtgaggggaatgaagagaagtaggttaatggatacaaacatacagttaggtagaaggaataagttctttttttttttttttttttaagtctcactctgttgcccaggctggagtcaatggtgccatcttggctcactgcaaccttcgcctcccaggttcagcctcccgagtagctgattacgggtgcccgccaccacacccggctaatttttttatttttattggagacaggagtttcgtcatgttggccaggctggtctcgaacaactaacctcaagtgatctgcccacctcagctttccaaagtgctgggattacaggcctgagccaccgcacgcctggctaaatagtacctttttaataaaagattttctcacttcactcccagtactaccagtctcccttatttttaccccatagcatttcattatattttaattactacttaattatttattaccacctcctgctcctctcctactagaatgcaaattccaaaggaacagcagtttttgtctatgtttttcccaccactgctatgtctcccagggcctggaacgatgtctggcacacagtaggtgctagataaatatttgttgttgaatgagtctttttgctttcatttaggaaagtattaaccagcatcagattcatctagttcttgaaccaaactaagcaaggctatctcttcatcttaacaaacagagtatccctaaacacagcctctgcctgttgtttctcagcagccttgcgttctatcctctgactctgatacaatacccttttatctggataggtctggtcctggtcccaagtttaatctgaagactacaatcacaaattcattttctctcaagtaggcagagcaaatattagaagctgttgcttccttgatattaggaaaggcaagatcacagcacattaatggaccctgttttcaaaactggagatgactaggaacatagcacatgttaactgtgctcacattttgggaattttttctgttgctaacttacgtctgtatgtctctttaaaataaaaccaaattgccaccatgagactattaaattattatcctaaagagccttagactattttggttaatttaatatttctagagtaaatttggaagctcaaaatcagagtaaatgaggaagttcaaggatgctcttacaagtgttttggagcctcagggaaaaccgaaatcatttagatgcccgacaggaaatggtgctgagcaagccctttttactgtgaaaacagaagaaccctgtctttttcctaatcctgatagacacaaaagtgtaaggaggcaaactttaaaagcaagtgcctgctgggcacggtggctcacgcctgtaatcccagcactttgggaggctgaggcggcagatcacttgaggtcaggagttcaagaccagcctggccaacatggcgaaaccccatctctaccaaaaatacaaaaattagccgggtgtagtggcatgcgcctgtagtcccagctactcgggaggctgaggcaggaaaatcacaaactcaggaggcagaggctgcagtgagctgagatcccaccactgcactccagcctgggtgacagagcaagactccgtctcaaaagctagggcaaaaaagttgtcttttagcaatagatattcattatttctctttacttttaagaaaacaattttttcaggtattcaaaacagtcttttgcctttaaatggaaaaaaaagtttttaaaaaagggtagtcatctagcacttttcaatatcaggtttttctttacttgctattagaaagtttactttggtgggaaatcggtgtgataaggagtgaaaagactgagacacataaactgaaattcaactttggaaatgaatttttttcactcagtgagacttaaaaaatgaaccacccagctgcactggattttgtgttggaactttgagggtgtttttttttgttttgttttgttttttggagacagcattctcacactgtctcccaggcaggagtgcagtggcgtgatcacagcttactgcagccttgacctcccagactcaagcaattgtctcacctcaacctgaccagtagttgggactgtaggtgtgcaccaccatgcctggctaattttttatttttatttttgtaaagatgaaatctcaccatgttgcccaggctggtctgaaactcctgggctcaagcagtcttctgccttggcctcccaaattgctgggatcacagacaggtgtgagccatgcctggcctccacagtttagatggctgcagtgatggctatgggtgggctactttttctatcctccacaaaggtagtctttcatgaaaattgtgacctactcaccctttttccaaatggctttacaggggcagggtgggggattctcttttaaagaagtacttgagaatctatttcagttgcaaaatagttaacaaaatttgatttgagtagttctgaccttgctgtgctttggactcccatttgacagccctgaaggttcgtcattctaatttactcctgcccaaatggtgattttgacagtttaatccaaagtcttttaaagcaatgtctattcataccactttacaatctttatctaatctttagtgttctgaagatttaatttgctgacatttctaatttatggtctaaattatttgagagttttttgagattgagattaagcagatctcatagcagaatgggtactacaggagaagtcatagtatttcagtttcagtgtcttttggtttctgttggcttcctttcgaatcaaggctttactaagagagattggctcttaggagctcattgcctttttaaagcccaataattatatgtgctactagaggatttacaattttagagatcatctggagggctctgttcaaagctttcatttctggttctgagaactgtttaaatatggaaacttcaaacgctgaagtgcatattagggacatggaaccactgcctaatctgtcaaattttccctataaagggttccactgttcacatactcttaacgaacaatgtcctaatgtctcctgagaataaatcagtatggctttatactcaggatgaacagcagtttggtaccatttgaggcctcctcagctatcatgtaatacccctgatctattgggtggactgagaaagaatatgggaagagagttcttgtttgaatcctagccttggaagtgaactaaagacgctgtccagtttaaaatggaattagcactggaaggaaagtcaattgacatttcctgtggttcattactctttctgctatgtttttaactctatcagatactgtctaatatcataaatagacctttctgttttgtcagggtctctgagaattcccagataattcattggtcaatagagtttgaaatgctatttaaactttgggtcaccaagcacagtggctcatgcctgtgtaatcccagcactttgggaggtcaaggtgggaggatcgcttggggtccaggagtttgagactagcctgggcaacatagtaagactagtatgtctagtctattccagtatgtagactagtgtctacaaaaataacagagttagccaagcatggtggcacatgcgtgtagtttcagctactcacgaggctgagatgggaggatcacttgagcccaggaggtcaaggctgcagtgagctgtgattatgcctccacactccagcctgggtgacagagcaagaccctgtatcaaaaaagaaattaaaataaataaaataaacttaagatggtagataccttttggcgttgattagaaatgcagaactacatgttaatttaactccagcacctagcagaaacggccgcttctgcttgagtctcagatgatatatatcacatagttggagtaagtaccattaaaaacctgtcactccgagccattcccctaggatctgttgactaggttgtgtggtacttaaaacacatctgaatcatcattcctcagagaactggagatggttgacgtcactgcctggtcctagcttggaccagcctgcatataatcattccaaaagctaaaaggagaagagaaataaaagaaaaaaataattcttcagaaatgtggaaaggtcacaagtgacgttatggaagagcagatgatataatctcaaaggcgagccctgtactatttcacttggttttccttgtggcagtgcctcctttggttacctgtggtgagaggtcgggtaagaggcctcatttgccagagttcagactgagttcatgttatacctttttatagtacttttgagtatactggtacaaggttagaatattaatttagcctgttcatctccagctgtcccaccataaagagattgtagctcctgcagcaggctttctatactatggaaagaaactaattgctggttacaggcttaagctgacaggttgttctttccttagcagcctcttaaagtaactttaaacaatcattgttattattaagcatttatagcctgcttttgtgttttcaaagtgccttataatttctgtttgctttcctattgatgtccctaaaaagcaagttaatattgttatggtcacatgttgcacatgacataccaaagaaacagagggttaggtaatcttcttggtaccatctgtgatctgctttgggcattctcaaagcagaagctgaggtgtgcattctcttccttcactcattgaacccattttctcactgcttgctttagtgtgtgtgtattgtggcttttatacttttttgactgcaacttacagtaagaaatgtattttacatagtgtatacacacacaatatgtaaaactgaacagtttcaggaaatattacttactcttcatgagatgcactgtgatatttttcattttatttttttaatgccagtttgaacccacttagttaattttaagaactaccggttggtcatgacccaccaagctagggatacttgaagctaaaggatacacaatagcacattttcctagagcatcagttttattgaaaggtaaagagagaaacacatattaaaacatatatgggtacattatgggatttagcatggaacttcaaagatattttgttcttatgatagtctacttcatattatacccctaatcttgacccagccccatgcctccttcacagtatgtgtccattctttcctcttctattacgggaaatacactagaaaaatgtgagaagtactgtgcttttgggacttgtttgttcgtttgtgagacaggatctcactctgttgcccaggctggagtacagtggtgcagtcatagttcactgtaaccttgaactcctggacccctatcctcctatcctcttatcctcgtgcttcagcctcctgagtaactgggaccaaaggctcatgccactgcagtcagctttttttgttttgttttgatagagacaaggtctcacttaggttgcccaagcttgtctcgaactcctggccttaagtgatcctccttccgcctttggtctcccatagtgctgggattacaggagtgagccactgtaccaagccccatagaacttttaagttcattattgtgtaaacccaagtgaggtcagaaactttgtatagtttattttacaactgttattcttactcagcacctattctgtgccagtcactattctagaaactgagaatattgtgacaaatagaagacaggaattctttccctcatggaatttatattctaccacaagtggggtatgtggcatggggacaggcaataaaccggcaaatcagtacaatacatagtatatcagatggtagggaggacagtggaaaaatataaaagaagtattgggacagtggaaaaatataaactggagttggaggttgggtggtacagttttacaaaaatatgttggtcatggaagacctatctgaaaagataatatttggttaaagcaaagactcaaaggagacagggaaagaatcatggatttctggaggaagagcattgtagacagaagaaacagcaaatgcaaaaagccatgaagtaggagtgtacctgctatgtgcaaggaaggaacaacaggctcctgcagctggattagagctagcaaggaggagagtattagcacgacctcagagaggttggaggagttggattataggcaattgcaacttggtttttattctgagtgagatggaaaggtttgagcagagaaatatttatgagctgacctacattttaagatcactctggctgctatgttgagcatatactggggaagctaggtgctgtgaagggaatgtatagggggatgtggctggaagactagtggagaggcagagagactgttaaaggctttgcagaatcccatagtagttaccgagtttggaaagacagcaggaggttgtatttggaggtggggaggggagattaagagtttggttttaccacaatgagatactatctcacaccagttggaatggctattattaaaaaaatttttgaaaataacagatgctggtgaggttgtagagaaaaacacaacacttatacactattgaagagcatgtaaattaattcaacccttgtggaagacagtggtgattcctcaaagacctaaaaatgggccgggcgcggtggctcacgcctgtaatcccagcactttgggaggccgaggcaggtggatcatgaggtcaggagatcgagaccatcctggccaacacggtgaaaccccatctctactaaaaatacaaaaaattagccgggcgtggtggccagcgcctgtagtcccagctaggctgaggcaggagaatggcgtgaacctgggaggcggagcttgcagtgagccgagattgcgccactgcactccagcctgggtgacagagccagactccatctcaaaaaaaaaaaaaaaaaagacctaaaaatggaaataccactcgactcagcaatcccattactggatatatacccaaaagaatacaagtcattctatcataaagacacatgcacacctatgttcattgcagcactattcacaatagcaaagacatggcatcaacctaaatgcccatcagtgatagactggataaataaaatgtggtacatgtataccgtggaatactatgcacccataaaaaagaatgagatcatgtcctttgcaggagcatagatggagctggaggctattatccttagcaaactaacacaggaacataaaaccaaataccacatgttctgacttgtaagtgggagctaaacgatgagaacacatggacacaaagaggggaatagcacacactggggtctgctagagggtggagggtgggagaagggagaggatcaggaaaaataactaatgggtactaggcttaatagctgggtgataaaataagctgtacagcaaatctgatgacacaagtttacctatgtaacaagcctgcacatgtacccctgaacttgaaataaaagttcagttttagacatattctttttgagcaacctattatccaagtgaagatattaagtaggcagttggttatatatgtgatcattgatttccctcaagcaatctaggcatgatgttatagcttttggaaaatagtttagaacttgtctggattatatcttcctactatctctacctgttgggatagtgaatttttaaataagaaaacaagaaactgtctttctcttttcctgtctccctccaacaacaatatcatgctctttaaagctgatttagttatatttaagagcaatcagcatcaggattggaattaaactggcttcatactgtgtttttcccttggttcttttttaacacccaaaatatgattggcatatccttggaggacctagcattctttgggttgtgatccactacctgtgttgtcctttcttagcatgtagatattatttaactcagtgatttgaaaccaaaagaacccatacatcatcccatccccccattcctgcctcattgagaatcagtgtgcctaatcagagatgttgctgatgggattctgttatgtatatgaatgatatggaggtagaaaaaatgttgagaaacacagtgtttcatttttatttgttcaacatcttccacttattttcatgcaacaaatattttttgaggtagtcaatatgctagcgaagatgagagacagaccctccactcaaggagctcattgtattataggtgagccggaagtaagccattattatatgctatcatagaattgtatgcgttgggtgctgtggggaggtgttagagctttctgggaagtgttaatcttgaactgaaccttaaggttaaataggtattttccagacagtgctaagcttaaggagaagaaaatattaagcagaaagaacaacatataggctgggtgcggtggctcacgcctgtaattccagccctttgggaggctgaggtgggcagatcacgaggtcaggaattcgagaccagcctgaccaacatggtgaaaccccgtctctactaaaaatacaaaaattaggtggacgtggtggcacacgcctgtaatcccagctactcaggaggctgaggcaggagaatcgcttgaacccggggggcggaggttgcagtgagccgagatcgcgccattgcactccagcttgggtgacagagccagactctgtctcaaaaaaagaaaaaagaaagaacaacatataaaaaaggtacaaagctgtgactttcagtgtttggggaataagaagtaattttgatgtggttgaagttaaggaaataggctggagaggtagtctggagtcagatctggggaagcctatgttactgaaatgaacccagttctagcctagagtgaaaatatgagagctgcaaaatacagattttgaaaagctaatgtaaaagagatgaactgcttcccccaatgaatgacctgtgtagttgatcctataaagagatgacaatttaccaaggcagtagcaaaaggaatcattaagctaacaatctgccgataagccttttaaaaagtctcttctaatctcttttttaacataatagtagtactacatctgagcatatgtaagatttcagataagtctaatgtggttatccttaattaggatgctgagtaaaaaaggtaaaacaggagatggtgaaagcagagtgaaattttttttttttatttgagatggagccttgctctgttgcccaggctggagtgcagtggtgcaatctcagctcactgcagcctctgcctcctgggttcaactgattctcccacttcagcctcctgagtagctgggactacaggtgcatgccaccacgcccagctaatttttgcatttttagtagagatggaattttgccttgttggccaggctggtctcaaactcctcacctcaggtaatccgcctgcctcagcttcccaaggctcacatggtggctcacgcctgctgggattacaggcgtgagccactgtgcccagccgaatttttcttttttgaacagacactttctacagtacttatgagtcaaggctgttcactgtgctgtgcaaatattaactcattatcctcataacaaccccatgaatttagtactttgtgatctacattttacagacaggaaactgtcagagtcagaatttgaaatcaggtgttctggctcccaagtccatgctgtgaacctctgtatctgccgcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttagataacaatgttctaaattaattgcttatccggttgatcttcctgggaactttttcccaaatatttatgccaggtcccagattcagagattgtaattatttcatgtagggtagggcctggcatctgttttgaaaagcctttccagatgattctgatacaggtcttcagttaagaaccactaatattatcctctagagaatggggatactactttatagtcaaagataatcacttgcatttcacatgagacctttacatgacccaccattagcctacccccatcaccccagttttcacttttttttttttgaggcagttcactcttgtcacccaggccagagtgcaatggcacaatctcggctcactgcaacctctgcctcccgggttcaagtgattctcctgcctcagcctcccaagtagctgggattacaggtgcccgccaccacacccaactaatatatatatatttttttgtatttttagtagagatggggtttcaccatctggccaggctggtctcgaactcctgacctcaggtgatctgcctgcctcagcttcccaaagtgctgggcttacaggcatgagccaccacacccggccccagttttcacttctaaatgttctttacagagcctagcgctgtctcaagatcttcttggtgcccttatttgaaataagaattctcctcccttacctgccaagtaccagatgagttagaaaatactctttcccggaagcccacggctggcatcaatctttgaaagtagtgctctggtacatcccttgttgttgttgttgttgttgttttgttttttgttgttgagacggagtcttgctctgtcaccaggctggagtgcagtgacacgatttcggctcactgcagccttgcctcccaggttcaagcgattcttctgcctcagcctcctgagtagctgggactccaggcatgtgccaccacacctggctaattttttgtattttagtagagacagggtttcaccatgttggccaggatggtctcggtctcctgacctcgtgatctgcctgccttggcctcccaaagtgctgggattacaggcgtgagccaccgtgcccggcttcccccctttttttttttttttgacagagtcttgctttgtcacccaggctggagtgcggtggcgctatctcagctcactgcagcctccacctcccaagttcaagctattctcccacctcagcctcctgagtagctgggactacagccacgcgcctccacgcccagctaatttttgtatttttggtagagacggggtttcttcacgttggctaggctgatcttgaactcctgacctcaagtggtctgcctgcctcatcctcccaaagtgctgggattacaggcgtgagccactgcacccacccatgctctagtacatcctaaagaatgcctttagttcctctttcctgacattactctgcttaaattccccagattcaagctttttgagaatcctatctcagcattttgggcatcaggccatgttatatataggtcacaaactcctagccttgttagttgacaggttaaaagcaaggagaataattggatggacacttctgggagagagaacgcaaatattatggagaagggaatacaggcaccatttaaagtaaggaaggtaagttgatactaaatgtagaaggactggaagtactttagaaagaggatatttggatctcatagccacagttttaagaggtcagtatgctgttgaagtgtagacatttgccataaaagacagagagtgagaatagtgtactagataagcactttttaactctgtttttagagcaaaatgagaaagaaacaggtatagttactgatcatagaacttgctcagataaatgttttcctacagcgctaagagcatagataggaaagtcattagtgacagaaaccagtgggaggtggtgacttagagcaagtctcctcctactccctcttcttacagtataagggccttatgatgtgctgctgtgcaatctgcctgttcctgaatgtatataccaatcagtgttgccctgaataaaagtacttactgtagctttaaaaaaaaaaaacaaacaaacaggatgctctgaattaagcaggctatggtagaatcatagtcgagaagtttgtattgtgagaagaaaatttatttatttgctcgcttaaaggttttttgttcttatagtcatcaggtttaccagtgttgggccaaacaagctttttccaaccataagacctgggaaataaggttttataaaagaaacaactttaaaactgatatttaaaaaaataaaaaataagagatagtatggcactagttattgtggggagaaataaaaatcaaggtttagcgtcaagtttctgtttgaatcgtaattcttctgtgtactagctacatgactctggatgttacttagtctttctaaacctgagtttcattatctgcgaaatgagaggggaatgatatctactttgtttgagatcattatagtgtgagttagaaataatatcattaataggtaacttagtaagtggtagcagctactattaataatcatagagaaaaaaatcacagactagattattcctggtatacaagttgtgccttgaagacaggccttctggaaggaggtagagttgcaggttgtcacagttctatgacaatggagtaagtaagggtgtgctttgcagtatatgggccagtttgtttgatttggggagacctgcactgagagaaagaggaaggaaatagggaggcctatttctagacacagcgctgttcttttcctcctacctggctccctgcgatgtcctcatttgaccttgttgctttcctggcaggtggctgtgaaaaacaatatcgatgtcttctacttcagctgcctcatcccactcaatgtgctttttgtagaagatggcaaaatgggtaagtaccttcctgcctgtcctgctgaatatacctttgcccttcctgtgcatgtcaggcagagcatagccccagaagttttgagttattttgaggttaaaaaaaaatgggttaaggatattctaaagctcttaataattgctcattatttattctcctgtgtcacaattgttcttgctctgccattggtctctaaatcacagtgcccaatatctgaataatccagtcaccccaggatacagaataagaggtttggggaccaggtaaatatggatttgaatctcagctctgctatttatttgctgtgtgactggtcaaggtgataaactttttggaacttccgcttccaaatttgcagtgtaaataatttttataattatttcatgagataatacatgtaaatttagcactttactctgtactaagttcatactgcctcaagctaagaattcagtaatttgtaataaaccgtcagaactcccgatgtgcctattgacatttctctcttcccttatttatgaatcacaatctaataaaactggcttatattggtgcatattaaactatgttggcacttaattgatttgattcttacaatagctcttggagtaggcaggacagatgtaattatagataaagaaattaaggctcagaaaggtcataagtcaccaaaataggaaaacaagggagccaaaatgaaaccctagatatagactcttttccaattatcctagtgttactgatgacggattaattgatctgaagtatagcacttttgtagagctcagcattggctccattcccagcctgctgctagctgtattgcaagagccagcatgccaaaggaaaaatgatgcaaggcatcgaaaatcagaatactgacagcttatgcacatccatccttcccctctgctttcccatacagagcgccaggtcttccttgcaacatggaaggatattcccaatgaaaatgaacttcagtttcagattaaggaatgtcatttaaatgctggtgagtaatatactctaaatttcagtttcatcttagtaaatcaaattagatatttgaaattttaatctttcttttgcctacccttttatcctcccccgtatctactatgtttctagtgggtatatatggtagatgcattactttgcaaacctctgtttaaaaacgtgatatgttttgatgtaggtactagattacttacaagctaacatttaagaaacaagctagaatcgacccatctacccatttcttcactaaagatgtgttagttctgttacttaaacatcctaataatcaaaaactgaagtggcacttgagaacatgcactcccttagtaattgaaaggaccattttcttcttttatatcaatttttggtgttggaggaaggttaactttctttcttagattctgtacttagaaccctgtgtttataatgaaataatgtatcatcattagtgaaagcctcgttgggccaagtatggtggctcataccagtaatcccagcactttggaaggccaagatggcaggatctcttgagtccagttcaagaccagcctggacaacatagtgagaccccatctctataaaagaaaaaaaagcctagttggtaaccttttactacactgccctgtgccacctttcatatgatgatactaacctctttaatcaccattaaagagctccgtactctttcatagttaactttgttactgtaaaagaacatgaaaggggtatcccaagaagagaaacaatagcagctattagtcccttgggctgtgtttctctgaaggatttctcaggaatgaaaggagccctaagttatttagagtcctgcctttgtttcactgttgctctctctttctctttagagctctttctttctctccttttgaagttagtactaggctttgtgagtttgaatgaaagtgagccttggtgcttggtcggtacctcctctttcctcatttacccctcatttactcctgcatacattggtggttctcataagggatttccagcacattgccatcctcccattgcagctggagcatagcactggggaaaggaggcaacacggcagcacagaaagcaaaaaaaaaaaaaaacacacacacacacaaaataatgccttctcattccagcttcccccaccccactccccggcccaagatggagtctcgctccattgcccaggctggagtgcagtggcacaatctcggctcactgcaagctccgcctcccgggttcatgccattctcctgcctcagcctccagagtagctgggactacaggcgccagccaccacacccggctaatttttttgtatttttttaatagagacggggtttcaccctgttagccaggatgttcttgatctcctgaccttgtgatccgcccgcctcggcctcccaaagtgctgggattacaggcatgagccactgcacccagcccagctttttaattttagttttttatggctctatgtaatattcatcttctgtgttcagatgaatcttatagggcttttgaaatccaacatcatagtgatcagctttatcctgtgatacctcttttaaatgtgatgctcctataggccctctctgagacattcaggagactgaagccctcctggaaccctcagaataaaagacattcagacaggcatctttgcatatagaaacttcaggcagatgtttgcctctgataattgtttcacgtctctggagctcttggagaggtgtttgaagcatggtcttctgtaatttccatcataataattaattgtttcaattaattcagtaataattgatttttttcattttgtgtcatatttgaagaagatgacagtgtcatctttccctcactttgaggctcactggtggatcctattagaggagccacctctgtacccagctaggaagagaccaggcccctggttatattcacctttgtgggagttggttcaatggcaacatttcaaatagaatgttcctcagaacacttttcccttatgaaaaagggttttgggccgggcacagtggctcatgcctgtaatcccagcactttgggaggccgaggtgggcagatcacgaggtcaggagatcgagaccatcctggctaacatggtgaaaccctgtctctactaaaaatacaaaaaattagccaggcgtggtggcgggcacctgtggtctcagctactcgggaggctgaggcaggagaatcagcttggatccaggaggcggagcttgcagtgagccaagatcgcaccactgcactccagcctgggtgacagagcgagactccgtctcaaaaaaaaaataaaaataaaaataaaacaaagaaaaaaagcgttttgttatccatgaaagttgaaaaatacagcatatgctaggcttcacctggaaattgccattgcacgttagcagactaaaagttctgagaagtgctatactgaagaaacctatttaactcagtgttaactgaacttatttggccttggaatttaaaatcacaaaatacttattagtaacatcatgtggaccaccagtattccttgaacatgatctggaaaacactctccgagagagaacagagatagaccagagtgattggaaagcaggttttgtttcagacatgttcagtatgaaagggacatggttgttcaaaaaagaaaatagaagttggggtgactgaggactttggtctgtcaaaataacagagaagaaaaaatcctcctgcttttagactggagttttgaactcttattgcacctcggcatgtttttgtgatcttatcaaagaggaagtgtctggcatttctcctagtggggctgtgccctttgatgtcgtttctcagagcaaattcagttttgatcaattctgtcatggcctcacgccaatcgctccatgctgtaggtgctccaaataccaatgaatcagattccagtgatacactgctctgtggccatgccgcacatgaaacataggggaaaacagtcattgcattttctccaggagtccaaggccaacattttcccacattaaatcactgctagtcttgcaagaccacttcctgcaactaatcctttccagctcttcctttgagtccacccccaggtctggagtgccctggcctttagatttccttccagtctcgagggctctattaacatgaacgtttttggctttagtgccttctgattcaacaccctgggtctagctgagagctaaaaataccatcctttccagctgatctgccctaatcacaatagcaccaacactttaaatagcttttctgtgctagcatagacatttgacagatggaactaacactctgagggctacaggaagtcacaggcttaaaggacttaaccaacttagcactgagctttactttgctctttcatgtctttctagagaataaagaaagagaccctcttcccaagtcttaataattaatcagatcttaagagaaaagtgtatggtgggagtgcttatgatgccgctaattgtgttaagtactagaaaatgttagatcagaaagctgctaacagaagtctctcctttctagcaccgatcatttctgtggatgttgggagatctgtatgaatctgttttacatcttaccattacagctgcatttggggttaataggtatctgggactactgtcttaagtgcacaagaagtagttgcatctccagccatatctggaaaggaatctttgtgacgaacagttctacaaaccagttttttaaattaagtgtttataatattaagaaaagctcagagacttaatgtatctattttcattagttaggtactgtaatgagagacaaatatttgttccagcatgggggctaggtaagggtgaattctgtttcattgttttgttgcggctctccccatcctttggaatatttcaaaaatggaaacactcttccagctagcacctaactatcatttggttgcttaaatggtaaaaagcattcttttcagcagtcatagtggttttgaacttgctaataaataccacagcagggccccagatgtaaattcccccattcccactctctaatatgagtacctgcttcacccttgttgctgtcagaggatgtgtgaccttagctaaagtagaaagataaaagaaggaagatcacatcgacaccttctaagagttgaggccccagattcaaaatgccaaatttatggaaggatacaaatgaaccataagaaatcttatattggctgggctcagtggctcacacctgtaatcccacactttgggagcctgaggcaggaggataatgtgagcctgggaggtcgagactgcagtgagccatgatcacgccactgcactccagtctgggcaacaaagaaagactctgtcgagagagagagagaaagcaaggaaggaaaaagaaaagaaatcatatcttgaacgaagggtaactatatttgaccatctttttttattctatgctttgggataaatctcagtgtcttatgcctcagatgatatcatcagcacacagtgaaacaatattacattacattctcattatcaaactctcacaactataagattccgtcctgtttcccagaaggtcaaaatgtgttttaaaaaattaaaaactatgatatcttgtcaagaattctatcccagtcagaccaggaagcctccttatatctggcttcccttgccattcatcatacatttagcagaatctcatcattctgcaatccgtaaatcttcaaactcaaacctaataactaaaatgtataaaaatcgaatcacacatactaatgttatggaaccctctctctagtcttctgataaaaatcacagtacagtcattcattaggaacagagtcaggttgctggccagaatgcttccaaatgtattaaagttacatccattcaacttgcttattcttcctggctgtttggcatgttttctaattctagaagagtgagaataagagagagagagacagagagagtttcttagcctgtcatctcttacataggtggtgaaataattgagaatatttcatgattatttctgtaggaatctggcccttgccacatgtatatgctagaatgtatttgtgcctatgcaacaaggtgggtgttcaacaaaggctcctactttgtgtgtttttgggtttcctgggaaatgggcaagggcctagaaagttaggaatgatttttacaacttaaagcaagcccctctgtgttcaagacaatcctgtcaaaaggcattagccaaaccctagctgatgatgttgcctagcaacccactcaaagctgcaagagcccttcattgtgggaagcagggtggcaaccagaactgcctcatcccccacaaggtgattaaaagggcatattgaggccccttcttccagcaatattgcatagatgtaccctgagatacattttttgactcctcaaatagagccatttcttaactactctgcttggtgtcagtgaagacattggaaataaaaggggaaaagctaagtaataactaagtgtggtaaaaatgtctcatgaaaggagtcttagtgcctcctctcctgagctgtcagtggtttgaatgtgcgagaaagacatcagggtgagagctacctgcaaaactagttcacgtctatgtctatggtattatgtaaatattggcatctccaacacctatcagagcagatattgatgaaaggtacctgttgtattgcagataacgtgggaaacacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaacagtcaacaaagaagcagtgcttgtcatctctattcttaaagtttctctttctctgatacagcaacatctcataaagagagaaataacctttaattctggaacgttatgtcctttttgaaactgtagtcatgaggaagagccaaaacaccaacccattcttaccctgagttggtgactatgaaaacttctgtcatagtttctgtcatagctgggatcttaggatctagcagcagtcacctttgcacagcttcagtctttctcaaaatctgtggttgagacagtttgtttcgttattattttcgaggcatagtattccctaaaggcttaagaaatcatttctgcctgctttgaaaaaaaaaaaatcttaaacatctaggttaataaatttgatttgcagttgacttctgtagctctgggcccttcctgatcctggcagttgaggcccgaatggctcacaatgaagtagtagtgacttgggaagtagcactatggatgtggtcatcagtctgtgtgtccccattgatctggaaccagcatccagaaacagataccaacatgacagtcactatggcatacccacacacttatttctgtctttgtcctcttcagagtcttctttacctgtctagcacctaatttgagattgccagctccttaggcccaccaatatcataatctccaaaggtaactcgcactaaaccataggtgtaccttattctgttttcagtcctggaatgtgataggcagacaagtcatgaacctgttcttcactttttgctattgtgtgggagaatggcttctgaagtgtacacatgtccatgtgacagtacttgtcagggaactgaacacacatggctcataaggatgtgagaagagagtgtacatttgtttgagattttaactgaaggtgttggattttgaatctgtatttctagacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacggtaaggcctttctcagaatgggtgagatggattagaggagggaggtgagagccctttcatgtttacttagcaccctagaaagacctggaggaggtgctttaaacctgagatatacaaaataagtagtcaatgaagaagcttccatttgcctcaatggaagacctcctctctgcagtgtctgccccatccaacaggaatggtatctctggcaagtgcctcaaatccatccctcccccctggtgtatacagagttgctcacaaaacttggcagcttcatcctcaatatcagttaatacatatctagtgtatctgtgcatgtggtactataataagctgccgagaggattgtttacatagttaatgtccagaagacctttcttgctgttggagttcatgacctaaggctatcagagtcattaacacatgagcttttttcagcagcattgtatgacctgaaatgcttgttattaaaggtgaggcaaaatggaacacacctttggaagcgtataaggggactttagtttgggaaatttccttcagtatcacactgaactaaagtaaaacttctggcaataataaggcagaagcagttgctttgttaaacagcagattgatagccaagcactaggcatttgtttgctgttgtaaaatgcaatttcccaataggatgtcatctgcattttgaaaagtaaaggaaaaacccttgggatgggagaaatatcttattcctctgttatgtttgagggttttatggggatctatttatttctgaggaagctgaatagtcagtagcttaagggagccttttagtcatttagctgagaaaactctgtgacccgttccttaattttgacagctaagtctgttttcactagcatatatcaagggaatagtaccatccagaactgaaaattcttggtgtttttcccactagttcccatccttgtagtaagttggagtagctgtgtgtgtgtgtgtgtgtgtgtgtgtgtgtgtgtgtgtgtgtgtgctcgctcctgaggcctatcaagttagacttttgcccaagcacttatgagctgaaaaacttcaggcttccctcataaaatgtatgctcctctccccaaccccccaccagtctcatctcttttggagagtaacatacactgtcatttatcttgagtttcccaagaaaggaaaacccctctgtgctgtttctggagggacaagttttactataaaaccaagatagcacatgcctgtaatcccagctactggagaggctgaggcaggaggatcacttgagcccatgagttcaagaccagcctgggtaacatagtgagaccttgtctcaattggaagaaaaaaagggttggggggagaataactccatttactctctagaaatttgccaaaagtttatatatgggtgtgtgtggttttttttttttcctttttttctttttgcttactgtccattattttattgtatatagtcttccatctcagctaggttaaaggagcatgattactcccaggttgcagataagtaaaccatggctaagaatgattagtgactagttcaagatcatgtaatttgttggtaggtgaattttgtttagaattcaggtgtttcttgacactcttcttacacaatattcttgattttgagaagagcttcttagtatcactgtcctaaacatagtttgttaaaattttaaaaagtattttattttgaaataaagacttaacaaattttttaaatggaacagtagagtttctacatctcttttacccagttttccccattaataataacatcttacacacccatactacattttcaaaactaagaaataggtattagtacaatataataaactaaactatagacattattctaatttcaccagtttttacattacttttgggggtgggggattggtagtggatagtactatgaactcttattacatgtatcaatttgataactgctgccagagtccagacacagacttgttctgtcaccacaaaaaaaaaaaacttcctcttgctgtccctttatggtcagactctcaccccagccctaaccccggcagcctttctccattactataattgtgtcatttttagaatgttgtataaattacacatgtaacatgtaacctcttaagattgttttttgcacacataatactcataacattcttccaagttgttacatgtatccatagcttgttcttttttatggccaagtaatagttcactgtgtccatgtaccacagtttctccattcatcctttgaagaatattttctcctttatatttaaacaaaagtttggaagtaattgtaaattcatatgtagttgtgagaaattatacagtgacctggtgtggtggctcatgcctgtaatgccaacactttggaaggctgtaatgggaggatcgcttgaggacaggagttcaagaccagcctggtcaacatagtgggaccccatctttattaaaacatattttttttaaagaaatacagtgagctcttcctgtaagtgacctgagatgatctctgctcagttggcctagaaaacccccaaaatcatacaaagcaagagattcaaatcttcatgtttactttaagaacacccgtggaagtgcccaggccatcaaaggtatgcatatccaaatagccaccaagtacttgaaagatgtcactttatagaagcaatgtgtgtcattccatattattatagtggagttggtatgtgtacctaagccaaacagacgggctgggcacaggatgacaggtggcccaaaaagagtgctaaatttgtgctgtacatgcttaaaaaggcaaagagtaatgccgaccctaagggtttagatgcagattctctggtcattgagcatgtccaggtgaacaaagccccaggatatgttgctgtatttatagagctcaggtcacattaacccatacataaactcccctgccacatattgaaatgatccttactgaaaaagagtaaattgttcctaaaccagaagagagggttgcagggaagaaaaagatatcccagaagaaattgaagaaaacaaaaatttataacctgggaataaattcagcatggaataaatgcaaataaaagttaaaaaaaatagattctgtcctcgtggtttagccacatccaccttcctttgtcccatatatttttattttatttatatatatatatatatatatatatatatttttttttttttttttttttttttttaatatagagatagggtctcgctatgttgtgcaggctatctcaaactcctggccttgagcgatcctcccatctcggcctcccaaagtggtgggattgcaggcgtgagccactgcacctggcccacccgccccctgccccatatttttaaatggtgaatttgtttatacttccttgccctctttcctattcttcatcctgtctggtgactaggttctctgcccacaataccatctaaatctcccatcatagcacttgacaaataggtctaatttgttcccctaagtggcacccttttagtcattagactaaaagaagaggtggtggtagaggggtatcagaggtatctgatttgcctatctaaagaggcagactctaaagtcattctgatccattcccttcatcaccttaagttcctattatactattaatctgatctgagctaagtattaagaaagaaatcgggttgagccagcactaatgcatgacagactgatggtcccttagtctcctaagaggggttaataaaacacttctccccaaaccccagtttttattgtattttattaagaagataggtttatcctataagggtgaggctatatctctgtaagtaggtaatcctcacctgaaagataacttgtcccacgtgaagcagtgtatgttccacaccatatgccaaaagtggatgcatagccccttaattttaattaggcaggacagggtgactcttctgcccttggtgtgtctagtttggactggattcctgaatggctgatgttaaagacatgtcacataaggaattagcagttggaaagttaagccccaaggaaggcctctttctccctaggagccatacaaaatgagagccagagtcctagctatatgtaataaacttgacactttgtcagaggctggggtggaggtaggggtggggaggtgtggatattaagagtccagacacagggaaagtttcttccccatcctccaaagaccagcggtaatgcccagggcctagggtctggtcagtccatgacttcccaccaatgccagccttggcagtttgagccattgttgaggaaggcaacatttccttactagttgtaaacataaaaatgaacctccagctggaggaacttcaagtattgttacaaagatgtggaaaaatacaagatagtattttgggggagtatttggggactacctctccttagtctgggagttaactctcttaagctgttgtttctctttttagattcctcttctcttccatttctgaatccacatattctcccactagaattttccacaacactggcagtagagaaggctgtagagaaggaggtacaagaattgctttaggtccagcgcagtggctcatgcctgtaatcccagcattttgggaggccgaggtgggtggatcacctgaggtcaagagttcgagaccagcctggccaacatggcaaaaccccttctctactaaaaagacaaaaaaaaatagctgggtatggtggcacgcatctgtaatcctagctactcgcgaggctcaggcaggagaattgcttgaacctgggaggtggaggttgcagtgtactgagatcacgccactgcactccagcctgggtgacagagcaagactctgtctcaaaaaaagaattgcttcaatagggagtttgaaagtcagggaaatgcctaaagatgcaacttggaccaaaatagggagctgttttctatatataaggaatagctatattcttaagttagttgttttggttttttttacatttatcagaattgtcttcctgactaataccaagcagcagttttgggaatgccttggggactgaatattaaagctgtaaatcaatagaatatcttcccatgttcttttgtttggtttggggtttttttgcattttaaattttactttaactttttaggttgttagtttttaggaaattcaccgttgaccaaaatcttcttgaccttttattcaaagatagtctcacttttgcactatgttaaattgtccttagtctctaataagagaataaagaggtaaaatagtctaaaatctcacggtgctacatcattcaagacaatttttgttgacctgccctaattaacaagaggaatgatgtcagcaatataaaatatatagctattaaattttctggttctagagtgcgttttgcatgcttatattattgttaataatattctgcctaatctaatacaattaagattctaaatctgggtttaaattttgtccttactgactcacaaagtgaaattctcaatattcaccattaagatctttttaatattgatgtctaatttggtattcattagactaaaagaagaggtggtggtagaggggtatcagaggtatctgatttgcctgtctaaagaggcagaaaataaaagattaagctgttgatgtgaattgaggttgggttatactaagtaagtgtcttttcatgttcttgtcttccctcttaggggtgtatactctcctcattataatacagaaaggactaataccttggacctacctagtttatggttttatttcacttgattgtacatcctcctgaagttgggactgagatatagccatcctcttgtcagactgagaaactgaggcaggcagctgaaaggaccatcaacaagttaagggctttggcccttcccttttcatttaataataatccctataactcttagaaaagcattagagcagctgttgctctgcagtcagtggctttgatgtttttagtatggattatttcctaatcttatagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacac

SEQ ID NO: 35611 - DNA, 51648 bp, Homo sapiens
gcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataaggtgagcccgggaccgggagacgcgtctttgcaatcccccgcagtgctccgaatccagggaggagagaagggccgggtctttgccgccttatccccgcgatcccaggagaatggagggagggcgagcgggcggtgtcatggggtgtggggacacatcccagtctgaaaaccaggagatctggggcgaggcgggaagtccacgcgtagcgggcagccgctgctggagaggggtgggctctgtgtcccggggttgggaggacgggagaggagcagggaagtcaggcgccggggtgtgttgggggaaggttaggggtgcagtcccgccccctacggcctggagagtgagaagagacggccgctccctctccgctctgcgccgagcgccaagtaggcggaagcgcggggcgctggtggagggggcgggggggcggggcagaggctggggggccctgcaaaaccgtccgctccggcgggggtggcctggcttcctggcctggcggggcgggggctatcagcctgcgagtgtgtggcatctgatgcggggggttttgggtaaggacccgggctctgccgcaagagccccgtttttgaacgacctgcacccccttggattcagtcgttaaaggactcgcagacctcctccacagcttcccaacccccacctccaattaaaagccaactcccggtgctgggccgtccagcctgagccgggtggggttgggtggcagagtagggtgggtggagggtgcttagctgagatctcctgaaattgtgctcagagccaggagaccgtgtggaagaacaaagagctaacttttcaaagcaggtttctccaatggagggtggggttggctgagttctggggaagccgaggaaagggggaggtattggggggaggggagggtggccttgtggagattcagtgtcccctgggggccctgtctccccaatgctggacttgttcatctggttgccattagacttttggaggggggttggagagtagaactgggtgtttcccgtacagtttagggtaggatcctgttctcttgtaagctccgtaagatcctaaggtaaaacctgcccctctgcatcccctccccagtctggaggggaggcctctgtgattttgtgcccttcctcaccgcgtctttcatccaccacccaaagctggctccaagtccaagtattctgtcctttccatctgaactgggagggctgggaggactggatggaagagaggtgcaagggtgggaacactagatgaaagaggggtatagagccctggggccaagttcattactgacctggagccaggttttgttcaggagaggatagtttattggacaccttatctctcccctcccccttggtgtgtgagcttcctcagtgacctttggcctctgagtcagcgtgaggaggtggggttggaggttctgaaagatatttgaacttgctcttggggagtgtgggcatatggggccgctgctgtgtcactgttcctcctggtcctgggcttgactgggcaggaggagaggagggggtatattgtgggcacgaggaaagttgttgatctccccatgaccatgccagccgctgttgggcaggacttgagcttagagctatcagataatgaagtctccccttgagaatgtacctgtccttgcacactggggtttcgcccgcccctcgtggcagagattttggcctctgcatcttgagttccctgtggtccccttcttctccacagtcatgaattgggaagaggcagtgggcacttgacccgtataaggaaaaagcaaaacatgaaggcaggattgccactccaggagttgggaaactgggtccttgttccaggtctgctcccaccagttttatgaatgtctctaggcctcagtattcaccatctgtcagatgggtatgatgatgtcatttccttaaaggtggggcagtgcactaaagtccctgagtgctaaagagggtgctgtatagactatgccctccctacctctctgggatgctctgttcagctccacaccactccccttggaaagaccttcagtgccgtgtacccgaggggaggggagcagggatgggcagggtgccctccccagttctcttaccctagctggaagaggacgttcaagtgggggttgcccagggaagtgggagttggtgattccttcctctttttagaactctccctataggaagtggccctggagagacctcgccccctgtactgagcaggagacctgaaatatccaggtatcagacctattcctctccacctgctccaggcagtaaggataggaccaggaatggggagccagtgcctggaggatgctgggctgtgaccagggaggaggggaaaccttcagtcccataggcagcttcagtcccatagttgctaaccaacttcccaaggcctcccatttacagcaaaagagtcaaattagactcacccgtttctctacaatcccccatggtactcagcccactacgtggcccaaagcacagggtgtgtccttggtttcagccttttctcctccctgagccttatctcccaaaggcataggtgggtaaaaaccttgtcacctctgaaggccaccctgcccccaacctgcagtacccagcatgctttgcaagctggataaatatgtattgctgatgacagtgtttgaggaaggaggtcgagatttgcttctccagaggacttctgggattagagctgggggagaaacagggtgacctcatttgctcattcaacaaatatttattgagcacctactttgtgcacctgctttgtatctagggagctgtgttgtcaagaacctcgccacgtccctctttcctggcttgcttccccaggtttctgaaaacaggtggaggtagaggattggtctgctgccagttcccctggaatcccctgttagggtgggctctctgcctctgcttgtctcagcgctccctccccactcgagggggttgaagtcctcacagctgtggtgccccgttttgctagctgaagcttagagtaccccaccatcatcttgtgaccatcccttcataatagctactagttatcacgatatgctgggctcagtcttcacagcagcctcacaaagtaggtgtattcgctcttgtaaacgatgcactccataaatggaggctcaggtagcccatgtggctcatctccctctcttagagctgaaattcacatccacagttctttctgctcagctcttctgccagtgtgtttgcagaaagtacttttatttatacatatttatattttatttacatctcatttgtgccaaaagtaggtcccatcccttcctgaccctatctggaggaatgctctgggcctggggtcttgtatgggggcgtggggccactgggaataatcctgtcctcctcggaatttgtggaggtgcagcaaagatctatgcctttaagccagcgggtcaggtggccaaccaagctaggctggtgccccggccagggtggggctggcattgcctctgcaggagggagaaactgtaaccctgggcaacaggaagggaagagatggtctcataatccatccctgagtcatggccaccccaggtagcctgggttcagaggccaaggtgccaggctgcaggcacagtgacacgaagcttgccacatcccccccaacccagagccacagagggacaggctgtcccaagtgaggggtatccttgcaggcttctgcccctaccagcctgtttacctttctttagagtgggttgcaggtaggcaagggaagatcaagatgaccctgccttggagcctcggatccaggctgagaggcctctaacaggcagcagaggtagggtctgtctggtttctgtgaacagggaagccatggactttgcaggcagcaggaaggggcagaggtgcatgcctcgaggtgcagtttccttgagtcctgaggcccaggaatgcttcgctgaaatcatcttgcctggggcctttaaaagaggggggctcttgctctgggacagagcccatggggcagggcagaggcagacggggtcactgtggggtcctctggacatatttccctgacagtgtccttccccagaccccattgagacaaggcaggagttctttcatcttagggtccaggcttggctcacagcggttgtggagggactggccattttctgcctcccctccccacaattttcctaccccaaaaaggacacagtggaaggagctggtgggttttcttgaaccttggggccttcctccagagagggtaggggagtcgcctgaagctgctggaggtgccaagcattaggggtggaacggcctcctctcctgaccttccagcactctgggagacagtggctgcagctccacttgacacttgtgcttcatagtaactggtttccatgtttctgctcagagccccctgcagggggacaggcgaccaccctcctctgccccacccttgggtgtctggatgagagtgtggggcctgtgagggaggtgggaaggagctactgatagaaataggtgccatcccctagaagaggggctctgcttcctccgcgtggcagcctggaggggtctttggaaccactgggtccagtgttggccctgtgccccctgcctgctcagtacaccccaccctccttctccaaggggcttggctccgggtgcaggcctggccatctggagtaggggtctctctccctttgtctccccaacgtcaatcaggaggcagccttggaggtccgtggtcctaggacagtgtgtagcccttcgtgtgtgtgtgtgtgtgtgtgtgtgtgtgtgtgagaaagtgggtcatggtctggattctggagaatgtttttcctggcaggcccctgtgggggtagggggaggcaggggcccaggcaggggcctaggcaggggcctgtgcagctaagtaggcagaggccagcagactgggtggtgaccaggctggggcaccctgccaatgcctcccagttactcggggagggagtggggctgtcacttcaggggcctgtgggggcagggaccagcctgtcttagtgtccctggtgggttctgtgtgttggggtatgcaccacttcaggggcctgtgggggcagggaccagtctgtcttagtgtcccggtgggttctgtctattgggttatgcaccagaaggagtctttaagttgcctcataggagtttgggggccctgggtcactgggataggcccaggttggggagggggccaagcttagacccgccacttctttgcttccagacttccggctggccgtcctccccaagagtggttctcctagcattctgtttaatattccaccattaggtttttcctttgggtcttcttgatagggaaccagtaccctattagaaggtgatttccccctgaaattaccctgggggtctctggttgaagtgggccatggtagggaggttgaatcccagattctcagccttctttctgctatcccctcctcccagtgtctcagaagcacctctccctccgggggtttggagacaacattttgaaaagcatcgccttgggggaattccttgacaaatggccaagaaccagctctgtggctgggctccttcaaaagtccccctgggcctgcctcctggcctccttcttttggaatggggaatgtctcccttgactactgggaaatggggcagggacaggccagccaggtcactcaggtggcctggattattctggggtcctggcagtggacccctgtttggtggtgatccagcacatcatcctgggcttctgggggtgaatttagatcctgttgtcatgggtttgcctaagcatcaatacttctcaggggttccacaaagacccctccaggctgccacgtggagcctgttagatcgtttctcttttttttttttttttttttgagacagagtcttgctctgtcacccaggctggagtgcagtggcacaatcttggctcactgcaacctccacctcctgggtttaagtgattcttttgcctcagcctcccaagtagctggaattacaggcatgcgccaccatacccggcctatttatttatttatttatttatttatttatttttgagattaagtctcgctctataccccaggctggagtgcagtggcatgatctcagctcaccgcaatctctgcctcctgggttcaagcgattctcctgcctcagcctcccgagtagctgggattacaggcacgccgtcactgcacccggctaatttttttgtatttttagtagatacggggtttcaccatgttggccaggctggtcttgaactcccaacctccagtaatccgcctgccacagcctcccgaagtgctcggattataggcgtgagccaccgctcccggctagatctgttctctttctgtcatcactctcttccctccgtcggccaccctggatgggccctgtgtcccacattctcttttttttttttgagacggagtcttgctctgtcacccagactggagtgcagtggcctgggttcacgccattctcctgcctcagcctcccaagtagctgggactacaggcacccgccaccacgcctggctaatttttttgtctttttagtagagatggggtttcaccatgttagccaggatggtctcgatctcttgacctcatgatccgcccgcctcggcctcccaaagtgcgggattacaggcgtgagccaccgtgcccggccgtgtcccacattctcacacgcatgaatggattggagctgtggttggcacagtgaagcccctctgcaccccaacacacacaatctccagtgtgagccctgaccccctcggctaaggttcacacctgctgtgcccagcacctgacatctgagtgctcagaggtgccaagtgctgtgctgagggctttgaaggtgatttctcctcagtcctggacaatcccaggagggccaggtgttattacatccattgtacacaccaggaagtgggctcctctgaggtgcagggccccgcccaaggccatacagttagtggggtagagctttgatgtccactataggggtgtccaccttcaaggctttgaagtagagcccttcagtgcctcagtgggagacccgctgccgggtgctctcctgccctcctcctggggtgggagaggatgagggaagggtagaaaggatgtgttgtgttgacagagcctgggacacccagcccactcctctggccaggcatcccacaggaagtgggaggtatcggagctgtagcaccacctggggctcatgtggggctggtgggtgtgctgggccctggtacaggagctaggagcacctgggttctgggcctgggtgtgtgggggctgggccttcctcttctgaggccttggtgccaccagaggagctgctccttcatgttcagcggctgctccctagcaacccagcgcagctttgcataagcaatgaggcctcgccagctctgggcaggaggggttccctggggagggtggagctgacttgggggctgctgccactgctataactgggctcttcccccctgtccttcatgcctgcctgtctcttcctcctgggttcaaatggcccattggtggaggatgaggaaggagagaggggaggggagtgccaaagcctgtgacctgaaatgcccccagctcacctgggatgattccatgttctccccacagccatgggcctaggacagtcccagcagctcctgagtgccccttcctagggcctgagcccctttttcagaagtcctggtatctgatgtatgtcctcctgtctccatccccagttctggcataaagcatgcttccattgcgagacctgcaagatgacactgaacatgaagaactacaagggctacgagaagaagccctactgcaacgcgtgagtcctgttctgggcagggggctgggtgggcaccttggctccctccccgagtgagttcttcctttccttccaataaccgcaaggtgacattggcgaacacttccatcccctacttgaacatcacagtttgtcctcacaacagctgaatgaagcaagcactttttatccccatttaaagtgcttttatcccccatttaaagtgcatttaaagtacagatgaggaaactggggcttagggaagggaagagactctcaaggtgggatggctagggcaagacaggctctaacccaatttcgggcagtaaggcgagcacgtttctttccactgtcccctgctacaaaagagggggctttcctcgtggtctttcaagaatgagtgacgtgtctgttgtatttggggttgaggactttgttctgtttaccttcccttatttctctcctcaaaatcgacagtttccttctctcacctgggtacttctaggctttgggggctccttcctccagtggttccttcaagaaaactctctggaagcctcatgccagcccttttggtgttcattttttgagaatgggcaggggtgcataaagggtgttgcctgggccagatagatctcttccctgcctggtgagggaggctgtggagactgtttcttttgagtatagtcatcttgagtatagtgcagctctgttccttctgcactgggacctgcagcagctgacggtagggagggagtatagaggtggggtcccccatcccagagcctggaggaatacctcccctcccatcccatcccatcccatcccatgcaatcccagaaagtacagcaattttccatcttccaattgaccttgtgagtagcaagtacaaactcagtgttggggcctcacagccgcctccacctgcgaggtggaggctttggaaggtcaagtcacttataagtaatgatgtaatgataatttctttttcttttaatttgcttttttttttttttttgagtcagaggactcatcacccaggttggagtgcagtggcgcgatcttggctcactgcaacctccgcctcttggattcaagcgattcttgtacctaagcctcctgagtagctgggattacagatgcatgctaccatgcccagctaatttttgtattttttagtagagaccggggtttcaccgtgttggccaggctggtctcgaactcctgacctcaagtgatgcaccgcctcagcctcccaaagtgctgggattacaggtataagccacctcgcccagccttaattcgattttttttttaattttaacttttttttttttaacttcaaccaactcaagtaatggtaatttcagtgttcacatgaatttaggatctgacttgagtccagttttttttttttttctcttaattctcagtcaggaggctctttgcagctgaagttcacccagggaaaaaaaaatttgggacttgtctaaaaagggggcttaaacctccagccttacccctaaccttaccccaaaccttccttgcttccttaccccctcccgttccctggctaagaccactctttcatctttttaggggctcgctcattcagcagacatttattgcctgcctgctgctataatacatactaacctgcaccaggtgctgggaaaacagattcctgataaaaatctcaagcccaagaagcaacatgaagttgtcccttctggaagaaggagggcactgggcaggttatctgggtaaaggaagggttgcagctctgtcctggcccctccttcagctgccccttctcttctattaatttctactgttcctcttccccctaccaacccctcccacccccacaagggaaatgggacattcttcgaattcttaagggctcacacaagccctggttctctgccacttcctccctccattgggtagtggggtggggttcagagaagccagggcagttaacccctccgttgctggaccacctcaggctagattctgagcctccgccccagcacgcagaagtctgaccgagccttggagcccagtgactcaagcagcctagaattcagtgagcactgggagctggagaaaaatcagaggcttgtccttgttttctctgcgttttatcagcctcatccaaagttccagcttactgtttttactgtcttcttgggaagctgccacaaggttgggtggagggctcctgcagggactgggggagccagaagaggcagatcaaggtttcttctctgggtgatgcttccaacttgcagaggcagaggttcccctgtctccctcctggcctccagccaaaagaagcaggttggcctctccatgtttcctccagcttttgtagccctagcctctgccatgcctcattgacctttggcccagttgggatgtttcctgggaaggagcctagtgagagagacctgggggctttgtgacccagctgtgtttcactttagctgtagtagcacctcctcgcccaaggcagtcattctccctcccctgcatccactgggccaagaagttacccgtggggattctgggatgaaccaggtgtggcgcccgcttgcaaggagtgctctctggacgtgtctgagccttggtttccccatggttaaaaattcctgcccaggaggcctggcatagtggctcacgcctgtaatcccagcactttgggaggctgaagcaggtggatcacttaaggtcaggagttctatcagcctggccaacatggtgaaactcgtctctactaaaaatacaaacattagccagatgtggtggtgggcacctataatcccagctactcaggaggctgaggcaggagaattgcttgaacctgggaggccagggctgcagtgagccaagattgcctctgcacttcagtctgagcgacagagcgagactccatctcaaaacaaacaaacaaacaaactaaagataaaaaaaaattcctgcccagggatgttggaccctagaccaaagaggatttattgagctcttgctatgtgccagacgctaggccgagtgtttgctgtcattccctcctgctttcttactttttttgtttttattttgctttggttttttggagacaaggtctccaaaaaaacttcgtcctgctcagtcacccaggctggagtgcagtggagtgatcatggctcactgcagcctccacctcctgggtttaagtgatcctcctgcctcagcctccctagtagctgggaccacaggcatgtggcgccatgctaatttttaagttttttgtagagaggagggcttgtcatactcttggcctcaggtgatctacctgctttagcccagcctcctcgtgttttcttcctgcctctggtcttatccttgagtgacattcaggttcctgaatcctgggtttaccagggtacagctttctgccatttctgttctggtcttgctttgtggaccacaggcctggcttccttctctgaagcatcacgtgctccatgctgggccaagcccagtgcaggacccgtaggggcacgtggtttcttctggcactttgccagggagttgggcccacccagtgagtgtgtgagtttggtgtgcagggaggcctctatgttctgcctgtctctggctagtctctgaggggagctaggatcttgcagggggctggtcaagaaagaagaaagctatctttccctgtggtttctcaagattcagatttaagctctagaaagtgactgtaaagtaggcagtgaaaaggcctcttctgtttctgtccttgcatcagacttgtttgggggagaggcaggggagagaacataggccagagctcactgccagcccacctggtgtggcggacccccacatgcgtgcagttacacacatgcctggtgtgtaggcagacacccacgccggtgctggggcgggggaggaggacttgggagctggactgaatgggctgtgtttgtgtttccaccttcaggactgcagccatgcagccaatgctgtggcaaggttgagggtgcactcccggcttctgcacaatagccagtggtggaggaagaactgctaatagaattctttttgtttgttttttttgagacggagtctctgtcgctcaggctggagtgcagtggtgcgatctccgctcactacaacctctgcctcccaggttcaagcgattctcctgcctcagcctcccaagtagctgggattacaggcacctgccaccatgcccggctaatttttgtatttttagtagagatggggtttttccatgttggccaggctgatctggaactcttgacctcaggtgatccactcgcctcggcctcccaaagtgctgggattataggcatgagccactgcccggcccgaattctttcttgaagcttctgggtgggtggagtgagcctgctcttggtgagagagatatttaagagagatatttatgccctccattacttgttttgtaaactggattttccaaaagtggggcagatcagtccacacgcccaggcttagcataaacctgcatcgttgtctccctgcagatagtctagagtactgcctgttccctcctctttagggccctactgacaggaggcagggttgccagccagggaaaccagcttgtgaggtgtcaagtgggaggtgggcatgggctggggaaggaaaattgggggacttggttgcacctttcccctcttctctgactgcacatatttggggttcattctccagtttccttgagctgtggggtaaggactgaggagggtaaagatgtccctgattctggggagccaggaactatgtttctgccccttcccttaggcatcagatgggagtagggtgtggtctgtgtcagacaaggctgggtgcttaagtgtctctggattctagcaaactgtctttaatcccagctgcttttaaaaggtggggcagggttgggtgcagtggtttatgcctgtaatcccagcactttgggagactgaggagggtggatcgcttgaggccaggagttcaagaccagcctcatctctacaaaaaatgaaataaattagccgagtgtggtggtgtgggcctgtggtcccagttacttgggaggctgaggcaggaggattacttgagtctgggaggttgaggctgtagtgagccctgattgcaccacagcactccagcctggcaacagagggacactctgtctctaaaaaatgtaaaaatgaaaataaaaataggtggagcaggagtaggcaaaccccgcactggggcccagggctttccctccttcccaaaattgtctgcctctaactggaaaaatggggactagggatgacagtgtgggggagggcaagtgcaaatggccagcccaagtagccaaatgtggcctccaggtagccctcccacctcacttacccccaaatccctgtccttcaggcctcctggagcctgagggatcactttgcttcctaacacctacgttttacagatgaggaaacaggcccgcgtttccatgccttactcaacttgcagaattgtttctcttctatattaccgacaggggcaggcttttttttttttttttttcttttcattttgtgtgcaatctgatggctggtaagttcttcctcaagtctagccttgatctttttgactgctcttttttttcctctgattgaacaatgcctccttgttgcttcctatcgccaccacttcagccccttaggcctgaggggatggacgggtgagaaactgggttagcagggagccctcccttcccgcctgtgggcagccttcccagtaggggcttttggaatccgcagctctttctagaggcaggatgtgggggctgttttttttttttccttttggtaaaaccaaaagctccttgttgcttttgttgatgtctttttgttcctccttgaacacaaagctgtggtttttgaagagatccaagcctggaacgggcgaggctctgtgtagaaagggcgctgggctttcgggttcgctatcctgttcttctgaccctggagtgtggctgatggcaggactggagagtgaggctggtggctgacaagctgtccctgtcacctgtgagcccggaaaccttgcccctgtagtcccaccaagcaggaaggccacccagaggtcctcacagataacccctctcctgggacacagggcctcttcagtatcatatccttttttttttttttttttaatttttattttttgagacagagtttcgctcttgttgcccaggctggagtgcaatggcgcaatcttggctcactgcaacctctgcctcctgggttcaagcggttctcccgcctcagcctcccaagtagcggggattacaggaggccgctaccatgcctggctaatttttttgtatttttagtagagacggtgtttcaccatgttgtccaggctggtgtcaaactcctgacctcaagtgatccgcccacctcagcctcctaaagtgctaggattacagcgtgagccaccacgtccggctttttttttttttttttttttgagatggggtctctctctgtctcccaggtggaagtgcagaggtgtgatctcggctcactacaacctccgcttcccgggttcaagggattttcctgcctcagcctcctgggtagctgggactacaggcgtgtgtcaccacgcccggctaatttttgtatttttagtagagacagggttttgccacgttggccagactggtcttgaactcctgacctcagatgatccgcccgcttcggcctcccaaagtgctggcatttcgtgcccgacctgtatcatatacctttgaaaagttcagagggataggcagctcctaagcaggtgtggctgagaggccccagaatatctctcataatggccgagcttggaaacgagttgggtttgaaggatgaagtgctttgttttgcacccaacctgccaagcacatctttccccagaactgagtgctggaggtggctggggtccatctggcctccccttcgctgtctgggcagctgtggtgtagaggagaatgccttgggcaaggtctctgtccttgacactggacctcagtttcttcatctgtaaaacggcacaatgagaatgccagcctaaagctgtgtggtgggttttgagagagaatgtgcacaggactcagtgtgccaagatgttgctttgtgtctctgtaaattgtcctgaagcccgaggctgctgccaatagctgcctgtttgccctgccctatccctgtccagtccctgttcctgccccgcttcttcctgtcctacatgcctctccctgcaaactccccagagcagctgatagcagggaggaagggtgggtggggcacctgcagagagcccaccacccacttggaatgattaacaaggggccagtacaggctggcctatgggacaaaggacagctgtgctctggactctgccctgcacccagctgatcacctgtccctcattcctcgccatggcccagtctgtcatggggttgggttccagcggagtcaccagctgggacgggtggcccctggtctgtcttagcacccatgttggcatgcacacatttccagccatccctgctgggatctaggggtaatggatgggatgggcaggaagggaaaaggtagaattcccaaaaattgtttctggagggaggtcaaatcagttggagctttctttgaagcccggcatgctggtggggggaggggtgcagcactgatgttctcatgcctttgcttctagaaacaaacccgtgacacttgtcctcctcacctaaattatccagaaagatcctatagacacagtctcctgactttgccctcatgggcttctccttagttgaggacccccttgctgtctgtgcctcttcctcaacccccgtagacctctctctctctctcactcattctctctcactcgctctctcactctcactctctctctctctctctctgtctcgctctcgctctctcctcactctctctctcactgttgctgctctcctgcctggagctgaagatgaggttgccatggaaacctgaagcgtagtgagccgggagagggaaaggcagagtcgtctcgccagggctgggggctggggactggggactgtgggctgtggggaggggacagggttgacccagcaagaggaatatagcccaagctgtctgcctgccttcctctgcctggggttgggcttagtgggcaggggaaggagcttggaggctctggagtgcctctttaatctagttaatctgatgcaggattaaaatcctccctcactcctgccaaattaagctgagctcacatctgggctggctcacccccacttcccttctgatgggattagcactccagctgtcgggggctgagactagggggaagggtgcttctgaagaggatgaagtacctgccaaccccacccaaggtgcctgctgcatgttggaggggctcccgagaccgtctggtgggtgtagggtgagcagagggacacagtgtggggtgcagggggtgtgtggacatggcctcaatgcagctgctgcctgggtgtcttggaggcgcccatcggtgcagagggcacatctatatattcatcgtgtgtgaggcacagtgcagtgtgtgtaggaacttcagactgtggaatgggtggggcacgtcaggtgcacctgtctggcggtctttgggcactggagctggcctctgttttatttatttatttaataaaaacaggctctcgctctgtagctcaggctggtctcaaactcctggctcaagaaatctgccctccttggcctcccaaactgctgggattacaggcgtgagccactgcacccagcctggcctgttttaaccctgtgcattctggccaatgagaaaccccagggttttgcagaccgggtctggaggatgtgtttgccctgcttgcctctagccctccccatcaaatgctaaccagcctcatcttctcagaattgagtcttcgagtgctgggccagagctgcccggaggtctcctctcccccaccctgcttttgccacatgtgcctctacttccatgtgcttgcctcaccacagcccctgcccatacagtctgcagaatggctctgatgttgggaggagggtcgtctcgtctctgaagcgctccctcttagggcctcagggcctgccagccctgctagagatcttccctttctggtctctaggaacagactcgtggttgatcatcccttggcctggaattgtacaggaactttgaagggagctcctcagctgtgggtggccctggctgcacggggacgaccccagacttggccacgtattcatcacaggccacgtctgttgccagctgcggacacctgtgtttgcctttcctcatcttcccttcctctgctggaggaactgcgagtctgggctgacctgggtggccaggacccaggtgagggctgggggacgggcaccgctaggatcatctggatccgggacagtgaaactggcccaagggaaaaaggatttgccaaggtcacccagtaagtcagtggcagggccagagccctgcactgggccctgtcaagttatgctcctttgattgaggtctccaaatcctgagccctgcccttcacaagtggtggcctcaggggaagtcgcctgtttacaggtagctctgatgcacggccatgtgggcggcaggagaacatgccgagcagaggggcagctcgttcttagctctcgagtgtgtcagttttgggtggaacgtgcctaggaagaggtcccaggaggccatctatggcttacctgggtgcagcctgtgagtcagggatctgcaggggtcatagctgtggtgggctgtggtcacccagggctaaaaatggcctgacgggctccggcttggagaagccacccaccagtccctgaagtaattggggcccatgcagacccccagacatttctcatagcagcacatacacacaaaccacatggctcagagctgcctgtctctcctgcagctggtttgctaggggaccttgtgatgagagagggatggagaagggctgagttctagtcctgcaccagcttcaattcctggcgtgacttttttttttttttgagatagagtcttgctctcgcccagactagagtacagtggcggatcttggctcactgcaagctccacctcccaggttcaagtgattctcctgcctcagcctcctgagtagctgggattacagctatgcgccacggtgcccggctaatttttgtatttttaatagaaacaggatttcgccatgttagccaggctggtctcgaactcctggcctcaagtgatccacctgctttggcctcccaaagtgttgggattataggcgtgagccaccatgcccagcctgacatttgtttattcaacaaatatttactgagcatcgcctactattctaggaacttgagataaatcaatgaacaaaagagaccccaaaatccctcccttcatagagaagtagtggagagagaagacaatacattgatgtgataaataagttaattatgaagactgctaagggagaagtgcctggtgccagcacaccgtttcctcctctgaaatgagggagttggaccagagtcttctggaggtctctgcaggctctgagggttgccgtggcttcggctgcctccaagccaggccctcttcctggggaccaggctgtgctgggcctggaaattggcggctaagttcagcatgaactgaagaaatcgtctgggcgcaaatctggatccctgtgtgtcttggccatgttgtttaacctctctggcctcagttctcccatctgtcaaaggggtacgctgaataccagtcacacaggtggctgtgagaattcggtgaactagggcacataagcccttagcacagggagaacattcactgtttgtttttttttgttttgttttgttttttctttttgagacgtagtctggctctgtcacataggctggagtgcaatggcaggatcttggctcagtgcaacctctgcctcctgagttcaagcgattctcctgcctcagcctcctgagtagctgggactataggcgcacgccatcacacccggctaatttttgtatttttagtggagaccggggtttcagcatattgaccaggctagtcttgaactcctgacctcgtgatctgcccgcctcggcctcccaaagtgctgggattacaggcatgagccactgcgcccggcctaattcactgttgttactatagattgagcagccctaatccaaaaatccagagtctgaagagctccaagatgcaaagctttgagtgccgacgtgatgccacaagggaaaattccacacctggcctcatgtgataggtcataggtcaaaaagcagtcaataattttgtttcatgcataaaattatttaaaatattgtataaaattaccttcaggccatgtgtatgaggtatataggaaatggtcccatccccaagatgtctcagtatggatattcaaatattctaaaatctgagaaaaaatccaaaatctgaaacacgtctggtcctgagcatttccaataagggatactcaacctgtattttacctgtcaccctcaggtgacctccttttttgtcctcaagctggccttcccacctaccctccagttaggttggaccttgttaaccgtttgaaataccactttaaccgtgtgttttctctctcaccacttcctccaggaagtccccctggatatgtgtgtccctttgtttttctgtctcccccttgctctcctctgcatggtcggtctccacttctggtcttagctgaaagcttagtcctgactcacctgtgcccatcttcccccagccgggcccagttgcctcgacctccatgtgtggtaggcacaaggcatggattatccccaaacaagggtaaccttcaaccctcagagagtggcccagtggccatcctttcgctcaggacagttctccttggctggcccatcactgatgcctgctgcgtcttcccaggtcagccagtcccagctgagtctgagaaacgcttgtctcccctcggccttggtggtggacactgaagtcctcctgtggggccgggccagggcgtgcccaagcataggacgaagttcccaggagggcatgctctgtgagaagcccagaggctcctgcccctcccccagagtcacccccactctgttttttctgtcctgcagacactaccccaagcagtccttcaccatggtggcggacaccccggaaaaccttcgcctcaagcaacagagtgagctccagagtcaggtgaggggctgggcggtgctggggcctggcagggagggatgctggggagggaagttgtaaggtcggcatttggcaagagtaccttcccctgcggttactctgcaaggccaaggtgctgaaatcctagcattgcctttaatcttgaccccacccctgactttatcaaaggagcagggtagagcgttctcccacttcctacctagagggggttggagaggtgtgggtgtctatttgagcccgctctggggctccctaaagcctacctcctccaggaagccactctcccctccctcttccccattcacactcacccacaaaggaggggtttggggaggaccagggaatttgcccctccaggtcatgccagtctgaggctgggcaaccaaccctctatagccgcgtcccaaacctccacccactgaagggcaaggtgtgaagggggccctgccatgggggcacaggatagggggctgttccgcctctgtctcctttggcttgactttccagaacactgctgagtgggaggtatgtgcccctgtaggaggggaggacgggttccaggcctagggagaacttggtctttaggggacacggaggaataagcaaagggtctggagtcctgagaacagaacagctgacccaccctgcctgggggtgcgagggctcctgggacaaacctggccagtgatgaggtggggtggggtggggcggggcttcagccgatgaaggattaggcgcgagaatacatgtaggggaatttaccacgtgggcagcgcgcccaggacccactcaggatcgggagaagactgcagaggttccacccgggccacagaggggatctctcccagttcctccagaggggactcctgctgcctgatcttgatgtgactgcccgggtccatcagggagaaccgaccctgccttttgtcaggctttccatgcaccctctctcagcatcctcccagcagccctgtgaggaaggtgctatcttccccattgttacagatgaggcgactgaggcccagcgactttgagggactagctgaggtcctgcgggtaggagaggcaataataatattcacagctgacgatggagggctcagtgctcccggcgtgtgagctcgtttaatcctcacccagccctgtgcagctgtagcatcacttcacttcagagaagaggaaatagacactggcagctttgaatgtaggtttgtctaacccagggactatccactccccaagaaacagtctctaccttaataataaacatgatagttccttatgctgttgagaagttttgtagtttagggctgggagccatggctcacgcctgtaatccctgtgctctgggaggccaaggtaagaggatcacttgagcccaggagttcgagaccagctggggcaacatagcaatacctggtccctaaaaaaaaaaacgagcagagatggtggtgtgcacctgtggtcgtagctacttgggagtttgaggcgggagtatcacttgagctgaggagttggaggctgcagtgagccatgatcgcaccactacactccagcctgggtgatggggtgagaccctgtctctaaaaaaaggaaaagcaagaaattgtgtagttcagcaagtgcctttagttagttcccctgtttatccttgactgggttctgggagaaggtaaaagacccagcgtctctgtcttacagataggggaaccgagtgagtgaatgcggatccaggatttgggccctggtcttgtcactcccaagtctggggcccttgatgctgcacagccctggtagggcctgaggctcacagaggaagagagcagcagctcacacctgccacccacccacctgcggcacagaagctgaagttactaggaagcagggaacaccacagcctgcctggccatattttacagattctagccaggccctgactcctgccttcaattccctgccctgtggaagggccatgggggccagaggtggaggggctcagaaggacctcggagaagaggtgctgggagcagatagcaggtctttggagacacacacacacacacacacacacacacacacacacacacccttctcaggggagaaattcaaacccctcagcctttgtcagttccacaaaagcgtggctgcagctctttttgccccggcaccctatccccgaggggtggggtttgaggaggaagcacctccacgttgttccccctgcccaggatgggcagcaagtgggcagggcatgctgttggcaggggctgcttctgccccccacaggggaagccagcaccacgctctgggtttgggggctcctgtccctggcctgtgccccctgcttcccagggtcatagcctgctgggttcccgggggggcctcttgggagatgaaaatggcggtcactcttcattagggcctcactgagggccagagcgtgtccgtgtgtgtatgtgtgtgtgtgtgcgtgtgcacgcatgcacgcgtgtatgtgtgtgtgtgtgtgtgcaagcatgcacgcatgtatgcgtgtatgcctgactttgtttaatccttacagccacctgatgaaagaggggctcttattatccccatcatacagatagggaaactgaggtttacagaggctgccctgcttgtgcagagcccagggacaggggcagacatcaagtcccatgacctggccctggagcccgttgctctgaacagtgctgatggcacaggcaccgagccctgtgctcccaccctgcaggatgcaccagtcagcagcaagtaggatgggcttgttggaatgcagattcctaggccccacccaagggacttctgcttggcagctctgggtgaggcccaagaatctgcattttgactcccccgtgattctgataaggacttttggccccactttaagaagcttagagatgggtccatgggcaggagtgtaccgaccctgtttgtatgctctgaggggtgccacattagggtagggctttgcactaagggcacggctctgttcccctgaggtgggggtcctcgggggttgggggctgagggcaggataggcaggggaggaaagggtactgccctttttgcaggcctgttctgtctcccttcccaccgcccaccagctgtgtggtctgagactggcctcagactgtctttcctctcatagctttgcttcctcaccagtaaaatgaggacagcaaacccagttgcctcaagctgggggctgggcctgatgctttgaggcttggaagggctgagccggccaggctggagcagtgacgggttctggttcctgtggctgccgtgggggcagagctggagagagctgcctgcggctagcaggaagggaagggggagcctcttctgctcacccagcttcaccccacggggtcagctggcttctctccatgccccttctgggcctgccttgcccttccctgtctctgggaagctgcccaggctatttcagctttatttattttcccatctctatattggtctccaaaatggcactttgggtgtctgggacacctggagcctcccctgtggaggaggtaaccacagaactgtccagaaatgaccctctcggtggtcctgcccaggcctggctgaggcagggggctggcagctggacccccagccccccttctcacttgctgctcctatcccacccccaggctgagcagaggcagtggctttggggtgggactgagctggaggtgtctgtatggccctgagcccaggcagaagtgccaagtgccagtagactgttcttccattttttccttcatcaactcaccttgatggggtcatgggaaattacaggggggtttctatcctcctcggatcttgtaagcagcacgggtggtagagtatcactcttacccgaactagctggcctgagattgaatctcgcatctgctgccaccagctgtgtgaccttgggcaagttgcttaacctctgtgcacagtgccttcgtctgaataatgtggattacctctctccagagggtggtgtgagataggaggatatgttaagcatttaaagattcctgacgtggagtcagcattcagtgtttgctactactgttctcccggaaaggagaggaaatggaacttggacatgaagaagctgggaaatacacacagcaaccttttgaccatgacttccagccccggccctttccatcagctctcctctccatctgtgtgtgtctaattttttttttaaatttgtatttttttgagacagggtctctctctgtctcccaggctggaatgcagtggcgtgatcttggctcattgcagccttgacttcccagactcaagcgattttctcgcctccacctcctgaatagctgggactacaggcgtgcatcaccatgcccggctaatttttgtatttttagtagagacagggtttcgtcatgttgcccaggcttgtttcaaactcctgacctcaagtgatctgcccacctcagcctcccaaagtgctgggattacaggtgtcagccaccgcgccctgcctaaattttaaaaactagtgtttcttttttgttagaaggggatgggttacaaagtatgttggcccaacacatggtaggcacataatagtggaaattgtatttcgctcaataaattttgtatttttttagagatttttattaattttttttttttttaaatagagatggggtactatgttcccaggctggtctcgaactcctgggctcgagtgatccacctgtcttggcctcctagactgctgggattacagacatgagccattttgttttttaagtccagcctaatttttgtgttttttttttagacggagttttactctgtcgcccagcctggagtacagtgtcaccatctcagctcactgcaacctccggctcccaggttcaaggaattctcctgcctcagcctcccaagtagctgggattacgcccaccacgcccggctaactttttttgtattttttttagtagagatggggtttcagcatgttaggctggtcatgaactcctgacctcaggtgatccacccacctctgcctcccaaagtggtgggattacaggcgtgagccaccgtgcctggcataatttttgtttttaagtaatgatccttcttcttatattgggtcatcaaggcagttgttttcccaattatgctgctttgtttggagattacgtgtctgcattcaattcattcatgatccaacaaatgttgatctgcacctcctgtctgctgggatgagaagcaagatagatccagggagaacaactaagaactgacagaaaaattagagtttcacggatggtggttgtttgggtgtcaggagcctcagatgtcagtcagtcctgggcctgacagcagagtttccaaaatgggagcccaggtatctcccaggagtggggtcctctgggagcccaggcatctcccagaagtggggtcctctgaccgaagcgctgagttgcatcctggcctgagcgacaactgggttgtgaccttgggcaggtcccttcctccacagggacccccacagcaccctggtgagccatcctagacaacaggggcaagcactcctgccagggcaagaagggagccctgaagaggggctctgggctgggccctccctacacccctggccccccacccttcacttctgccaccccttccatacccaaagacctttcaaagagcctccctgtcttgattatccatagtcagggtctgaaggtgctttaaaatggtcacagactccaaatgggagggattttagagatcagctagccagctcccttcaggggacccagagaggggaactgacttgcttagaaacacacagcaaggtggtgctgatcccaggctccctcccttctcagcccctacccctcacccctaccctctgtgggcctcctatgttagcagtgaaatgaatgatccttccccaacagggagggggaggcagaagcagttcccgatcctgggaacctgctgatgtcattgcagcgtcgccatggcgattattcccctggattaggggcctgacccttgcaaagccaggaagcaggggacggagtgggggactggcactcgttcagcacttcattgctgacagagcactttcacactggccctccacagtgcgctgctgctttagagccactgtctgtatcgtgggttggagtgactggcgttatggtccccattttacagatgtgggaactgagtcttgagatgtgaagtcgttggcccaagatcactcagaagtgggagactgagcctgcgttagtgctagctccgcctggctttgtgcccagacttggtgataagaagccccctccccatattatacctgatttctgtcacaactcttttacagatgaagaaaccgaggccaggggcttgagatgcagggcttctgtatctggagctacatttctctgcctctgagtgccctaccttccccgatgcccgcttcccaaagggcctcccactaagagtcaccgtgctggcccagggcttccaggactgaggaagagctggtgctaggcaggttctggactcttggggtgggttggtgcctctatccactgcattcacttctgaactaatggggaacagcacatccaagcccttcttgtctggatcagaacagagaaggagagggaaccacatggatgagtgactgggggcttcaggagacaaacaaggactctgacccccacaggcatgtgcagaggacctgacaggtgtggccgtggctgcatgcgcatgcgcagtcgctccagtccaagcacagctcggtgctgctgccagatgattccctgccagggaactgcctgggtttgtgtcctgggctgacctgtgtccaggacagtgcagcccccgtggaggaaatccaagcagctggtggggtctggaacagatggctgatgaggtggacagtgaagtctctggaagccaaggaatagtttcctgttccatgagttttctcagcctcattctgttcttcaaaaccctcaggggaggacaagctgttcctcatatttcaattcctttcgtgccagggaagtcctttctgatgtctgacttgagtccctctagtactgtggtggggtggaagggttcttccctggagcttggagacctgctgagatgctgtctgacccccgctgctttcctcccctcctatggcggtggcctctgaagccatcccggcaggctcccagaatccgcggggcctgtcaaaggcgcactgatggagccttccctggggctgtctcaccaccctcctttctgggcaccaactctgtcctttggcacagccctcactcagctggttgctgaaaagctcccccaggcgtagtgggcagggccacatcctggctaacatgagggctggggccaccctgggagccctggaaagaacctttttcctataagcttccagacaggatgggcagggagtgaagggtcaagagtcaggcagatgagggtttgcactctggtagtgccggacattgactgctaagctctgtgaccttgggcaggggactttgcctttctgtggctccgtttcctgatccgtaaattggagctgttaattgcgtggctatatgtatggtgggatctaaatgagatggttcatgtaaggccctggactctgtgcctgccattcactgtgcaccaaagacttggtagtggcttattattacgagtctaacaccttttggctgaggcctctgctttgagttggggacttctgatcagggtctttctgctgactccctgtccctgtctcctgactggttgctgcctcagaggggccccaagccgaggccctttcggctcctggcctgactccaatccctcttcctcccctcctgcaggtgcgctacaaggaggagtttgagaagaacaagggcaaaggtttcagcgtagtggcagacacgcccgagctccagagaatcaagaagacccaggaccagatcagtaacgtgagctcttgccctgccctgcggcatccctgctgccctctgtttggtccccttcctgccagcctggcagacgcaagcctggcagatgtgaatgaggccagtgcctccactacccctgccctccagggtgggcctggggaagagcttggggttcccagatgcctcttctctgtgtacccccagaccaccagcacgcatagcattttcttcttgaagggactgtattctgtgggggcctgtgtgctaaatcagcccccactctctctgactgttgttcttttttctggatatcgtgggtatcggtgaagactgcatgtctcatcttagcacaaaggtcaaaactggggggcggggagcacctggcctcccctggtctgcgcctgggtgctgacattgcagtcatttccgcccttccttggcctcctcccccacatcagcctgctcttccttcctgtgtaaaaaccccagccagcttcacccgccagccctgcaccccctggctcacaccccccgcctccctgatggtcagtggcatctggctgtggcaggggtgggcatggagagtgggcaggggatcaactgtccccagcatcgtgtgccctccatggcacctgtggccagagaacaggcctcagtttcctgcttggcagagccacaggcaagcagcctgtgtggctttaggcatgcgggggcagggcactgcggtgagcagcaaccatgggggatgcgcacacagaactgcaggggctgcccagccagcctggcctaggaggtcctgccagggagggtttaggcaggcagctgtcttcgtgtctggaacaggaagggatcagtgagctgcccattgttgctctgggctgaggaactggggatagagattgccgggggagcctggctttccggtggtctcagcacccactccctgggctccacatcccttcctaccctccacctggccacctcagcagggcgctcctttaagagcttggctgggccgtgcatagagtgggctgcagtggtgggtcaggtggatttcagaagcacaggcagcccacagacagcagaaccagccatgcccaaaatggtggctttcaaactctgacttcagcctacagtaaaatatacattgtacgtcttgacccatctgacaggcatacatttatgtagagggaaaacagaatggaagctttcatgaatgagtacttcctacttagagggcgttcagatctttttttttttttttgagacagagtctcactctgttgctcaggctggagtgcagtggtgctccgcctccagggttcaagtgattctcctgccttagcctcccaagtggagtagctgggattacaggtgcacaccaccacccccggccaatttttgtatttttggtagagacagggtttcaccatgttggccaggctggtcttgaacacctgacctcaggtgatgtgcccgccttggcctcccaaagtgctaagattacaggtgtgagccaccgcacccggccacattcagatcttttctaaagatgctggttgcaggcccctatacaccctcacataatacagcccctttgaggactgtattcccaacactttgggagactgaggtgggaggattgcttgagcccaggagtttgagactagcctgggcaacatagcaaaactgtttctacaaaaaaaaaaaaaaaaaaaaaaaaatacaaaaactagccaggcatgatagcacacgcctgtggtcctagctattcaggaggctgaagtgggaggatcacctgagcccagaggtttgaggttatagtgagccgtaattgcaccactgcattccagcctgggaaaccgagtgagaccctgtttccaaaaaaaaaaaggaccaggcgcggtggctcatgcctgtaatcccagcactttgagaggctgaggtgggcggatcatgaggtcaagagatcgagaccatcctggccaacatggtgaaaccccatctctactaaaaatacaaaaattagctgggcgtggtggcgtgtgcctgtaatcccagctacttgggaggctgagacagaagaaccgcttgaactcgggaggcagaggttgcagtgagtcgagatcgggccactgcactccagcctggcgacagagcaagactccatctcaaaaaaaaaccaaaaagatgctggttgcagacttactgtgaatgggttttgcaactggactgttgacctgcagtttgaagttggtggcctgaggaaatggcatgcttccctttggctagcaggggatgcctagggcgggcactctaatcctccttcccctccaacttccagaggcctgtcacagttgactctttatatgctagggcctggcctcacgccctggagcttccctttggctcagaccctgcaaagggtaagacccttaggtctgtgtttcagagctctcggcttggaaagtgggggagggggaagatggtcttagattatggggaaaacccggaatggttcacagaactggaatgtcggctcttcagcctctgcggcttttcatgtagaggctctagtcttttatcagtgacacttgctcccaatgtgcaaccccagctccctggctgttcactcattgcttcaccctgtgggttttggaggaggggagacaagcccagtcatccctgcttccctttctggaaggcttccagaacactccacactcagcctaagccacctcctcttcttccctcccccagttagaggtgttaatatcctagtgacaaaactcaccaccctggccaagccatccgcatctcaggagataaccatcttttacccttctcgcggtgctgcagtgagctaatggtcctctgcaggagctgggggaagggatcgaccccgacctgctagctgcttttgcagctttagcagagacctgtagggtgtgaatgcaaagcctggagactcttggttttaatgaaagcaattacagtctgtcggatatgggcctccagacagctgtagcacagtcacctgtagggttgactgaaaatgcagactcacaggccttctcccctggctgccagaatcagcgtctctgggagtggggcccaggaatcagcatgttagacacattccctgggtttctgtggtgctctctgaagtttgagagccaccacctaaaagtctgaaaaagcttcaccaacccctaagtcagagggtgccagatcaggctgtacctcagaaccccaggggagctttatttttatttttatttttttgagacggagccttggtttatcacccaggctggagtgcagtggcgcaatctcggctcactgcaacctccgcctcccgggttcacgccattctgctgcctcagcctcgtgagtagctgggactacaggcgcccgccaccacgcccggctaatagtttttgtatttttagtagagatggggtttcgccgtgttagccaggatgatcttgatctcctgaccttgtgatccacccgcctcggcctcccaaagtgctgggattacaggcgtgagacaccgagcccagcctatttttatttttgagacagggtttcgctccgtcatccgggctggagtgcggtggtgtgttcacggctcagtgcagcctgaatcttctgggatcaagccattctcccacctcagactccgagtagctgggaccacaggtgtgcaccaccatgcccagctaatttttcttttttttgcagagacactatcttgctatgttgcccaggctggtctcaaactcctggattcaagttatcctcccgcctcagcctcctaaagtgctgggattataggggtgagccacctcacctggcctcccaggggagctttttttttttttttttttttttaatcagagacagggtctcactatgttgtcttaaactcctggacttaagtgatccgcccacctcggcctcccaaagttctgggactactacaggcatgagccactgcgcctgggagctttaaaccacacataaaaccattgctaagttgtcccaacctcctgaagtgttttggaaaatagggtgtttagagccacaccttttgttttgtatccaaaatagcattcctgttcctgtatgtagcttgttgctttgcttcccagattagcaccaaatgactccagttactttatttatttatttttaattttagttttattttatttttgagatagagtctcgctctgtcgcccaggctggagtgcagtggcgtgatcttggctcactgcaacctctgcctcccgggttgaagcgattcttctgcctcagccttctgagtagctaggactataggcacatgccaccacgcctggctaatttttgtatttttagtagacacagggttttgccatattggctcggctggtctcgaactcctgacctcaggtgatccacctgccttggcctcccaaggtgctgggattacaggtgtgagccactgtgcccagctgactccagttatttctaaaggtcaggccatcttacaaaagaatgaggatatgcttccttggagggatatgctgcagactagggctttttaccagccagagcattttaaaaacaagtgtctgatctcctctggggtgtctgctttggataagtgcagtctgtcttcagtcttgctaagtggtgagacagtgaggtaggaagagatggtaagggcccagatcctagcttctgtcattctggggccaggcagggctctttgagcctcagtttcctcatttgtaaaaatgggacagtaggccctactttgacaggtggttgcaaggaacatgccaagtgcttggcatgggataaatgatatcactcttattatcatcattattatttttgagacaagattgcccaggctggagtacagtggcacgatcataggtcactgcagcctcgaactcttgggcacaagtggtcctctcccgtcaacctcctgagtagctggtactacaggcatatagcaccatgcccagctaattgttattttttttgtagagagagggtcttgctatgctgcccaggctggagtgtagtcacgtgatcacagctcactgcagccttgaactcctgggtttaagtgaaccctggcctaagactcccaggttgctgggattacaggcacacgccatcacacccagttatgttgtcaatgttatcaatactttaaaggcacacttgtctgctttctacactgttgccggagaagggtcataaagtgaagtttggcagaaaagtttggccattgtctagtactgagaatgtgtggaagtgaggaaaggggccagtatattacacatctatggtgagtagttgtgtcatcattaaaggcatttgaagagttgccttttgatgggtccatgctatgggataaaggttacatgttaggaatcctggccttttgtcatgagctctagcagtgttcaagtatggaaaactttagtcactttactggagcctcttcttttatttacttacatattgattttctgtatacaattttgtgtccttaaaactttttttatgtgtgaaatatgacacatagtaacatatacaataaacacctgtttcaccaggcaggtataccatacattgtattactgtatgcctgtcaagagcccagtgttcacagtgttaaaaatataactcccatgtagtaagtacttatcatatctttatttaattatgagggaaccagctagagattaaaactggggaatatgagaggcagaggtaaatgctagtctgtgaaagaaagtgctggggccgggcgaggtggctcatatctgtaaccccagcactttgggaggccgaagcgggcagatcacctgaggtctggagttcaagaccagcctggccagcatggtgaaaccctgtctctactaaaaatacaaaaattagccaggtgtggtggtgcacacctgtagtcccagttacttgggaagctgaggcaggacaattgcttgaacccgggaagtggaggttgcagtgagctgagactacaccactgcactccagcctgggcaacagagcaagactccgtctcaaaaataaaaaaaaaaaaaggaaaaaagagagtactggatacatttagctacagaaatggttaagggcctaccattagttacacattggctattgtcctacaggaaaataaaaccataaactttgaagatatctttgctgcaggcagaaatgctttgcatctcagttggccagaaataatgagcattttatactctgtaatgagcttcagtctttagagtctgggcctaatcaatagtaaatagtcaaacaaagttttgtccccagagtaaaatactctgaaggcaggtttgttggacaatcctctagtttgattttgaaagcatgtatttttcattataattttagtatgtaattatgtattcttaaacactatagttttgcttttcctgattttgaacacagagtaattttgtgtatcttgcttctcttacacaccattgggtttaaagattcatccatatgtttgtgtgtagcggtagtacatcctttttcattgctatatagtattccattgtttgtttataccacattttattgattctgttgctggtggacatttgtactgtttccagttgctatggacatttttgtacatatctcctgaggtctatgtacattggaactgctgcatcttagaatgtgtgctccttgggccgggccgtggtggttcacacctgtaatcccagcactttgggagaccgaagtgggtggatcatgaggtcaagagatcaagaccatcctggctaacacagtgaaaccccgtctcaactaaaaatacaaaaaattagccgggtgtggtggcgcactcggtggcgcaatcccagctgctctggaggctgaggcaggagaatcactgaacctgggaggcagaggatgcagtgagttgagatcgcaccactgcattccagcctgggcgacagagtgagactccatctcaaaaaaaaaaaaaaaaaaaagtgtgctccttcaactttacgagataatgcggaactattttccaagtggctgcactgatttaccctcccaccagcagagatgagtttcatttgctccatgtgctcagatatgttcactttagcattttgatcgtgtagagtgtgatagccgatggttttagattgcatttctgtgattactaatgaagttgagtacagacttttgtttgttttaaaaataaaatactggggcatggtgggctcacgcctgtatcctaacagtttgggaggctgtggtgggaggattgcttgaggccaggagtttaagacttgcctgggcaacatagcaagataccatctctacaaaaaaaagaaagaaaattagccgtgcatggtggcatccacctgtagtcccagctactcgagcggctgaggtggtaagattgcttgagcccaggagtttgaggctgcagtgagccatgatcacgccaccgcactccagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaagcaggagaattggttgaacttggaaggtggaggttgcagtgagctgagatcgcaccactgcactccatcctgggcgacagagcaagactgtctcaaaataaataaataaataaataaataaagttaaaaaagaaaaggaaatgagtaatgcatgtaagggcacccaaaaaaagaccctagctggtgagctgatgattccacccagagcctgctgttccctcgttcactgtgatgtataatcatgtgaggagcaccgtatggagagtcagacttttattttccaccacagttgggagagcaggggggtcagaaaacagaacatcagctagcagagctttgtcatggaccctaacttgtcatcctggagtcccagctagtagggtcctggctgagtcgggagggtccttaggcctggacccctgaacccacatgtacttggacctcatgggcacaggtagagtgtggcctgtgtccacagaggcccaggacagcttccaggctgggggctgtgctgacatgtctgggcttagggcgctcctcactcagggctctctgaaggccagaactttgcagagcttggagcagggatgagccaggcccttggaagctgggaaatgtttccttgccttctgaatgtgctaacatccccctcatgtgcctatttgcttaacaaaccagtaggtgggtcaggaaagtaataacacaatttcctcatttgctggcgaggggaaggagaggaagctgagggtttggaaattttatccaagtgggcccaggctggaaggagctgagcctcactttttctcagcccatttagccgctctgtgccgcctgtcctgagttgcatgcctggtgtccctctctctcgagttagggtgactttctgattatcattcttgttgagagtgaaaaggggtgcattgaaatttatccctgagcagcagacatgaactgggacttgggcgtgtggtcaccctgctccacacctgttctcaggaaagggcctgtctagctgtgattttgtccttgtgtcaccagccttggctgttactgagcaatgaaagctctgcctcgggaagtcatttaatttctgagcctcatgttcctcttctggaagatgggaatgaaagtgtgcgtgtccggcccattttttagggcaatgattgtcagggtatgaagagcttggtcaagctgtgtgaagagctgtacagctgcagaggttgttaacattgatagagccacccaggaagggtgtcctgggttcaggcagctactcctccagccgtcgggtcagccagccgtaactttagatacacttatccatgtgtaatgactttttaagaagcaagatcagtttccccagccctttatgggaatacccatgtgtccatacttgctttcagcttagagtttgctcaggttcctagagctggtcagggtttgcaggaccgcctgggagcagatggtaccatggccttatttacagatgaggaaactgagacccagaggggaaagtgactcccaaggtcatgtaggtaagcatacggctcccctaaggatgaggcattggtctggtgacagtgcagcccatcataagggactgagcctgtggggtccagacctgctctcctcccagaggaaaaggctccctgtcaccccatcgctaatgcagatagcgtcatgtccagggaagctgtcacacattcatctgggcccccaacatcaaggacacctgtccctgcaggccccctgctggcaccttcggggcccagggcaggcccctgtccattccgtgtctgcacttccctccctggtcacaggttctcaggggcaggctcttttccttagcagaaaggaaacaagggaagctgacctttcccacctcagaacaaaagttggaagggcaggtgcctcgtgagcctggaggcctcaggaggggtgtccccttcccttgtgccctccccgccaccaacaccagtggacagggatcactaagagagtggggctcgggagactcaccttctgcgctgggtctgtgagaacatcacctggagtgcccctcccagcggatgctggggtcggttggattttcagcctggccagggttggctgcctcacctcaggaacaggcttagcctgtgctgccacgtgggtgccggtccttgctctggcctgaagggagggggccgggaaaggagggactgatcctgacccaaacccctaagtaaactgccctctgcgtccagactggactccccccagactctgtccaggcccttaccactgccctccctgtgcccccagcccgggctgcaggaactattggctgttcagccagcaggagcagcaaccatgcaggtgtttccagctgttaacgtgtaagccctgcctggccacgtgcttgctcttgccttttgtgcacagccagtgccaagggggagaggaggcagcagagacgttgtgcggaggggatgcccaaaggggactgcccaggctgggacagccctgatggggcaggggcgttccaggaaacagcaggttttgcctctcctcctcttcccaccccactactcccaccccattttcccggatcaggaaaaggcaggccagcattctagggaacaggaagtgaagttggcttccagctaggtgcctgccagggcctggaggaaattcctgcaggcctgagcccgtctgggaaggaccagtttctctccttgtcctggtgtcctgctttctgagtttcccctgagggtgggggagagctgtcactctcttcactctatgtcccgcttcctcccccatcctcatggagcactcaaaccctgaaccctcacacctttctatggttgtacccgtccccaccagtttcctctctggaaagtgaagaggaggctgggcacggtggctcacggctgtaatcccagcactttgggaggccgaggtgggcagatcacaaggtcaagaagttcaagaccagcctggccaacatggtaaaagcctgtctctactaaaaatacaaaaattagccgggcgtggtggcagttgcctataatcccagctactcaggaggctgaggcaggagcatcacttgaacccgggaggcagagggtgcagtaagccgagactgtgtcactgcactccagcctgggcgacagagcgagactccatctcaaaaaaaaaaaagaaagaaaagtgaagaggatagagcccactaggggtcatcaaggtgtgggacaggcagcatgttcctacaggaagaaaactctaactcctggttctggttctttttcatctcattcattcattcattcattcattcattcatttgttttgagatggactcactctgtctcccaggctggagtacagtggctcgatctcagctcactgcaatctccgtctcctgggttcaagtgattctcatgactcggcttcccaagtagctgggattacaggtgcccaccaccatgcctgattaagttttgtattttcagtagagacagggtttcactgtgttggccaggctagtcttgaactcctgacttcaagcaatctgccaacctcgacctcccaaagtgctgggattaaaggtgtgagccaccgcacctggccatctcatactttcacaattcattctttggtgcaagttttacaatatacattctatatttgtcaagtgataacttccatgtaacttataaaatacacataattcaggaagattgtgctaaaatacatttaaccaataggagtatgccgtcagaatattttggcaaacaagggtcactaagttttttctgtaaagggccaggtaggaggtatctcaggctttgtggccatatggcctctgtggcagcagctcagttctgcagttctgccatgaaagcagccacagataagaggtaattgagtgggtgtggctgtgttccaataaaactttatttctggaggctgaaatttgaatttcagagaaatttcatgtgtcatgaaatattattcctcttttggttcttcttccccccctccaccgccccctgccaagcattaaagaatgtggaacccgttcttagcagccggctgtgggctggatttggtccatggaccatagattcccagcttctgctctagaccacccgttctcagacttgaagcctgcttcagacttacctggagagcttttttccaaaatgcatattccagaaccccagccctgattttgtagattttctggaaggccccagaacccgcattctaacaaggagcccagttgagtcagacacaggtagtctggagtccacttttttttaaacagagtctcagtctgttgcccaggatgcagtgcaatggcgtgatcttggctcactgcgacctccgcctccaaggttcaagcaattctcgtgcctcagccttccgagtagctgggatcacaggtgcctgccatcatgcccagctaatttttgtattttcagtagagacggcatttcaccatgttggccaggctggtctcaaactcctgacctcaggtgatccaccagcctcagcctcccaaagtgctgggattacaggcgtgagtcaccgcgcccggccaggagaccacatgttaagaagcaaagctcaagggtctccaggatcctggtctgttctcttcagccagtcctgaggcctggggtgtgcagtgctgtgggagacccctgcatcagaataactggctccttcactaccttccaggagcttccatccagtgggggtgggggacaccacccgccaacagcacagcccagtcccaggtgctatggaagccctgggttcagcctggagccagggccagcgtcccgaggatgaggtgccgagatggaccttgaaggatgagagaagcctggactgcccttgagtggcgagggtgggctgcctccaggttgaccttaatcccttccctccctaccaccatgtgtccagatgaccttgggcaggtcccttagcctctctggatatcgggatatgacattgactacctcagagacttgtggggaggattcggcgagctgatatgcatgaagtgtatcaactagggctgctggctggtatctccttcccttgtcttcccccaccaccccagccaggggacagggtgctgctgagggagtgggctgggagagtcacttctggccttgtcttagggatctgagaacagggcatgggccccgtgtctgggagtgccctggtgcccttcctagtggggttgggcgtggtcagtctggccagggctggctccctcccccataaataggctcacctggaggtcttttcccatttgaggcaatgagatatgtatgtgaggctttatgacttgtcttttttttttcattttgagacagagtcacggagtctcactctgtcacccaggctggagtatagtggcatgatcttggctcaccgcaacctctgcctcccaggttcaagctatccttttgcctcagcctcccgcgtagctgggattataggcgcccgtcaccacacccagctaatttttgtagttttagtagagacagggtttcaccaagttggccaggctggtctcgaactcctgacctcaagtgacccacccaccttggcctcccaaagttctgggattacaggcgtgatccaccgtgctcggcctcaccacccgcctttcttgtggtgtagttcttgctgcctcaagaactacatatatcaggcctcaaaacccacctgatatatgcgtgcctgggaatagggaccttgacttttcccctgtcccatatgggcccaggggccggttctgggctggcccaggtggggctagagcagctggatccaggcacatgagatgtgaaagtgtgggccttacgccgcatggagcggctggaggaaggagagagggagcaagggtgccgcagggtcagattgccacagggccagggtgccacagggtcagggtagggccagggtgccatagggtcagagtagggccagggtgccacagggtcagggtagggccagggtgccgctgggccagggtgccgcaggatctggttgccacagggtcagggtgccgcaagcacaaggagtcacccgtgattctccagggtctggctcttgggctgagatccaggagaccttggcaggcctgtctttgggagtctggcacagccccagaaggccatctggacagttttcagacctgagaggaggaaagggcttgtgtctggagaaggtgccatgggggatgggaggtggaggaagcctggggccaatcaggatctggatctagcagggaacaccgaggccggtgttctcgtcccaccatgggactcagcctgaagaagacaaggtgaatgaacgaccatttctctctaactcagttggctaagaggactgagctggcgccgaggctctggacacaaatgggccagttgaccctgaggtttctttctggtagtggaggtggggcttcctctggctgaccctgcttaggtctctgatggaggtagcaggggctctggttcccccaaactggccaagtcctccaccatagcacccaaggggtctgggcagagtgcagcttccctcccctccccagcttggcttggtgggcacctgcctcccctgccctcctgaccttgatggctaatgcagccagccccaggcaggcacagtcacagccctcaaacaacatgaggcccaactcaagactcctgggtggtggtggtcaaggtgggggactctgtagccagtagagcactgtgggggcaagagactgacttgaaggcttggagcctcacatgcccgcctagtggggtggtcctgagggatatgacttctttgggcctctctgctcatttttggaacctgacccgagaaggagcccatccaagacaatgtcccgccctcagggagggtctggcagtttttatccctaaaggctgggattctcagcggagcatcctaggctgtagtacccacgacatcttgcacacaagaggtggaatcgcctgttgatgaagagcaaggctctggaatctgtgatcttgggccactcacttcacttatcaatcccttcgcttccttcttgcctgttacatggggtctgcaatctacccctcaggggcgctgacgagctcacatgagcctgtgacataaaacacctagcacggccctggcgcagtaagagctcaggaaacgggctgctgctgtggttactgtggacccaggcggaaacagagcagccccgcccctgccgcaggcatataaaagtgaccacttggccggtcacggtggctcacgcctgtaatcccagcactttgggaggccgaggcgggtggatcacctgaggtcaggagtttgagaccagcctggtcaacatgatgaaaccctgtctctattaaaatacaaaaaattagctgggcgtagtggcaggcgcctgtaatcccagccgcccaggaggctgaggcaggagaatcacttgaaccctggaggtggaggttgcggtgagctgagatcgtaccattgcactccagcctgggcgacagagccaaactccgtctcgaaaaaaaaaaaaaaagaaaagggaccactcactttggtctgattcttcagttctcatggtccttttacatcggtcatttcattgcattctccaacagtgtctgagggagactggtgtctcattttgcagaggtgaaaactgaggcttggcaagattaggtagcttgtccaaggacacacagctggtgcttccagagcgagacctggctttctgtacccaaagctcttgggtagtctctcccatcctgggatcttgagggtcacgggaaggaactgggtggtttgcagtgggacccttcacctagtgccttctgaccttgcagataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccgggtgagtgcaggtcctgttggtgcagatgacctgaggcgaggccagtggggtggggaggaagccaggagaagacagacagacagatacaccttccggagccttgctcttaatcaacaggcgattatgcctcttgtgtgcaagaggggaccagaggacctgaggccgggccagctggggtggggaggaagtcggcgagagacagacacacacacacacacacacacacacacacacacacatgcacgcacgcatgcaggcgaggaaaagactgcttcccaagaccccaagttccattctcatccagaatgaggacgtgagcaccagggtcaggcctgtactgggccaagaggattgaaaggagaggcccccaggtcatggggctcagagcccctgcgtgggatacaacacacaggcaaatgtgcacacgtggacatcagcctttgagctgtggggcttgagccaggttgggggcggggtggaagtgcatggtatggacttctcgggagctctgggaggggctgggtttggcaggacagtttccaagccctgtctcctcccatcttccagtttaccagcagccccagcagcagccggtggcccagtcctatggtggctacaaggagcctgcagccccagtctccatacagcgcagcgccccaggtggtggcggggtgagtaaccctggccggaggggagaggccagaggcagggggtccttcgggaaggcttggacacagctcatggattctcctgacctttgcacccaccctctgttgtgtgtgatgataaggatctcagccttgtgagcagagaggaaattggttggcgtagtgggcagaggctggctgggactggggccctgcgttccagccctggtgtaccatgggcaggttgctcaccctgctttgggtggggtttccttaccccagctacctgggaacacacaaggcaactttctgcatggggccttccagcactgggcgctgctctcctcgcttcatgaggatggcccccacatccttcagctctcaggctgcccctgcctctgaggggcctccccagccatgtcgtgtaaagcgcatcaccctgatgctttgcatcactcgactccgctggctgccttcagagcactttttccaactaaaaagagctcttcgtgttggtcaccttctctgtgtcccctgctgggctggggaccctggcagcgtccgtctggttcacctactctgagccaggcctagagcaagtgaataagcccagcaggaatggggtgagatcaggcttcctgagccctcagagctgaagtcccggctctgtaagtcctgccactcactccacccatgggtgccgctgagccacccttaccaagctcctggcaggctcagcgcctccaggctgggtgcctgggaattcaaagtagctcacgtaggagcagaacagatacttagagagataaaatcgcctgagataatggctggctggagtctgatgctctgggcacacaaacaaagggatgttaggactgcccagggcactgtgggcgcaagagttagtctgaagtataaggttccaggcagcccagccagtccctccctcctcaatgggtctgtcctggatgtgtagggtccatctctgaatataaagccacctctctgccctctgggggcttacattccagtcagggggacaaacaagaaaacaataagaaaataggtgtataacataaggtcagcggtgacacgctgtgaagagaaagacagcagggtgagggatggatagaaagcagctggattaagacatttggccgggggtggtggctcacgcctgtaatcccagcactttgggaggccaaggcgggcaggtcacttgaggtcaggagttcgagatcagcctggccaacatggtgaaaccccctgtctaccaaaaatacaaaaattagccaggtgtggtggtgtatgcctgtaacctgtaatcccagctactcgggaggctgaggcagtagaattgcttgaacccgagaggcagaggttgcagtgagccaagattgcactattgcactccagcctgggtgacagagcaatatctccaaagaaaaaagacatttggccgggtgcgatggctcacacctgtaatcccagcactttgggaggccaaagtgggcagatcacctgaggtcaggagttcgaaaccagcctggccaacatggtgaaaccctgtctctactaaaaatataaaattagctcggcatggtggtgcatgttcataatcccagctactcgggaggctgaggcaggagaattgcttgaacctgggaggtggaggttgcagtgagccgagatcacgccatttgcactccagcctgggcagcaagagcaaaactccagctagaaaaaaaaaaagaaaaaaaagacgtgacatttgagcaaagtcctcaataaaggaaggagtgagccgtgcaacgaggacaggaagtgcaaaggctctgaggcaggaatattctaggaaagttcagggagcagcaggaagcccgaattgactagagtgggagagggtgggaggtccgattatgcagggacttgtgggccccaggaaggcctctgtgacctgtgatctgtgcagagcgacataggtttttggaagaccaccctggcagctgtgttgagaagaggcagtggtttgagggtagaagcagggagaccgtcaggaggctgttgcaggatataggcatggatgggagtggctcagcccaagatagaggcagaattggtgatgagagagactgaggttacttcatgggaggtgtgacttcttatcccatagacctgttggtttcaaactgtcctgtggagcctcagagaccagtcaagggcagtgaaggtcaggggaggtagaatgttgtctatagctataggatttatttttcttttttttttcctctttctttttttaaactccatcctggtagtaggtggcgctgtaggtttttgtgtgccttactgaacattacctagatctagggcttaagcggcagattttggctgaggcttggaaggtggaacctgatagactcgtcttctgtcctctgaagatttttctcccaaggaaagatctttgtcctgaacttggacaggactcatcatggcttctaaaagaaactactggtgcttataatcatacaaataatagcatacagggcatgttttttctgttttttttttcttttttgagacagggtcttgctctgctgcccaggctggagtgcagcagtggtgcaatcacagctagctcactgcagccttaacctcctgggttgaagccatcctcccacctcagcctcctgagtagctgagactacaggcatgtaccactaagcctaactaattttttattttttgttgagatgggctcacgctagtactttgggaggccgaggcgagcggatcacttgagaccaggagtttgagaccatcgtagccaacatgatgaaaccctgtctctacaaaaaagtacaaaaattagccgggcatggtggtacacgcttatagtcccagctacttgggaggctgaggcaggagaatcgcttgaacccgggaggcggatgttgcagtgagccaagatcacaccattgcactccagcttgggtgacaaagcaagactccatctcaaaaaaaaaaaaaaaaagagggagttggggggtcttactgtgtttcccaggctgatttcaaacttctgggctcaagcagttctcctgccttggcctcccacagtgctgggattacaggcgtgagccactgcacctggcctgcatgtcgtatttttagacattactctgtcatcatggctggtggaccttactgcagtcctgttcagggaggtggggcagagctgatgtgacccggtccctgctctgcctctggcccttagtagctgccaaaggttgtaaaagatcgattgctctcagaaagcaagacacagaggttaagaatctttgcagcagagcctggtgctccatttctgagttcactgctcccccaggctctgctccagggtcgtggagagttagaaaaaaatgctcagacccaggtgagccggcatgcagggccctaggctgaccacacttcccccacagaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataattttta

SEQ ID NO: 35612 - DNA, 21761 bp, Homo sapiens
aggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtagggcccgtccggagcgggctgcgacccttcccttgcagcccatttctcggctccccacacgtatgtcggctctggcaacctggctgttaaatcggcccttcaatcgctgtctcccatctgtgtagctcctgttttcctccctaatcctgcctgcaccccatttctgctgtcattaccggaagtttgtcctgcactaccctgtgataggctgggggacacaaagatgagaaagacgcgatccctttcctctgggagcttgccgggctgcaggggagtcgagcactcggaggaggataggggaggatatggatgattaatgcggggtcctcacctaagggagcgtaaggggggattgtagaaagggaggcgcagatacgcgagtccacaaatgattgattgataacccttgtttactaagcgcctctcggggccaggagcgcagtcttcggggagtcagacaagtagacgattccactgtggtataaaaagcgtcacgaaggcagctcagggagtagcgagacgctcaggaatgctgtctgcctatgttgagttactgtgtccaagacgctgccaagagggactgggttagagaagaggcaattaggtgtctgcctaccagaaactgaccactcagtgcagaaaacggggaattcgtggagtgggtgaagaaatgagactgtggacaggagggggttcgcagcttacagagaggaatggccctcctctctatgcttcccccctttcttttaattacatacctaaccctcttcacgttggtttttcagcctaagaactctgtttactcaacattctaaattgcttgatgattcccaccacacctttcccatgtatgatttgagtatatgccctcccccacgttgttttatgagagcttttgttgatgttgctggtggtttcctcttcgtttttccttcatctcctctatgctatttgcttaaccattgtggctggacctccttgctctctaaaactggagtggctacggagacagttccagtgaagcttaggatgttccatattggcgagtattttcaggtctttgaaatgaaaagttctaagtgccggcacttctcagattttgttacggctggattttaaactgcatggagattatcaattttcaaaaaaaagtgtgggagaagggactgtactaaatttttccagagatttatgtaacaatcgagaaagaagtgagaagttttaacttcagacttaaatcaatgaatactgcttctaaccacgttatttttctccacctcttgtaaacttctcatcattaagaggattgtatgaagaagctcattaatattgatttggcctggaattgggttgagacttactttctattgttctagggtttgtttccttttttgggattttctcggcaattttgtggtataaaccagaatgttgggaaaataatcaaataatttgaaaggataccttcctggaagttgtaggtactttaataatgtccactattttctaacaattggtgttatatctataaactatttttacttatttattaaagcttttctcacaaagaactccaaatcatctggctccctataggtcctggacttgaaatttatatagactccactgttagccagagtgatgggagatttatcataccattatccctaattctcacaacaaccctgtaaagtagggttttaaaattaaggaaattgaggctctgaaaggttaagtgacttgcctaaggtcacatacccaagaaatagtggagcaggaattcagcttaaaactggctacactatgctgcctcctattaataaacttgcattaaacatattcggccgggtgcgatggctcacgcttgtaatcccagcactttgggaggccgaggtgggtggatcacctcagctcaggagattgagaccagcctggacaacatggcaagaccccgtctctggaaaaaagaaaaacaaaaaaactagccaggcatggagacgagcacctgtagtcccagctactcggtgggaggcttgcttgagcctgggaggcgcaggtcgcagtgagccgaaatgtcgccagtgcacgccagtctgagaatgagaccgtgtctcaaaaaaataaaaataaaaaaatgccgggcgcggtggctcactcctgtaatcccagcactttgggaagctgaggcgggtggatcacctcaggtcaggagttcaagaccagcctggccaacatggtgaaaccctgtctctactaaaaatacaaaaaaatttagccagtcgtggtggcgggcgcctgtaatcccagctactcaggaggctgaggcaggagaagcgcctgaacccgggagacagaggttgcagtgagcccgcgccaccgcactccagcctgggcgacaagagggaaactctgcatcaaaaaaaaaaaaaagaaacatatttaattatgtcactgatttctattggctctcctctgtgctttgtgctccaggaaaaagcactgtgtattgtaagaaattagatgaattttcaaactcacatagcgtttgaaaaacgagatagaaatctcgttttaggctgggcgcggtggctcacgcctgtaattccagcagtttgggaggccgaggcgagtggatcctgggtggtcaggagttcaagatcagcctgaccaacatggtgaaaccccatctctactaaaaatacaaaaattagccgaacatggcgcacgcttgtgatcccagctactcaggaggctgagtcaggagaaccgctggaacccgggcggtggaggttgcagtgagccaagattgtgccactgcactccagcctgggggacagagcaagactgcatctcaaaaaaagaaaaaaaaaaaagaaatctcagacactttttgagaactaattatttgttgcaagaaagtagaatacctgtttgtaaatagttatttttaaattattctatgttttatctacagaagtgcaattgcataatttatctcggtcgaaaaaacaagagacataaatcatgttaataaaaaagctaattagagccagcctggtcattttttaatggagtgtggtctctagaaccatacagacctggttttattcccagctccttgattactgtttgtccttgctgatcacttaacttctatttatttattttttaatttaaaataattgaaacagggtcttgctgtgttgcctaggctggtctcaaactcctgggctgaatgggtccttatgtcttgacctcccaaagtgtcgggattacatgcatgagccacggtgcctggcctaaatagtaccattgagggaccttctaattatgaatttagctggtatttcatatggtggaagcactatttattgtgtcctaaatcagaggagatacatgttatataaacttgccagtcatttgggatacatagggcatgaaatatttacttgaaatcattatttttgtatatataacatgaaatacttagaataaagatatgattcttgatagctaccagttgagtgcctgctccataccagatgtttcataatttgttaagtcttaatacagtgcctggcacattgtggatgctcattaaatatgtctgtctattagatagtactacatagtagtaatgctattgtagatataaatatataattctcctaatagtgaagattgacactctgcaattatacaggcagtagaaaataaatgaatagtagttaggattgatgtaagagtattgtccttattttacaactgaggaattagattaagtaacttgtcaaaggttgtgcagaataagtggcaagtctgagcttcaaaccagggccgattcctgaaacctcggctcttttcaccatgccatatggttttccgaaattggtactggatgacttattaaaggaaagcatatctgagaatgaaatggcatgtggtatagctcatactaatgagcttatgcttcctttgtgcaatataaggaaatatgtggtgctccagagacataaaataattctttaactgttttacaaagcctgcaacagctactcagatatgaaatctatctcaattgttaaaattctttcaatttcatcttaacagtaaatgcagttggaactgaggtccaaaagtgtgctaccttcaaagttgtatgataaagtatatttaatattagactgcaggcatctcttcttgatggattgttgctgctgcgtaaattttactaatccttttgctggaaagaaatacatagcttgtatttcattggttgctaactggtatatgcacatgctgtttccttattaggtgtctgccagtttgtacacagtggatcacatagtaagtcgagggggctcccccatatgcaatagctttttttaaatacttttattttatcaaagaaaaacagctgaagacattagtcttattaagcagttaatattttacagtaatgaagaaccagatgtccatcctgtcttaagctttcacacgtatacattgatgcctgtaattgttttctattttaaaaatctattaacactattaccatttattaagcaccttctacatcccaggcactatactggaaatagcttccaaattattgaggaatttggagataatggctgttctctccttttttgatgagaaagctgagattcttagacaggtaaaataacttatgcactcacccaaaaggtttgatctaggtctggctgattgcagtgtcctttcccatacaccacactgttgctcctgtgttttcatttaatgtaagcccagttttaaaaaatcccttcatataaacatttttatagatgtataccttactttatcaggcccttgtgtcaccatttgccatgtgaagctagtctgatacttttcctgataagcctggtgattcatataaacagggatgtggcagaagtatgccattggtcctagggtacttgcttactcctatcgctgttaaagttctagttatatcaccgttgtgttttttgttgttgttgttttttaagcaacagggtctcactttgtaccccaagctggagtacagtggtgtgattatagctcactgtaccctcaaactcctgggctcaaacaatcctcacacctcagcctactgagtactaggacaacaagtgtgcactaccatacccagttatttttgtgtgtgtgtttgttttggtacagatggggtctcgctatatagtccaggctggcctcaaactgttggcctcaagcagtcctcccacctcagcttcccaaagccctgggattacaggtgtgagccactgcacctggcctgtcactattagttttatttttaatttttcccccccacagattgtaaccaaagaaaatggaaaaagggtggtggttttacctactaggcttttttcttcgtatcacttttaaaataaggaactaaaacctctatatggcaaaggtcttgagtatcaactggctcctatcatttttttctttcagttatgaaacttactggacgatttgtaataaactttactaactgctttcttcctaacctgttttcccctgaggaaaaaaaaatactattttttggtaacccttcctgttcttgaactccctaggaagaggagttgtacgcatgtcagagaggttgcaggctgttttcaatttgtcagtttgtggatgatggaattgacttaaatcgaactaaattggaatgtgaatctggtaagatgctatgctaacgacatcagctgtatgtaacattgttttctttgtgataagcttttgaagtattttctttaggaaatggaaaacacactgttgaaactagtcatctaacatattgtaattattatggatctaagagttttcgtagctgctgctagaaatttcatgggctttaaatttcatctgtttgttgagacagtgtttattttctgctatgaataggacacctttgtttaaccaagcattctgtcagacaaatgcagtataattaccctactcacaattcattactaccttttcacagatagtataattttcctaaacctttcaatcataagttcatcgacttatctccaagttttttactgaatcaggcctttgactcagtatttaatagcatattattcattggtcaggccattaaaataagtagccagaggctttgtcatctgttaaaccacttttctttctttttgctgaaagcaatatgtttaacaaaagaaacctataatcaggacacaattgacgtttaactttttaaataactataatggaatattctccactcgttacactgtttattagtgtagaaggaggcaccttttcccctatcactatgccatggctcacatacagtcttctttgatatcataaccgtatttttgcggcttagtctcctaactgatcatctttatatatgcataatgctgtccagtttattatctagcacttctgagaagtgtattacaaatgcattactgagttgggaaaaaataaaattaggatagtggtaaaatgttatatcacaagaaggaaatggatttaatgaactaaatgagagtatatctggtagagacccatttcaacattagaattatctgctgtagaacattttctagttcaattttcttagactttcagatgttaggctgattgttttatttttcttttgccatgtgcatacccttacttcttaactgagtgatctggttcttaacaataataccttatatttgtataaatcattaaaatatattatttcattcaaccctatacaataggttgtggtatttctattttacacatatagaaatcaatagtcagaggttaaactgctcagctcaggtcacacacaccaacaaatgatggaactaaacctttttgagtggcatcttcaggatgccaatccagtgcattttccaccacacaaggatcctcttatatgaatgtcatcatgtggccagagcctgggtgtataattaatagatttgtatctaaaacatttgacttgtaggagggagacaatatggagttctgttaaagatacatttcctactactatattaccaaatttggaaattcacattgatgaaacctttttaagtataaaaatttttttaataaaatgccaaatccttttctttcctctttccctttctcttttgtttcttgtaatttgactatttttctcttacagcatgtacagaagcatattcccaatctgatgagcaatatgcttgccatcttggttgccagaatcagctgccattcgctgaactgagacaagaacaagtacgaaacaatactgcctttcaaactagcctgcttagatggcactgacttgtattgcttgaagtgtttatcacccacttgatcctattttagtgttatattttatatttggctttcagcaaacaaaattagtttgcaaatagaaaagtcagttgaataattgcttttgtataatgctttactattaaaagttatgcttacgttcataatcttattttgtttcttctcacattccagtgaagatattatcctcattttacatatgaaaaaaccaaggctcagaggaattatttcagagttctttttctccatcccaactcccattggacagttgccattgccttaactcagataatcatttcttgtctgtatttttaaattaacttccaaactgtttttctaatttaaccctgtctaactccatcctttgctgtgtccagatttttttttctaaatttcatcatgccattctcctgtcttatataatcagtagctcccaattacatatagatttaagtccaaactgtttatcacaacctactcctgattactgctccaatgccatctcttaaaattcctgacaagggaatttcatactctattctccagacatactgggaaaagtttcttaattttattgatttttgcacaggaaatagtcacatgtacaaactcaaaagataaaaagagtatacatatagtgaaaagtctcccactcctgtctcttagccactcagttttccctcttgaatgtagccaaggttactaatgcatagatatgttatgcgtatacaaggatgtacacatatattttgtaaatataagtatacataaagagcttctactaatttttttctactacataatattctgtgtagatatattataattttttaggcagtcccttatttgtgaacatgtaggttgttcctaatctttttcttttgtaaatgatacctattttgcacatttgtgagtatacctgtagaataaaatcatagggctagaattgctgagttaagaggtatatgcattttttatttttatgttttttagagatgaggatctcactatattacccaggctggcctcaagcttctgggcccaagtgctaccatagataccactgcactccagcctgggtgacagagcgagacactgtctcaaaaaaaaaaaaaaaaaacagatgaaaaaagaaacaaagcagaaccaaagctatccctagagtttagtaaatggcatcccacacttgtgctttagagaggcccagtgctgctaaagaagtcaagaaatcagaattggaggaaagatgatatcatttgtcaaaatcctttttttttttttttttttgtgatggagtctcgctctgtcgccaggctggagtgcagtggcatgatcttggctcacggcaacctctgcctccctggcttaagggattctcctgcctcagcctcctgagtagctgggactacaggcgtgcgccaccacgcctagctaatttttgtgtatttttagtagagatcgggtttcaccatgttgcccaggatggtctccatctcttgacctcgtgatccacccgcctcagcctcccaaagtgctgggattaccggtgtgagccaccacgctgggccattaaaatcttatcagtagcttactacatatattcagcccataaatactcccttcaccctgtcgtgttgtcagatgtctaccattttatatatatattcttctgattgattttttccgttctcttttccattgatgttcattatagcatgatttattcttgatgaaagcattaaagatgagaatgatacgatttgtcccttcccgttctacccttaaggccttgctggtccttatttaattacatcttaagagtcttcttatttttggacttaattcaaaagcctgttattctgatagaggtgacaggtagctagtaagtgtgtttggtggcaaattaaagtatccttggtttttaagctttaccataatgtgcatagataactaagagtttactctaatgctattgattatggtagatgtatttaattgtttgtatcctgtcccaataaggattggagtaatcttgattatattgttcttttgaatatacatatataaaaataatatatttctcattatttattttatttttagcttatgtccctgatgccaaaaatgcacctactctttcctctaactctggtgaggtcattctggagtgacatgatggactccgcacagagcttcataacctcttcatggactttttatcttcaagccgatgacggaaaaatagttatattccaggtgacaactgagcttcatggattcatctaaatactaacaacagtaaatgtatatgtcttaaatgagtgtttcagcatagaaccatactcagtcacttacaaatatttatcatcaaataataattacttatttggccctacattaaaatattagacatcagttttattacccttccctttgcccgttagaagcctaatctaaagcccattagtttttatgtaaccagaactcttgagtcttttaaattttatggtggttaaattgataaaatgaaatttttaaatatgagagacaataattaatatacttcgaacataaatagtggccatatatgattacatatggatatcagataaaagcaatatgacataatttttagttttttacagtgcttttactcatgactctaataagagaacttgttgaagaagtattttgcctagagaagtaatgtctcctatctcatcgtttaccacatgataataactgttattccctggaggttatattgtgctagatatattctctcacatcttcaaacaactttatgaggttgtattattcctgttttattatgaggaaggtgagagtaacttgttgcagtttcacggccaataagtaacagaattaagcttcaaacccagggcactttagcaccaaggcccatatactaccctaccatgcttttaattcagtagttgaattcctcaaatttaccagtcaacagagtttatgttgtggcactgtcttcctctcaggtaataaagtaaaccttttaagtactgtagctaagtaagtggcttaatgtatggctggtatgtgatttttagcactcccctgaaccttgggtcccctctacttaatttggtaataagtaaaacacaggaattttctctttaaattcatgaacaagttctaggtcctaaagctacttacctcaaggcataagttgactctcagagtgaagccctcattcattcctcattagataggagattagctctgtgtctctctaaagtctgtgtgaatttgagcataactgggatgcagaaacccccattctagaggatcagaactatacacaagatgtaaaaagtatggagtgtttggctgtaatttatggattcctcatacttagggaagaatataatgtttcatatgagaataaatagagataatgtgtatttagccaaaagttttggcagtctgataaattattcctgatcaactagaattagaactcatttctgcaaggtatagtatttaatgtagtatgtcatgatttgtccctctctccctttaaaaaaaaaaaaaaacaaaacaaaacgttgtcaggaagttaaactaacataaatctgccagaaatctgtttctttgcaaggcactggctctgatgtttaggaagtgcaattaaaatatattgtggttaatgtgttttattttttatacagtatttctgctactttttctcaatttaaatgtttaaagagatgatttgttttagaacttgttactgaaaaaagctaaagaagtacaaatgacttaattgctttcattattattttagtctaagccagaaatccagtacgcaccacatttggagcaggagcctacaaatttgagagaatcatctctaagcaaaatgtcctgtaagttttattttaagtagcttagataaaaacattagcagtcaaatctggttgtagtagagttggtcatgtttgtttttacactgatggaacataaacagataatttctaaaacagtggttctcaaactttcatgtgtattacagtttggagagcttgttcaaacacagattgctgggccctacctccagagtttctaatttactaggtctgggagaagatctgagaatttgtatttctcacaagttccagattttgctgatgctgctggcctgggggccacactttgaaaatcactattctaaaaacatttagtttgcttcaaaggatgttttgagcatgaactaatcaaatattctggtatttcccaataaattgatcaaataatgaaaaatgccaaaagtgagagtccccattctatttttatttccatgttagaagtgaattttgacttataagaacataaaacatcaagctaaagcagaactcaccttgtgaaatttcctcataccttattttagatactgatttaattagccttctaattattttggtgggtgggagtgggtagataatgatagcacataacataagaccatctttaactttaattagattagaataaaccaaatccaagctcacatgtaattaagcagaaagcatcaatgtcaataagaatttgaaaataaaacaggaaactcataatgtgatagaatattcatttggttttgatgtgctagagaaactggtacacattataaaatgtatcagatgacacaaacaaaaacaattggatatctgtaaagtgtatatatctagaagtagtcatgtgagactagcttttggaatataggatataataaactcatacttactatttcagcagatctgcaaatgagaaattcacaagcgcacaggaattttcttgaagatggagaaagtgatggctttttaagatgcctctctctgtatgtattcctctttattatgtgtataacagataaaatctggcttgtatcagagagatatattactttttattattttaaaattagcacctcaaaagtaaacctttttacttgttcctttccaaagttgtacattagatattttagtttgtttaaaaggttgtaggcatactacttgaataaaacccaggcaggtagtttttttcacagtacaagagcatttttcttgttagaatctcttgatttatgttgaatgtgcttctccacacatttaaattaagctttaatttaacatatgtctgaggccgggcacagtggctcatgcctgtaatcccagcactttaggaggccaaggcgggtggatcgcctgaggtcaggagttcgagaccagcctggccaacatggcgacaccccatctctactgaaaatacaaaaattagccgggcgtggtggtgcatgcctgtaatcccagctacttaggaggatgaggcaggagaatcgtttgaacctggaaggcagaggttgcagtgagctgagatcacgccacagcactccagcctaggtaacagagtgagactctgtctcaaaaaataaaataaataaaataagtatgtttgaatggtttagggatcagatttttgtttttgtttttatctgcatggccagatttgacgctagaagagctggataaagactctagattaagaagggctttgtattctatactaaggaatatcagctctatgccaagagtttttaagggtaatggtaaagtgggcaagtgagagtaggggtaccatatgccctcctaggaaaaaatatcaagccttatgagggtgagaggcaggttttatgaaagtgtgcatgtttcctcttctccaaggagttcagatatggtccctcccccacattttactcctccccacccccaacaaaaaaaggaaaaagagaaagatagtgggccataccacttattgactatcacctactcggtgtcagataccaggtcaagcatttcagtgagtggtaaacaagtttctgctttatagtgtgttcattctagtggactgttctatctcaagtataaaactgcagtagtccaaatcacatgctccctgtaatttcttatagaaacagtttcttgagaggttttatcatatatcattacaattatgtggaccttacaaattaatactttttactaagcaaaatgtttaaagactatgtgagaaaacaaggattaaactttaaattttatccttcgttcatttctaaacctggttttgagcttgtccaaaaaagggcagtttttctttccagtatttaggatgtatgttgcagtttgatagttctgtgaaacctaaataattatttaatcttaagttacagttctcagtactgtactacctggcatattattggtgatttattgacctttaacattttgtcattatatgttatgttgtttttttacatctaacactttaaaagtaattttgtgaagcaactaactttataatgtatttatagaaatgtatttcttagaagtttctgtgcccaaacataaattataataggatcctacatttgaataaaaattattcttttggccgagtgcggtggctcatgcatgtaatcccagcactttggaaggccaaggtgggaggatcacttgagcccagaagttcaagatcagcttgggtaacatagtgagaccccatccatctctacaaaaaataaaaaaattagctggacatggtggcacacacctgtagtcccagttgtcaagaggctgaggtgggagaatcacttgaacccaggaggttgagactgcagtgagctgtgatcgtgccattgcactgcctgagtgacaaagcgagactgtctcaaattttattatttttttaagtgttctttttttaaatgctttttccccttcagtgatcccatttgacttttagaacaataccctgtgataagtaggtggtgatttagagaggtgaattgactactcgcaaggttatacagtcactatgttagcattcaaacctaatttttctaactgtacatcttctgctcatcctattctgctgtaactatttacttcctaaagtgtcatgatttttccatgattacatacagaatcactcagccagttattggaatctggtcgtagctgttaaagagacacccttgtctccagaatggaaattgaggtcactctttcttcacttgcatttctttttgaggagccaggcactgtgctagggagttgagacctagtaaagatgtcaggagttctcagatctaaacagacatggacaataatgattgctatacacacacacagtcctacacatgtctcatacacagcatataaggactgtatttaagtctactggaggtttcaaggggaggattgacaggtgagatagaaatatctcaagtgatgagtagaaatttttgctagttatagcagaagatttacttaaaatttttttttcagatatactggcctcctgctcaatgtgtatagggtacattactatatatggaggataaggagagtcagaaatttgactgaactgggaaaacaggaatagagagaatcaggaacataagtgtcaagaagaggcttctatgtgaaggatagattagaggaccaggttggagaactttggtaaatcagggaagaaattatgaggtctggattagggcagtagataagaacaggagataatggagatagttgaaaatctgtaggatctagtcattgttttgttgtggagattgaagggatgagccccagttttctggcttaggtagttgctactggaatctagatatcaaatatatcctcattttgtggtaaattccttagtactcaggttacttagggctggaacatggagaggaaagtgggtatttgttcattaaaaacatattttactctattatctttctaaattggatacttaaagaatcatatgggagttccctgcttttagatacaatacattctccaaagtccacctcttttgctggcagacaaacaatgactgtgcttactgcatgttcaagtcttggcaaactatcaagtgagtgattagggtggtaagtatagatctcttactaggcagtgttggatgagcagagatgtgaaaattagggagtatctgtattacacagtttgtcagagttagacttttaattatttaaaaatggcttgactttttcctattctttgaatcttaataggtcaattatgaaaaaaactccaggtgggagaatggcttgcgcccatgagttcaaggccagcctgggcaatatagtgagagcttgtctctataaaaattcaaaataaataaaaataaataaaaaatctctaattgctgattctcataactggccttctgtcttaagatattttaattataaggaaaatataactatctctttactgagatatgctgtaatggttacagaatgccttataatagctgtgcttttttaaattgaagtataagtaaattatggcaaattgaatatgtaaagtattctagggaaactgacttctggaagcctggtgtgaattcttttataaaacaaatgatcattttaaatttacctattctataccttaactttttggtatattggttttcttaaagcaagtatcgtaataacttgcaaaataatatatgacatttgtacaacagtgtacaatttacaggacactttcacttgccttatatatttagcagaaagtcaagtatatctgattttattattattacaaaagtgatatagccatgttacagaaacattagaagtggaggaaaaagactttatgccaacctaatgtaatagctattagtataatatttccttctgtaagtatgttttttaatagtttcaaagataaccaacaaagttttaattgtactgttgagctaagtacataaggttgactaattaagaatttcctgtttcttataaaattttaatataactaattgttgattttttttttccagtaactctgggtggattttaactacaactcttgtcctctcggtgatggtattgctttggatttgttgtgcaactgttgctacagctgtggagcagtatgttccctctgaggtaaatttaattcttaccatttgaagactgagccctgtgatatatcattttaaacaccttatttgtttagctggaaaaacaaggcctttctactaatagaaagagagaagatgtggtggttttaatgtggtagaggttggcacacataaaaattacaggtttgcagcacaagaattgttgttctcagctttctgtgatgctaactaccgtggtgacatatatgttgactggcttgagaacggtgtctctttctgactctctaagactgaaaagacctgttgacatcagtttctaggggatatatgggaaagaagactttttttttttttgaggcagagtctcatctgtcacccaggctagagtgcagtggccaggatcttggctcactgcaacctctgcttcctaggttcaagtgattcttcctcagcctcccgagtagctgggactacaagcatgcgccaccatgtccagctaatttttgtatattcagtagaaatggagtttcaccatattgaccagtctggtcctgaactcctgatctcaagtgacctgcccacctctgcctcccaaagtgttgggattacaggcgtgagccaccatacccagccagagagaagacttgtagaaccacttaatagtttaaattaattaccacaatattaaggatcagtgctgctttagaagcagcaaggctgggccaggtgtggtgctcatgcctctctaatcccagcactttgggaagcctaggcaggaggatcacttgagctcaagaatttgagaccagcctgggcaacatgatgagatcctgtctctatgaaaaattataaaaattatctgggtatggtggtgcgtgcccgtgatcccagctacttaggaggctgaggtgggaggatcacttgagcccaggaggttgaggctgcagtgagccaggattgtgccactgtactccagcctggtgacagaacaagaccctgagtctcaaaagaaaagaaaaaaaaatgctggagtgtttgattttgagttgttatattctggtatctaaccccaaaagagatgggagacattgtgacttccttggtaattaaaatttaactggcccaaaaaatataactgttaaggtaaaggatttttgtttgggggaaaggctataatttaattattcaacttagctttcaagaacagaaaagtatttatataactaaatatagaataataatggctgtcaacatctaatccaactgaaataaactttagttttcttatgcctccaaagtaccatagaaaaagagaaaagacagaaattagaatctaataataagccattggcatgtgcctaacatggtgcctgaacaactgtcttatcctaatagactataaagatgtttaaatatatgatttgcacatgaaaaatgattaagataatattacacttaatatttttattaaggtgatataattgatgtaggtacctggaaactgggacaggataatgttgataactaacatttatatagtcgttaaaatttacaaagtattttcatgtatcttcatattcttcccatctaactgaaatgttgtgtcctttaaccaacatctcctcagtctcctacctcccttcagtggcttctttcatgttgatgtataaaatcaaacagttcctggttgctgcttcaagatctttaaatattgttaggtagagttgtgaacatttttctttcacagtgccccagagccaacggtcacatgtgaattctgagttttatggaggcctgctatatcagatccatcagatccacgtccaacccatcaaccactgaactttcttttttctttttttagacagggtctcgcactgtcgctgaggctggagtgcaatggcacgatctcagctcactgcaatctccacctcccgggttcaagcgattcttgtgtctcagcctgccgagtggctgggactacaagcgcacaccaccacacccagcttatttttgtatttttagtagagatggggtttcaccatgttggccaggttggtctcgaactcctgacctcaagtgattcgcctgccttagcctcccaaagtgctgggattacaggtgtgagccactgcgcctggcctgaacttgtcttaaagctactctcatactggaaaagcttaaggtactggggcacctccttgcaggatagttgttcccctgaggcaaccgtccagtagaacacatctgaaacatgtgtgagtaagcaactatcgtgacaatcacttttagaacattttcatcagcccagaaagaaaatctatactcttagtaattgctccccattttctcccaagcagcagcagctgcaccacccctacccccatctcaccctccagccctagatagccaatatgtagtctcttgtgactggcctctttgactaagcatattttcaaggttcatcatgttatagcatgtatcactttatcacttttttttttttttttttttttgagatggagtcttgctctatcgcccaggctagagtgcagtggtgcgatctcggctcactgcaaacctctgcctctcgggttcaagcgattctcctacctcggcctccctagtagctgggactacaggcatgcaccaccacacccagctaatttttgtatttttagtagagatggggtttcaccatgttggccagactggtctggaacgcctgacctcaggtgatccaccttcctcagcctcccaaagtgctgggattacaggcttgagccaccacgcccagccaggatagcatgtatcacttttgataaactcttgaaggtgctctttattcagcatcttttaaaaacacctttccagtatcgggtacttctgtggagttcttgctttataatctagtcagttgtcctgccagtgatatcagcacttcagtttctaacttttggatacagggatttgttgccgtatgagtagattaacaacagaatctataccatttttttttttttttttttttgtgagacagagtctcactctgtcccccaggctggagggcagtgtcgcgatctcaccccactgcaatctctgcctcccgggctcaagtgattcttgtgcctcaacctcctgagtagctggaattacaggcatgtaccaccatgcctggctaattttttgtatttttagtggagaccgggtttcaccatgttagccaggctggtctcgagctcctgacctgaagtgatccgcccgcctcagcctcccaaaatgctgggattacaggcatgagccaccgcacccagcctatgccgtttcttagtggagacttttcactttgcttttctgcctttaagagatacatacggacaggcctagtggctcacacatgtatcccaacactttgggaggccaaggtaggaggatcacttgaggccaggagtctgagaccagcctaggcaacatagcaagaccccatcatttaaaaaaaaaaaagaaagaaaaaaaaaagaaagaaagaaaaaagaaaaattagctgggcatggtggtgcatgcctatagtcctagctactcaggaggctgaggcaggagaatcacttgagcccaggagttcaaggcctagtagtgagctatgatcacaccactgcactccagcctgggtaacagaacaagaccccgtctctttaaaaaaaaaaaaaaaagagacagagacattcatacatatatctaagtctacctactctcaaaagatgctagatattactattattctccaatgagttttatgacatttgcagtgattctgttttatgctttcattcttttagtgtcttcttgtatatggtattaacaattaaggaactttatatatttatgaagacccttctatcagtgtgagagcatttcatgcatattctttgttctcgcagccttttcaaatagcatctatcattttccatacatgttaagctaaaacatttaggagcagaaaaacttgcaccaaattattttaccacttggtaggagagctaagatgttgaaggacttgatcacttaaggcatccatagctgtttttcttgatacccaattgttatactcctgaggattttaacttgagacgtggaacagctttctttggccatccattgggagctgaatcacatatctacaacactttgagaaaaagtattcttctttcttaaagttgtttatagaattttttttaccaactatttataaattaaattgttatttaaagactaacttggagaggttcctaattatccagactactaatgtacattggttttcttttgcagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaat

SEQ ID NO: 35613 - DNA, 23591 bp, Homo sapiens
gccgccacttccgagagcgcctgccgcccctgcgccgccgagccagctgccaggtgagtgcgccctgagtcgcgcggctctgcccgccgcggaggggcgcctgggcacgcactcagcgcctcccggtcttgccagccccgccgcagccccggggctgtcgcaggcggggaactgtgagaagtgaccgcagttagcccgggcagtgctgctcttttctggaggcactaggtccgtccccatcccgggccttcctgggcttcctggacacagttgacttccgcgtgtgcgtgacccagggcgacccggctccccgcaaccgcctgcaagtcgggcagaacaatcggcgattctgcgcgccactgacgctcattgtatggcagagagatgagggcatccgtgccaccccctccctcaccctcctgctggggagaaaatgcccgcgggcggggtggggcaaacatctgggcctgaccttggacatctgtgtccctgagcgcaggtgtgagttttccctcttgtgaaataactgcatggaaacctctccactccaaatcttggtgctaggtggtgatggttactgaaacctgaaagagcctgcagtcagtgttttgtggcctcagtccttgaaagctgggaagtgataaaggggctggtattgagcacatttaaagcaaatcacaatgtgttagctaacaatcagccctctgaggcaggtattgtatctactggtacagactagagaatattttgcatgcttctggttctggtgctgttgtgaactaaccaggacccaggaatcggctggagcaatagtgggctcaggctctgcctagagccctgggctccagccacccaccagctgctccctgagagtgaatgaatgggcaggctctccccacgctgggatactatcacagtggcaccgaggaaatccactgggccctggtagaaagtatatcagtatatcatgaagaggtggcttggagtcttggtgggattgtttggaaggcagagttttgactcttggatttgccacttaacgcgcaggtttccttggacaaactatttaacttctcaatgtctcagtttctttcagggatgctacttggggagcatattacacagaacctccaacacaggagtgatctctcagttactgtctttcttgtcctcccctcatcccttgccttcctcccagaagctaaggaggctggaggtgctggttgtctccctctgtcctctcagactgcatgttggggattttccccaggtgggatttggggatgggtactgagcctcccctcaactgctctcactcaactgctgcctcctgactctccagctggtttctggctacctcttttgagagagactgtcctcagccctcagctgctggagggcagcttttacccattgtttcctaaatccagcctcctcctgctcacggtcttccagtgaatgactctttgccttggagaggatatccggggcggaggcagtcagacgaggaaggaagtttatcctgcagagggtgtagtgtgggttagaggagagggaggagagaactgtctgcaaggcctgagatgcccaggatggagggtatggggaagaagaagcaggagagaaactaaagagaaggcccatcaactctgcaattggcctgctaataaaatgggaaaaacaggggtgctgtggcctatttgcctgtggtctgtcttagcacctgccttcctggcccaggtgtttgctcttttaattgcacacatgtgcatctgcctctggagctagtgagtcctgactgggccagagttgcagcctgggagtgtagtgacacttgactgagtgatcagcaaacatttgatgaatgagtggggtagcaatggtctttcagctgagttggcctacgggatactcataaaccttgcaaatagttactagccagtttttccacttgggtagattgacaagcaggtgagagaaaaaaggcgtaggttttttttgggcttttttgtgtgtttttgttttgaggcagtcttgctctgtcacccaggctggagtgcaatggcgtgacattggctcactgcaacctctgcctcctgggttcaagcgattctcctgcctcagccttccaagtagctgggattacaggtgtctgccaatatgcccagctaattgtttgtatttttagtagagacggcatttcgccatgttggccaggctgtttttgaactcctgacctcaggtgatccacctgcctcggcctcccaaagtgttgggattacaggcatgagccactgcgcccggcctggtgttttttttttttttggagacagcgtctcactatattggccagtctggtctcgaactcctggcctcaagtgatcccctccctgtccccaccaccatctcagcctcccaaagtgctgggattacaggcatgacccactgcgcctagcaacatagtttttaattcactgtccatccctggtgtgggaagcaaattgggaaggcttttctggcaggttgttaaagttttaaatatgtatgtaagcctagcttattgtgaaacgttggcttgctagatgaagacacatgcgttaaatattttgggatccaaagaggtgctagtgagaataagactttttcctccaagtcagccatttggcattactcagggcatattgtcaaatatcaaaagagatacaaacctgaacgataagtgttagagttggcctctccttaagataaggataaccagatatctgcacttgcagtgtaccagacagtgtgagaaatacttcacatgtgttatcttggacaatttatgaggtagctactgatgctctccattttacaaatggagaaactgaggctcagaggtagtaagaaacttgctcaggatcacagctgatcagttgtggagctgccattcaaacataagctgactgtttccaaaacgtatgctcagtcactaccttattatttttctttgctcctctacatttcctttttccagatcaactcactaaggaaatatctgccatttgtgaaacacatcagctttacaaggtgctttacagtggcttataaactatttaaggaagatatctttcacttggatggatcagggttagaactcctgacctccgggttttcagtctgttgcatggccaggtaggagcagaggggacccctgagagttagttcccagccactaatggatatgctttcaccagctctgcatgtttgagtttcagagccaggtttgcagaaagaaaacaagcctggaaaagagcgtgcttgagaaagagagagctagcaaaacttgaggggagggcagagaaggtgaggtggaggggtcctgggttccgactgctgtttctagttgtcaagaatttatatggtaatgacgtgcctgtactacgcagctacccaggaatgtgtctgacgccagcactgagtaattcccatgtatggtaaagtgtgtaaatacgggggcagctagcatttccagactctggtatttccagtgcttccccagggccagaaggcagcgtctgagtcttcagcggtgacaacaggggaagaaatggaaggttagcagctggagctcagccccagctaggcagccagcaccccctacccccgactgtgtgcctggctttctttatgcaggggtggcgtgtgttggtgcttcctgggatgtcagctgcaaacgacctgtgtttttaaggcctaagtgctaatgtgttttaacttgtaaaaaattaatcaaagaaaaatcattcagaccattttgttcagcatggaataaccaacatcattacagatctggataaaagcaaggaaaccccatctgttaatttgtctatgaggctttattataatacaggatttcctgtagaagttttgaaatactacaaagaagtcatcgacctccatttctacctgtgttgaccttcagacttcttttttttgagacagagtttcgcttttgtcccccaggctggagtgcagtggcacgatcttggctcactgcaacctctgcctccgggttcaagcaattctcctgcctcagcctcccaagtagctgggattacaggtgtgcaccatcacactcagctaattttttttttttttttgtatatttagtagagatggggtttcacgctgttggccaggctggtctcaaactcctgaccttaaatgatccacccacctcagcctccccaagtgctaggattataggaatgagccactgcgccctgcaaacttctgaactccaagagtagggagctctgctctagaaggcactgggggcaagtggggaaagggagagacatataccgcccttgtcagctcacagtctcacaagggccactggacatggatttgaaaagagaaagctcattcaatagagagaaggattcctgacctagaatgacagtcaagttctggaggcccatggggcctggattgatggtagctcagtgatgctggttaccttttcagagaggcgggtcatgtgcacggttctgaaggaaacatgaggtgggacatggaaagctgaggccaagcctgccccatctccatggcagccattctccccctacccgtgaccctgagcttcaggagaggctgatttcctgagctctcaggtgtcacttctaagacttggctctgagccctgaccagcccagccccctcctctctctgccctcagctgctctctggacactggggcgtggaggcaaaagccgagctgcagattggaagggatgccagccctcctgtccacctggcagataccaagcagctcagctaatgcgagggagctagataaacatctgacaggtttctactggagcaagtggatggggactttaaccctgtgccgtcagtcactctttggccctagggaataaatgattttggaatgggagagatgggatttttccactgtagaaataaagatatgggatggttttgaagggtttgataagaaggggcttgccttcagacactggtggctggcagttagggattttacatctctgcgatggttccttcaacctgtcacctgagccagactttatttatttatttatttatttatttatttatttattttgagactgagtattgctttattgcccaggctggagtgcagtggcaagatcgctgctcactgcaacctccatctcctgtttcaagcaattctcatgcctcagcctccggagtagctgggattacaggtgcccgccaccatacccggctaatttttgtatttttattaaagatggggtttcactacattggccaggccggtctcgaactcctgacctcaagtgatccgcctgcctcagcctcccaaagtgcaaggattacaggcgtgagccaccacacccagccgagcctgactttcatgagatttggggtgactgagagtctgtgacctttttcttctccttttgctgctgctgtaagagctgccaccttggctttcttgtctcaaggctgaggatctgggtacagtcctaactggggatctgggtacagtcctaatgggacagccaggctaggaagatgcagcagcagacacagcaggcttctagccgccagccgtttcaggaaaacagctgaccaggtgtttccagccattcagtagaaaattcaagctctgttctctgttgagatggtcaacagagtgaaatgggacatcacagacagctggggggagctaaaccccaaagaagggcaagtaacttgtcccagactcattcgctgggctagcagatgaatcaggagttcctggccctatttggcatggtacttcttaagcctcgctccttccatatgtggactagctacatgtggatggctggcccacatctagcagtgtggagtcgacgtatgactggtccagtcgtgtgagtggtagtcagaggggcgggcacttacagtgtgctggccatcacttccatacctcctcatttaatccttacagctgaattttagggagtccatatacggtccattttagagacaagcaaattgacactcagaaaggaaagtaacttgcccaagatcattcagctaggaaggggtaaatccatattgatcgaatcccagctcttgttttcctaaccattgacctgtacagcctgaactctgaccttgggaacttctcttgtcccagccttctgcagggcctctgtgccggagagctgggaaggcaattaagaaggagccaagtgtccctctaaggcactccatgaactctgagaaacaggtttccttttaaggcaattcggcctccctacaggcagaatttggctgttggagagaagggcagaaagggaggaggtggagtgaagactgagccctgcctgttgccagggttccctccagctgagcctcttccccacaggcagggtcacctggaggggtcctcttgtgggcagagggggacaggacctcatccacaggcactgcctgaaacccttcctggctagggatagagtcatcacttttcatctcaaggcaatagagccctgtcctttcactgggctcttgaggggagaccccccaccctcgccctaactaaatgaccaggctcaaaagagcagcctggctaagagacgtcctgagcagattttccttactggcaggtccttgggtttcacccatttctccgcccatgttcttgattccctggggccctgctggatgtgggcccctgacacggagccagggaaaacaaggggaggcctgtatggagctgtgggtctcccccagagggagaagggcttttgtgtctgtaacaaaacagtgcttggaactggctcccaaccatgtggctaggggaattttcctcccttaggggtgttcctaggggcctgagtatgtcccctgctggttcagggggttggaaaaggagaaggccgaggaagagggccagcactgatgtattgtatgcctatcatgagcagcccctcttaaatatgcaagggccacagcatggtgactgggacccagaggattcagaaatagatgagcttgcattagaatcccaggtctatctcttccagctgtgtgactataagcaacttgcctaaccgctctgagccttgcttgtcttgtctgtaaggtgggcatacattctttatcttcggatgatgaggatgaaatgagatgatgtggctgggagcagtgactcatgcctataatcccagcacattaggagaccgaggcaggcagatcacttgaggtcaggagttcaagaccagcctggccaacatggtgaaaccctgtctctaataaaaatacaaaaattagccgggtatggtggtggtggcgggcgcctataatcccagctactcaggaggctgaggcatgagaattgcttgaactcaggagatggaggttgcagtgagcagagattgtgccactgcagtccagtctaggtgacagagtgagactccatcttgaaaaaataaagaaatgggatgatgcagatgagccatctgatgcatagtaggcattcagtccatggcagtgtgggtgccatggctgagttccaagggtcacattgagtcaccttatcagagggagaagagagcttgtgtgggtctgtacaactggatacattattcacaagagcttcccaagcagacctcccctcacatctcactggccagaaatggtctcagcctgttcctgatccagccactggcaagggaatggaatctccatggttggcttaggggacagaggctctgttcctccatctggggaaggggcatctccccagtcattcaatggcctgaataaaatcggggttttgtagcaaggaagaagggggaaatggccgatgatcaggccgaccataacacacattgctgattgctgttcctgtctaactgtccttcacatcgtacggttttcagctccaaacctttgcttgacaagggcagctagcagtcctcagtacagaaagaggctgaaggaacagtgcaacatcagaggctgggaatggggactgtccctggatctgggggctcaggccgcatgggttatctgaggaagacagagatggggatgtgagcagttacagaaattcctgcggggcatgtcagcgatgtgtgggagcctgaggaagtgcggctgctccagaacctgggaaagggagaactgggcttatgcagcaggcatggtctacctagatcccccagcatcactaacaccacttccccacagtaagctctgcctctcagcctgcacacgcttaccaagcacctccactaggagccaggctctgcagagattcaccatgcagagaaaatggccccagaagctgtggctttcgatattagtgcatccttcattcattcctcagctatttcctggccacctatatgaacagccacgtgccaagtgctatgcagagcatggggacagagtggtgaacgtgacctggatcccttcttgagctgaggcccgtgtcaccctcaaatgggagctctccagtaatggagactgtatctccctctgcccttgacattgactctccagctgctggtgcaagccctgttaccaggagggtgggctctcgttgccacatcccggttttcaacatttccatgtgacaggttccgtgagctctctccttaggctcctttgcctcctgaggcaacagatccctctgactcccagcccctttatttcccggcacctccctgtgtcctttactcaccaagtcctgggcaacccccggcaccaagcctgtacccactgtaggtggtgctttgtatagcccttccctcatgaacttctgttgaaagagctggaagggtggtcttcctccttcagccacgtctgttgagtgagcgagtgaaatggaaggagagaagcaggccccatctgttctccacactcactagtgttaccttccgtgctgctctgtggccacgtgggcactgacctgaggcatcacttggacttctgtgtgctgtatatgtgccaagtactgtgccttgcctttgacatatcatatctcatttaatcaccagacatactcggtgaagtcgctatttttatccttttttttttttgagacggagtcttgctctgtcgtccgggctggaatgcaatggcgcgatctcgactcactgcaacctctgcctcccaggttcaagcgattctcctgcctcagcctcctgagtggctgggattacaggcaggtgccaccacgccccactaatttttctatttttagtagagacaggttttcaccatgttggtcaggctggtctcaaactcccgacctcgtgatctgcccacctcagcctcccaaagtgctgggattacaggcatgacccactgcacccagcttttatccttatttaacagatacagaaatcaaggtttggaaagactgactatcttgcccaaggtcacacagctaatgagtggcaggatcaagattgagccaaacctgcatggcatcaggacgccagctctgaaccaacacctagagcatctcaaagttggtctgggccacctgctttgtttgcctggggtgcttgttaaaaattcagattcaagtacctcattctctcaagtatctcattctcagaggttataattcattagatgtggggtggtgttactaaatctgattttgcaaaagcccctcactctgaagtttgataactgccctgtgtgcctacctcctgcctttttttttttttttttttttttttgagacagagtcttgttctgttgcccagactggagtgcagtggtgctatcttggctcactgctacctccgcctcccaagttcaagtgattctcctgcctcagcctccagagtagctaggattacaggggcgcaccaccacacctggctaatttttgtatttttagtagagatggtgtttcgccacattggccagtctgatctggaactccggaactcctgacctcaggtggcctgcccgcctcagcctcccaaagtgctgggattacaggcgtgagccaccatgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgtgatcatcattcccttgcttttctgtagtaacttttccacctatatgtccatcccttggcaatatgagtttagcccatttgtgaatttcctacaaatggacttgcattttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcagtgagtacgccccaggccctattgctgttgccttggacaccctggacgggcctgcccccacaggctgggcctgtcaacaccccagggaactgatcccatgggatgtaaacagcttgacatttggctgaagcgcagctgggcagggaaacacttcagggcctctttgttccgttcagaagcttctttctaagggatgaactggccagagcgggtcggggtggcaggcgttcaggggctgaaagccaagctgtaaagacttggttaagaaaactttccactcagctctctcttctctctctccctgtcatgatttcaccatttcagaggaaaacactttcagccctttgcaccctaattatctcttgttcaaaggcaacagaggccacaacctcatggtgaagctgaatctggaggaagagtggggctcctccttcctcagccccttgcaggctggcctgttcagttcttcacttcccattcccactcagcctgggatgagaggaagagggagtacaaagttccctgatatctactcctaagaagccagagcaaggtttgctccagtcataagcctagatgagtaagaaatcagacaaaagaataccaagcaactgacagaggtcaggtcgacccagggatcctgacaccgtgatgctgcacccactggtacctgggccaggtgatgtttccaggatgtggcaacttggtgaagcctctcctcaggttcctaaatgagttggttcattgtgatcagagcagaaggtctgggttagaagaagaggcaacttcagcaaggtgcattttctttcttaagacagagtctcactctgtcacccaggctggagtgcagtgtctcactgcagcctccacctcaaatgatcctctcacctcagcctcctgagtagctaggactacacatgcatgccaccatgctctgccaatttttaaaaaaaatttttagagagacagggtctccctatattacccagggtggcgttgagctcctgggtttaagcagtctgcccacctcagcctcccaaagtgttgggattacaggtgtgagccactgtgcccgccaaggtacattccccatgatggtaggcagaatggatggtagaagaatgtcttagttaaaaaagattcggtgtttattatctgtgtgatgatggacaagttactcagtttctctctggttgagttttctcattattacggaggaggtaataatagttacctcatgggattgttgtgagaattaaaatgaaagaagcttgtaagacaaagcacttaaaatgattatgagtgttgaagaaatgatatgcacacacacatgcgcacacacgtgcacacgcacacacacacacgcacactgctgagggatctgtagcaagatggtgtgatacaaagaagccctcaccagggtctgaggcccctgaagatggggagatccaagaatggggtcctgtctgttctgcattacacgaagcaaagtttcatgatttgtgctccagagtaggatacagatgggccaagagccacctgttcaatggacgtttgcatctctgcctgtcgctaggtagacccacctgaggccaccccgcacagggcagcaggggccccacatcctgctcagccgggcctggagtgacagctccagggctgcgtctgatgaatggggagtaaacaaggtttagtggagctttgttggcttccagcctgcaaaggaggccagaaacagcagcgtcttgttatcagcagttcactactcttaggaatttccaagccgtttatctttccagagggaataagagagagcttggtgctggctgggaagggggtctaggctgctggggtcctaagggcccctctctttgctctcagatgttgcttaatcactgaccataaggggtcagctgtgggcgggggtgcctgcctgcagacctgtttacggaggagtagtcggtcagagggttgagggaagtcaggaattcagggggtggcataggaaggaaggaacagggcctggggcagggtgtgaggggcgctgcggatgagaaacagttgtagaaagtcaggctggggagcagggctcttggcggggtgcgggggtgttatgcaatgagcagccgcaggaagcagtctcaggtcacgctagggtctcagggccagtgcagctattggatatcagagcaccaagtggaccccctagcactgcacatgtcccagcaggctgagccatctccacaacttgctcattcatcatgcctaacacagcacctggcacaaagtgggttcctgacaaagatttgtttatgaatggaaggcacatcatttctcttttccagtgaagtgggtgataagtgttcaccccattcagggtgcccactgaatcaaaggactttccctcccgaggaagggagaggctagccaggtctgggccaagggcagtaagggccatctccctcattggccaggcctggttgggtccccaaaagcagttgtgaccatgtgggttcttggctccagattctactcagcttgcccacctacatgcctgtattagtctactctcatgctgctaataaagacatacctgagactgggtaatttataaaggaaagaggtttaatggactcacagttccacatggctggggaggcctcacaatcatggcagaaggcaaaggagaagcaaaggcatgtcttacatggcagcaggcaagagagcttgtatgggggaactcccatttatataaccatcagatcttgtaagactttttcactatcacaagaacagtatggcggaagctgcccccatgattcaattatctccatttggcccaaggagagatttgggtgggaacacagccaaaccatatcagtgccctttcctgagtgtctgaatgggcgggaggaagacatgatgatgtcataggcaaaggtggggagaatgacctccaccctgggcttggcctgggaccagggactgagagggcctacagtatactcccatggtcttgaaaggggctgccagatcctatgagcaggtggtggttcagaggctggtgggaaagctcagctccgtggctgggaacctgccctgaggttatgtgcccatctctgagctgtacccagctccctgctggggaaggtgggttaagcagccagccctgaggaaagaagaactctgtgatggtggccgatggaacagggccccacaggttggccctgggctgttccctagaatccaagagcacaggggaagctcacggaagccttgcacactttctgacaccagcgtctcctcacctgcaggctgagacttactgacacttttcaccctcttggccccacatgtgtggcccactggaggggagcaatggctggcagaaaaccaccaggtctggaggtcaggggctgggttctggcctggccctgcatctggccaacacgtgatctggaactgttttgtgggcctcggttttccttccagaagcagagaatcattctctatttctgagtggggcaagggggctctgacctctcccctggggctgccttttccctttatttccaagcagtatcacaagggcccaccaaagtggcatctggaagtatgtgtttccaacaaatccagtcttttttttttcttttccccttattggcttaccatgatatggtagaaatttattcaggcctgcctttaaaattccccttgattgagtctttggtggatcttacaaagactttggtgagttgcagagtctctcagtatatcacctggatggaggtagaggggcagagggccacgatgggcaggattgggcctctgggagaacagaagggccaaggcaaagcagaaaggagcagggaggtcctcggcaggggagccatctggaagatgtcaacttgcaggccctgaggtctgccctgggctgagttcctgggtctcctactggagagatcagccaaaatacacctctgttcccccaagcactctttgctttctgccttctctctggtcttggaattttcagttcaattgggatcttacaggaaaacaattccaggccaattcctgacttcccaccctagaagggaatgttggagcccttggcctgtggttccctctccctccttcttgggagctggtcccggggggaaatggtgggaagttccatatttggatggcccagagtgctggaatgagatggagatctccagagcaggacaagagggtccttatttagtctgaagtctccaacctggggcttagggtgagagaggagctggcagagggatggaccctttaaaggcaagaggatggcagttgcaaggaaaggagctgagagcttctccgagggtggtaaaaggcgtggcttctccagtggtatccctcggtttctatgttcaggacatgtttgaggatgcgtccaactgagatgctgaactccaatatttaaggaatatgatcaaaccgaattaggattacaggacaagtaaagaaaaagaatgcagttgaatctcttgagaggagtatgtgaaagttagaagcaatgatctcttgaagctggggcctgtccctcccacttccttgtctcccgatggtactaactttatataatactaataagagtagccaacatttattatgcatttgttgtatgcagggtattatgccaagtacttcacatgtcagatctcatttgattctcaccaccagcttttggggcagacattattatgttcatttacaaatgaggacacagaggctggaaaggcaaaaaaaacttgcaaatggctggaaagggagagagctgggatttgattctgggcagtctgactcttcatgaccccaggctctgaactgctttaactttatttttatttttaaaagttttatttatttatttatttttaaataaatagagacagggttatgccatcttccccaggctgatctcaaactcctgggctcaagtaatcctccagccttggcttcccactgctggaactacaggcatgagccactgcacccagcccaaactgttttattctggatagctgggcatagctcccctctgagattaacaggacgaaatatgaggcccacagcctttccagctcagaccattgcaatccctagttccttccgttccactctctcttaccccaggagtcaggaagttcttctgtgtctgaccctcacttcttcctgtggtaaagtgatttctgagattagaaacttcaaatcctcttgtgattagcatgagctgcatcccatttcaaagcccaccatgttgggcacttaataaatgttaaacatttcttatggggtatcacatcacctgcatctccccccgttggctccctgccaacatgcacagatagtctcttctggattccactgttgaaggcaggaaaactgcccttcttttctttttcctcctcccccattgggacatatggtctctgttgagggcagagtgaggaacctcaacaggcgtcctgtggcttggggtcagcctaggctgttgcctctgaaccctgtgttgcactgcagcctgaggaagtttaggggtgcagaggaccaaaggagacacatatggattcctggaagaggaattggtgttggccagcatttctagagtcggatatgcagatcccatccctctgtcctcccacccattggccatcccgcctgcctccatttgtagacagttcctgaaagatcaggatattatgtatgcaaagaggccagagagcttcagctgtaagaagcttgcaatgagcaagaaggtcaccccagcttcaactcaatgcgtccgcttccccttcccctccacagtggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggagtgagtaaaagatcccctcccaacctttttcttgagctctctcccccaccctgtattaggcctcatgtgtatttacaaccatttttgggtaagcaatggaaggctcagaaaaccagttatttaaaaggcagtcacagagcagtgtctatgtgtcaggctgctgcaggagctggggatgcagcagggactaaaacaggctgggctcctccctgcaaggagcgtgcattctatatttgtatgagagtcagagctgggaggggccccaagaatcacttagtccaatttcctctttttttgtttttttttgaaagggagtcttgctctgtcacccaggctggagtgcagtggtacaatcttggctcactgcagcctctgcttcttgggctcaagtgatcctcttgcctcaggctcccgagtagctgggagtacaggcatgtgccaccacacccagctaattctgtattttgtagagacagggtttcaccatgttgcctcctctttttatagatgagaaaatccagcccaggctcagtgacttgcctggggtcccacggctagtgagtgtcggagccagatcaggggctcagggcagcaccgttgccacaccagcctcactgtctcagccctgctatctctcactactgagaagaagtcatttccctttcttcgaaatgccatagggtgtcatcagccccaccacacccccctcaccccacggcactccctggcctctgggtaaatggtggctgttggcagtcagcctggcttgctcctcggcctggggggtggacggaaatgatggatgaattaccaagtttcagccaaggtcattgccccagtgggaatgattcatcagcagatttctcctgtaaagaatctgataatagaccagctgcaggaatgaggggcagaggagggcaattcttagcaaatggggtgttaaatgattctggggttaactgggtgaccgagggaagtatgatgttacaatggaaataacattgtgctgaggcttggtttgtccatctgtaaaatgggagatgaccctagaggccctagcctttgtgactttggcagagagaattgcgcgctgctctggcatgagatgaaggtagggtcatgccctctcagtgccagccccacctgtacttacagtgtaagtcacctcaccccatgcccttctccatgcagagcccctggccacaggcccaccaccaaccccaatgcatccaaatttgcccagaagattggtggctccgagcgctgcccccgatgcagccaggcagtctatgctgcggagaaggtgattggtgctgggaaggtaaggtggctgctgggcatgagagggatggggggagatatcttcctgaaatgtggattccagaacttttaaattggtgacctagctctgctcagggcagcctgagcactggggtttaacctcttctctttgtccctgtgggttgcatgtacctgtgctttccagtctccaaggagctcatatcagccatgagcagtaacatccccagcattgatggacaatgggcaattcatagggagtggcaatgatcaatctgtatctctaatataggagaacagaaagtaagggtacgtggatgggctgcagagggtccacaaagccctgaagattatatacaaagtttcatgggaacctgtctgtttcttagaagaagatccatagcttttattaaattttcaaaggatttgtgatcccaaaaatatacattctgtttcatgggatgtggactcccaaaaacccatccaaatacccccagggcagagattttcaaggttcagacctaccagagcctcctaggaggcttttttcacactgtttagaattgccgcacatgcccttcccccatgatattctgacagtagcccccaatcaccaatgcacagtgagaatcactgtagcaaatcaacagttcccaattgagctgatcacttccttcagataggctgcagtagagaagaggcagaactcttgcccctggggtttgcagtgtcagattagcagtcagaaaatcacagaagagatgtctttcagctgtggggccagagaggaattctggagcatcacgtgaggcctgagatagaaaagtgacttggccaagatcacacaacaaggttatggaatgtctgggcctggagcccatcttcatctcttctggattcaggttttggctttcaaggctttttgaccttgaggaatgggataggggaattgatcaagaaatgttaaacaattaacacttaggccagtgttagaatctctactctcacagtcatggttggacagagatggggattagtatccctgttgtacagatgaagaaactgggagtcaggaggattacataatttgcccagatccgctagctaggaaggggctaagccagactcaagcccaggtttgtctgactccgaagcccttgctcttactgctgttactactgttaatgctactttgggccatttagcctcttcaaacccatttccaaggctgcaaaatgggaggggatcctagcacggtgattaagagcttggactctagacagcctgctttgaatcctagttttgccatttattggctgagcgaacttgggaaaatttagccttcctaagcctcagttcttcagctctaaagtgggcctggatggtggaggaaatgcaaagtggaccaagtaatggcccctgacaaataaggcagtttttttttgtttgtttgtttttgtttttgttttcttttggcagaatttcacacttgtcacctaggctggagtacagtggcgcgatcttagcactctgccttccgggttcaagtgattctcctgcctcagcctcccaagtggatgggactacaggcacgcgccaccacacccagctaatttttgtatttttagtgaagatggggtttgaccatgttggccaggctggtcttgaaccagcctggacctcacgatccacccacctcggcctccaaaagtgctgggattacaggtgtgagctaccacacccaacaacaaggcagttttaatgattaaatgagatagtacatgtataatgtgcaatgtagtgcctggtatgtcctcagtacagttttgctattgttattattattgttgtttattttcagggattattttgaggtcacaatgaagatccttgccattgactaaaggatatgaaaacaggagacattaatattattattaagttgggttttttgttctatctcattatgagaatagaaaattattaagaatagctaagaatcactatttccattacttaggcaggctataaggtaaagttagggctgtactaaggagtaggataagagaattttgcattcaagtggaaaaggtagggagaagccccacctttctattgcctcgctcaagaaatgttgagctgggagtacttttgggtgcttatgaatgagcaaagggattcagcttattttggcagggaggtggctaggaaatatgaggagaggtgttggtctaggtgtgattcagtttttctccagcctagagagcttggggtagcagcccctgctttacagaggaggcagcaaaggctgggtgactattgaggttgcaccagcactgacctagacccaggtccccccatttcagctctctggaggagaagccaatgtgcaaggttaggcaaccaggaaatctgaggggatgaatttcctttctcatccaccagcctgggcactgggagtgtctttgcccttaaaaggccttgttttgtcttatctgactgctgcctgcctcttgcttttcctgggttaagcagagctgtctacacatcagcctcttagcctgcccagctgttgatgggaactggctgcggagaagtctgtctgtgcaacgtcccatcactgtgtacaaactcgggcctcactttttttctgggacagctgtttgccctgtgttacagaatgcatgtgaggactagatatttaaacatatgatgcctggccacagagaaggtatttgtaattggattctcctggaccagcccagcctctgaagttctagaattaggtgcctcctttgcccaaaggctatcagctattggaggggagggtggcagtatgtccctcactgggtagctgtgaacactaactgacttcaccagtgtaaagtgcctggcacagggcctggcacagaggaagccagagtcaatgttgtctagtatcactttggaaggagaataagtctatgaaatgcattaaactcagcagggaaagtcctaaggagtagtttctccaggggccacagaagaccctttgggtctctatgagaggccccaaggcaacacagggcagagaggtctttctggtgagggctgttcaagtactaagtgacagtaccaggaggagtgcaaagccctggctcacaccactgatctactggcaagatgggtctggagaaggctcatctggcccagccagtggggtaacagctactttggtgttaaacccaccccctcacctgccttttgtggtatagctggtgaccctaatcatcaggccattgcaacatagcatggaagatggtgcgaggtggcgtgtggtccctggccttctccctctactgccttgcaccataggccatgtcctcccagcagcaccagctgagtagacttcagaagtggcttgagcccttataccatggttatgtcaaagggagtgggcctggggtggagggtaccctcatcactggtggcagccattaactatttccttccctgcctagtcctggcataaggcctgctttcgatgtgccaagtgtggcaaaggccttgagtcaaccaccctggcagacaaggatggcgagatttactgcaaaggtgggtgttttcacttctaattgagggtcaggaggcccaagggggtaggggggctaagtagttttgcctttgctgaatgtaaactaattcctggccttgggatccaagatctgaacatctagtatgattccttcattgtacagatgaggaaacaagaccagagggggaaagcaacttggccagcatcatctggcaaattgaggcaggcatagggctagaccctggcttcctaactcccagtccaatgttcttacagcagatgatgcttctataattttggtggcaggggcaatgggtacagggtacaaccaagagcctcttcgctattttactattgagattggggtgctgtggaggtgagggggtaccagtggaccttccttccctagcagtctggctgggcactaggagtgggggatcttcagcaggagggtgggtggtgtggctgggggtggaggaagaacatgcccttatctctctcctctctctgcaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccag

SEQ ID NO: 35614 - DNA, 9471 bp, Homo sapiens
gcggcgcgcgctgcgggcagtgagtgtggaggcgcggacgcgcggcggagctggaactgctgcagctgctgccgccgccggaggaaccttgatccccgtgctccggacaccccgggcctcgccatggtgagtgaggctggggggtcgccgaggctgcgggctctgaggcgggcttaacggggcaggacccctgagggggcgacagagcccagagtggggggcgtccgggcccggcgagagcctcgggacccttttctacccgcgttgtcgggggctgttgaacccagagcgggacgtctggatcaccagaggtttccagaagcgactttagcaccaaatgggatgtttaagtccacaaatgggtatctgagcccctaaaggggacatttgaaccccggatggaggatcgggaccctcagtgggacccctcaaaaggattttggacccaggatggggcgttgggtttcaggatggaggtgtttggaccccaggggacgaaataagaaagatgggctggggaggggagctattcgggccctgatgaaggcgtttggtcctgagaggatgcggggaacgggggacgaagggaggctgggctgctcctggatggggtggtggagggtagctgggcccgggcggggaggggcgacccctgggctcctgtggagcagaggagagggtcaaggatgggcggtcacttctacagatgagactcccgagggtgggggagggtgggggagggtggtctccagagcccagcactgcagaggaggaggagggtgaggtgcaagcttatgggaggaagagcctggggtgggtggcagcggagattagaagatactcttgaaggcttccgggacggagaaggatcagggtcgtggaggtggtgaaaagggatggtgagagtggggctcgccagtagtcgggggacagggacccttggggttaatttggaagtagctagaaaaggttccgaggttactagtgggttaagactgttgctctagaaagacagaatttttttaacggggtgggagtgttgtgtttgggtccaagagaagatggatttccaaggtgaggggtgggggaggacttgggcttgggtggttgggaggtgaggtggaaggagaaaatgaatggcagtcaggggggcctaggtttgggggtggatgtgggtagcaccctgccagtctccagggacaggccaggacaaagacggctcagtgtggatggggagtgggctgcagggcccggaggaagcttttctaccgtcctccttcctcaggaagaacgcggctgggtggaagacaccggggcagtgggagcaggtgggcggagctgttcgggcccctattgcgcactgaagcctcatgaaatggggatgggagatcaaagtttggggtgcctcgaatgagccagctttttcaagcctagaagcctcactctgtcgctgcccttttcaggccaagagcactgccttttcccagcaggagcgccggttttctcatgatccccagccccacgcaccatgctgcacctcgtcacttgtgccaaatgacagtgcagtacagtgtggcgtcagtgacaatcagatgcctattcccgtgccctcggggtgggggctgcagagcttgatcagagagtgcctctggggagaccccttgatcggcctgagggccacttgttccattcagggccctcgctgagcgtgtctgttaattcacagggctttgagagaaaaccagcagactagttctttcctactccctgccacccacaacacccacagccccaccaggctgagcctgggaaccgtgtgcagccatcctccctggcaaggctggggagaacaggcagccgctgctgtgtatcagatctcatacttgctgacacagacctgatggctcctcttgccgctaccccattttcccccagcagaacctggctaaaaggggccctgaagcactagcaggccccctacctccagaataggacccaagctttggccacaactagtttctctttctgtttgtaatcagcaaggtagaggtgggacaagtcactggtaactggccttggactttggcctgagctctgtggctcctccttggcccgggtgaggggccctggccttggtttctgatctcatctaacactgctctctggcattggctgggggctggggcaaggcagagaaatcacaccctcttccctcccccacctcatggttttttttcttgtccagccccttgctggagcctaagatgagggataaggaagcaggagaccagctgagttattttggaaacagtttttgttgaaagtttagtcttcaggtctagaaagggaagaaaccttgagcaaggatcaatgatatcttcttaggcggtcggttttctgggcggcaaccttgcttgagatctgtacctttccttgaccaagcagggaagtgggtctccaacatgggagggagagcatctgacaggccctccatgcagagccacgcctatttgcagcaaccctgtgacagaactgaacatggcagtgcctcatctgcatcttccagtcttttggtggagactggcaaacggtggccttcagagccgctcggggcagtctgcagcctgtcacagcctcctcgcccccacccccagccccttacagtgctgcccaaaggtccggggagctggacttcttgcagggcggaacagtgggctgggaaggccctgacctggctcgctttttccattctaggccaggggaaagaatgaaaagcagatgggatggcagccacctccccacactgctgccctcctctctgttctttccctgaccctccctgggcattgcctggtctcggtaaccagaagcccatcctcccttctcactttccctaagcctcttcctcaggtgtcaggacctaagggatggctccaggcttttttgtccatggtgggaggtggggggcaggtggatcaagaggctcatgggcctggggctaccaggttggcatttagaagcccaaccaccctgtcttttttgaaggcaatgcagaagaatcttcatttggcctccccacctcccctttacactttggacttttccagaatgtgcatgtgtgccgttttctcccttcctctttccccctccctaagccctctcccctctgtgatcatcattttgattacccctcccattctgcctatttggggcttgcaagttcttcttccgttaggttttttttttttttttctaacttttttagatcagtgattgttaatatttgggacggggatgggggtaggggaggcaggcagtggtttgttcctagcttctggaacctctccgtagaatactgcaaattcacataatagtctgcttctatttctgaggctctcagactcgagactagaacatgctatagacttggagcccctttccctgattgtgaaaggaaggggaacagacccaccatggtcccgggatggtggtgccttcttcacagcatcaacaaaaaccagggaaaatgtgtcttttggctgctaaagctaaatgttgggattcagcctccccaaccccccagccccgctcctgccccataggatcactatgcctggctgatgcccagcacaccagtgcaggagaagccagtccccgcatctcctccccacccccaaaccccgcatgcagcaagggctgcctgccacccactggccagtccccagagtgcccaagctggaaagggttaaaaactgcagtgcaagccagcttcagtcctctgctgctgcccgctgcagccctctccctgacgtttgtcccttctgcccaaaagaaacaaaacagaatggccctgtgccctcactgtgcgcagggggtggagcgcctgcctccagcctgaccagagttctttaggtgcttgagcaactcgggccgccggttaggagaatttttgccacttgggtggactctgcctgagccaaccgcctccaaataggtgacacagaaactagcagagatagccccagacatcgtccctctgccctacccaaggactggcctgcttcagtttggagccttctagagcttcttgatgaggcctccagggcaatcgttcccttcactcggcctctggggctctcactgatgagatgcaaacctgtgccaggcctcaccagcgctgctggtttggggctggggcaggcttttctcccgcccctgtggctcccacatgctgagttgagattggaagcccgtgggtctgggcagcttcatcgggccgtgcgtccagcaggcctgagtgtccagcccaccctggtacccagctttctgaatcaccagactttatcatcaggcgctggctctgcctcagaccctgactctggcatgctcctccctggcccggcgggaatggcacgtggagctggcctcactggggccgagggtctgggctgagtgaggaagatgcgtccgtgctgtccggcctggtgactgactttccccttcatgcttttacaggctgaccagctgactgaggagcagattgcaggtgagtctgctatccccctcatcttagctcaggaaagcctccacatccccagccaaatcttagccactgaggagtgacatctgatgggtgaacctgtgtatcccttgtgtcacctaacactatgccttgtgcctagaatgctgataaatgtgtgtaagagcacaccagtgccccaatgacacgaagccccatggccctgagacaggcctttaccagacaccaaaggctgtgttcctctcctgggcctgggtcatctaggggcttgatatcagtggctgcaggacgagcccaactctctctcccagcttcagccaggttggcttagaaggtgagctccctgcctccctgtggggcctgcagagctcctgtcccactttaggagccgcccaggagctggctcgtcactcccacctctgcgcttgcctgcgctttgcacttcctttcgcatgtgcctgcgcctgcctgttctgctggcggaagtgcctccccagtgctttgcatgggcagctccttcccgtcccttagctcagatgtcccctcggggaggccttccctgacccccatctcaagtacacagccttcctttactctccttcacatcactttattttcttcataacctttctcgctgtctgaaattattttcttatgtcttcacctgttgtatctcctgttactagatgtgagttccattgagtttgggacttggttttgttggtccctgctatagccttaatgcctgcctagaacgtagtaggtcctccgcaaacttttgctggctaaacaaacatctctctctcagcaagctagaagaaatccctggatcccatctaattcatttttctaacccctccaaaaccccagaagggtcagctacaggaactattgtgtaattacagatccgtgcctgcctacccgcccatactgagctgcccgaggacagagagcaactcttggtttatctccatagccaggggccagcacacagtagaccagagtagcgatccagagaatgggcctctgctccccaccagctacccagcccccagctctgctgtcaggttcaaccggctgtgtaacaagtactaaaggcccagcttctgcggtgggaggcaggaacggacttgccttctctcctttctcccctcaacccgcatcacagagtcacctttgcagcttcaaaattttggccctgggtggctatggagacccctgaggaaagccagaagatggcctggtttagtgatcatgagctcggggtgccccatgacccactcactacctgccctccccaagaacaacaaggcctcagcacagggaggtgccagcctccccaaagagactcttgccatgtccccagggcccagaggctcagggccacagcttcccagctgtgcatgtccctcccaatgcacctgccacccatctcccaactctggccttgtgcaacataaacggtctgcttttcaccctgtccccattagcaaactgtccaccgcctcaccccagcccacaccctctgggaataggctgccggacatctgtttttggagggcttgggggtagaggagcaccaggtgccaaaatgggcccagtgggagggcaagagccatgtgcttttctccctgcccctgatgcggccccagctgtggccttcccactcagcactgctagctcctcatcctcctggcttggcagccgtcccctcgctttccatccccccatcaaccccacgcactgtccgtcagccatgttctgctgccgaccacccccacgctcaccacacgcagtggctcagctcctttggaagctggtagcacccacggcaaggaacagggctgccagtcagaagggagtggatgcctgcatttcctcttcaggccggccagaggcattctgcagcctcccctcctcgtcccagccagccaaccctggctaacacactcagacaaagaatcctttcggctctcattcactccatgactttggttcatttcatcatttcaagggagaagtcaaagccagggaccaaacagaaatgtagaatcatctaaggacagctgtcagaccattttccccactgtcttcactggctggccagaaaaatagcttcacctagcacagtgttgatgttcaataactgttgaatgaaggttggaagggctttgccctgagcactgaggagagagagctggttgcgtgggacttgaagtctgtctcagtttctttaggtgggactgatgcccttggccttcctccagggaaggcatccagcatccagaggtaaggattctcctgtggaccttgtgacctctgactcctcccccttcttcccccagagttcaaggaggccttctccctctttgacaaggatggagatggcactatcaccaccaaggagttggggacagtgatgagatccctgggacagaaccccactgaagcagagctgcaggatatgatcaatgaggtggatgcagatggtgagccccacagagcgcgtgggcagccctgctcctggtcaccccgagtgactgcagggagcctctctcagggtgatggatgagcccgtgtctctcagggcccaggccaagagcattctccatcctttccccaccttccagggaacgggaccattgacttcccggagttcctgaccatgatggccagaaagatgaaggacacagacagtgaggaggagatccgagaggcgttccgtgtctttgacaaggtaagcagccctctccaggggcggctctgagactgacgccagccttcaggcagacaggcggaactggagccacggagctaccacttccaggaggtccgggtcccggtgccagcctcattgccaacctgctctgccacctcaggcagcctccctcactgtgctcactgctgagggatggtgatgacagccacccctctcactgcctctctccccaccgggagaagtgcccagtgaaaggctttatccccaacccccaggatgggaatggctacatcagcgccgcagagctgcgtcacgtaatgacgaacctgggggagaagctgaccgatgaggaggtggatgagatgatcagggaggctgacatcgatggagatggccaggtcaattatgaaggtgagtcaaggccaggcttgatctctggaacaagaagagaatcgcagcttcaggaacaagcccccagatccctcttgttggggagggccgctcgccacttagcctgcccgcctgacctcctctctctctgcttcactccacagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 35615 - DNA, 37909 bp, Homo sapiens
caggaggttgacaaacagccttttcgggaatgggactcgaactcgtaagccacgtctgttcctccatttcccgcctcagctggatgacggagagggatctccgggattaaagaacaacgaccgcaggcgagtgcacgagcgaggtgcgcgcgctgagtagggggaggggcctggcgcgcgccgaaccagatcgagggggtgggggcgagctctctcgcgagagtgggtttgttcttgggctgcagccgctgccgccgcttctcgccagcgccgttgctgcgggggattgtgggagtctccgcgtcccgctcgctgggagagaggtacctctccttttccctctccctttccctaaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttcccccaaaatggaggatttcgcagactctgaagagcctgcttgtttgagcagcgtttctttcttttcccggtgtctcggccttcacgccgctccttgcccatcgcctcagagcgccccctaagactcccggcccacacgcgcgcgcgcgcgcggcgttagctggacatcagaaacaattcctccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctaggtgtttatcctgctctgtggccctgttctgtggaatattcctattggatcagttacagttttttagccagatatttctagaacggttatggtggttctgaaatggctagtctttcgggcgcgctggaataatgtgaagaatcgttgatttcgtaggtaggggtcacgagattttgtattggtactgcgttctgtgttttaaaccttggcttaagatttctgaatagtcggtaaaatacatttttctcccagggaaatctaaacagttgactatgcggacaaaaatgatgtttcaggctattttaataaatgtttaaaatttccctttaaaaacatttctttactaatggctcagtcatctacgcagtctatcgacgtttttcacagtattgttttaaaaatcaagaaaggcttgacattttcgttgcaaaaacgctctggatgatgccttttccacttaaatagaatgtttttgcaaactcgaaattaaacaacattaaaatactgcatgaagtttcttggttatgtaagatttggaaaagatcatttagccagatgtgtgttgaagtgctttaaatttgtatttcttcctttgcacttaacagtatatacttagaacattactttgtactttacccagagaagtttcgctttatcatctttatatatttttcagccgtgtacagcttttatatcacattttgaactaacttggaaggatttaactacccttgatctgtgcatttgttttagtctttaaacatactaatttttttactaatgcttttagagtttgtaaacgctaatattacaagtcagttaatggtttttactgaggagtgcaacggtggtgtcgtattttaggagcatcacgtagttcaaatccctaattttatagaagagaaggttaaagcccagataggtcgtgaccagttgcaaatagtagcagtgctgtcagtgtggtctacagaggtcttggatcttttttttctctgaaacaggatcgctctgttgcccagactggagtgcagtggtatgatcagtggctcacggctcacagcagcctcgacctcccaggcttaagtaatcctcccacctcagcctcctgggtagctgagatcacaggcgcgcgccaccacaccaagctaattttttgatcgtctgtagagacgtgttctcacaatatggcccaggctggtgttgaactctcggagctcttagatgttgattcagactccttcatagtataataggcttaaaatggaaagactgtgcgtacaggaatttatcctaaggaagtaatgtgtcagatttgcgtatataaatttaatatcagttattaagaattttttttaaaattaaatattcaagttttgggaatctgctaattctgttgtgaaagtggaaatctatacagccacttaaaacagtatcgtaggtgaagagtatgatgggaaaatggtaacggtatacagttttaactggaaaggaaaatgttggaaaactgctaatgtcgtttgattgttttttaaacgacaatgtaaacatgaaaatagagatataccccaaaatgtttgctcagatgttggcattgtttactccctgatgtttttctgaatttaccacgagaaataacatcaacttttgtaatgagagaaaaaaatgaaaaacatattttgtaaatactgtaactgcttaaaatattagagtcctctgtatttttaagcgaaattggcatagacaaactagctgcttcaagtctgaagtgaaaagtactgagaagtgacagaaagtagtgcttgtgtaacattttggatattgggtataagcaaacacaggaatcagaatattcttaggcaaaaatgttaaaatcattattattggaaatagtactaattagcttacaatatgaattgcagccaaagaattgaataatggttagatgttcttagaacatctttttgttagggatacttgattttatatatctcctttagttagaattacagtacagctatcccacacttctggcaacaggttctaaaagtggatgattgcggccagtggcccgtgatcccagcacattaggaggccaaggcgggcggatcatctgaggtaaagagttctgagaccagcttgcccaacatggcgaaaccccatttctactaaaaattacaaaaattagccgggcgtggtggcaggcacctgtaatgtaatcccagctacttgggagggtgagggaggagaaatcacttgaacccaggaggcggaggtagcagttagccgaggtggcgccactgcattccagcctgggcaacagagcgggactccatctcaaaaaaaagtaaagtggatgattgacttaacatttgggatggacagtgctaagtttgttgggatggattggaagggttataggctgggagtgtagttttgccattttctgtatatgtggttggttattctaaggcacaacgctgtccaagaaataaagtgctgtaatttataattattagctatgtagcaaacctttctcattggatcattaggattaagggctctgaagttcttgataaaagtttatgtgtagaaaatttaatggataattaaaagtaaaacagaaaacaagcctatgggttgagttttagatatgtacctttaaaggggttttatgtgtaatttaaaaaattgagtataagtgttaggttttaacgcatttctattataatcctatttgtaatacagtaaaagttacatgataaagtgctgttatctgacctaacctgaatataatttattactgtggcacttctgtgtggatggagtgcggagtgcctttgatgtgatgtataattttccagttgtacatcaagccctaatgttctctgtatagataaagctcaaggctctttggaagtggaaaataaaaagtgaagtagtaatgaaagcttaggtttgaaaaaattttaaagctattccaaaatttaaagtatgcttgctccccacccaccaaaccttaaaaacatcttatctgacattctctttaatgtggttcaggcagaaacaggttagtaggaaaacaagaggggagcttgcctgtggagaaggagagagtagttgcagatgggtaagaaaagtaaaagcagagtgcctatggtaaatgtcttagtgggccagcagtaaatgcagcaagtatggaaagtagtcatttaattaatattagggagcagtattatctgcatttacttcatgaagatgcataactttcagatcttttaggatgatgtgtttggtttttttcctcctttgtgaggattattaggatattaaccgtccctcttaacacacgggaacctataccatatgtgaaaattaaaagtcaattatttgagcactcaacttaagcagtagttggggaaagaataatgtcaaagaaatacaaacatttggctgggtgcagtgattcacacctgtaatcccagcactttgggggctgaggtgggcagatcacttcaggccaggagttcgagaccaacctgggcaacatacggaaaaccccgtctctactaaaaatacaaaaattagcgggtcgtgatggcgcgttcctgtaattccagctgttggagacgctgaagcagaattgcttgaacctgggaggcggaagttgcagtgaggcgagatcgtgccactgcactccaaggctggtgacagagcaagactgtctcaaaaagaaaagaaacacaaatatttgaactccaaatattctttgtgtgtagaaaaatctaatggataattaaaactagagcagagagaaaagcctaggagttgagagatttttagatacgtgactgaaaagattggaaaaggctatcagttttaatgcttgtgtctgtctttgtgtgggccatggtattttggaagagcaccatggaggaggaagttttgcagttttgcaccaagggacaccaagaaacagcgttgttcttggtaatggcaagaaattgaaaacaacttaaatgttcatcatctgcagaataaagtacatgtgcatacataatgatacctatattgcagtgaaaatgtaggtttaactcacaattgtggataaatcagtttttaaaagcaagtcagaacagtacattttaagtcaatttgcatgaagttcagaaatgcaaaaataacactttttaagggtacatacattaagtagtcaaacttaaacacaaggggagggagtcgttggaaattgctatgtagatttatttccaaagtctcgttaatgttttgtttcgtatttttatatacactggtttgtataatacattgaatgattaaaaggggatgctgggccttgagaaaataactggtattacatgaaatgacagagggatgcctcccagctaataattttatttacacaagcattgagtagtttctgtaaatggaatagtaagcagacgtttctgtaaggtgtttggttatggttggggaaaaggtttagagaagtagaatggaaccaacacatgaaaggcagtgaaaattatatgtgaggcagggcacagtggttcatgtctataacctcagcactttgggaggctgagggaggaggatcacttgaacccaggagttcatgaccagctcatgcaacgtagtgagaccttgtctctactaaaaatgttaaaaattagtcgggtatagtggtgcatgcctgtggtccctgctgagaccaaggaggatcacttgagcccaagagattgagtctgcaatgagccaagattgtgccactgcactgggcaacagaggaagaccctgtcttgaaaaaggaaatcgtagtgtggatttcatgtggtaagtggtagggagtagtaggtttttgagccaggagagtgtgaaatgagtgatgtttcaggttgtttatgttgaaaggtgatgaggtgtgagctttgatgccaggaggctagctaaaaagcaggaggactaagattatggcagagagaatagaaaggtaagatctatggccataccaccctaaacgcacctgatttcgtctgatcttggaagctaagcagtgttgggcctggttagtgcttggatgggaaacaggttaaggatgcagggtgaagggtgatttaaacacaggttggcaatacagaatgaagaaggaagatgtttaatttttccacttttactagaattactgcaatatagatagtgtattgttctttagcttgtctgttgaaagttactaccagttggctcacacctgtaatcccagcactttgggaggccaaggtgggtgaatcacaaggtcaggagttcgagaccagtctggccaacatggtgaaaccttgtctctactaaaaaatacagaaaatttgccaggtgtggtggtgtgcacctgtaaccccagctactccagaggctgaggcaggagaatcacgggaacccgagaggcggaggttgcagtgagccaagatcacgccattgcactccaggcctggcaactgtgcgagactctgtctcaaaaacaaaagttactaccagtctttaagtctgtttttgaaagctgattcctggtgaccagtatgacattaaagttgatacatgaaagagactacggtgcagataaaaagtttataagctctttattcatttgtctttggatctcagtccttttgcctctaaaagtttttctcatctaaaaataaagaaaaatagattttaccttcttagttttatgaggatcagattataccaaatgagatgattactacggtgctgtgtgtcagacactattttaaatgttttatttagactaatttattaagtctttttgagtcagagtctcactctgtcacccaggctgcagtggctcactgcaacctctgcctccagggttcaagtgattcttctgcctcagcctccccagtagctgggattacaggcacatgccaccacacctggctgatttttggtgttttgttgttttgagacagagttttgctcttgttgcccaggctggagtgcaatggcatgatctcagctcactgcaacctccgtcttctgggttcaagtgattctcctgcctcagcctcccgagtagctgggattacaggcgcctgccaccacacctggctcttttttgtatttttgggtagagacagggtttccccatgttggccaagctggtctcgaacttgtggccttaagtgattctcccacctcagcttcccaaagtgctaggattacagccatgagccactgtgcctggcctaatttatcgagtctttatggccttatgaagtaggtattatttttatttcccaccaccctttttggctcaaggtcacacagctgtttgtaatagaaccaggattcacacgaaggcttttgggcccccaaaattcagtatgtatgaaatagttgtagaaatgtttatggaagtcaagagaatagggctcttagggatacagaatggagccttttttctttatttgagacagagtctcactctgtcacccaggctggagtacagtggcacaatcttggctcactgcagcctccacctcccgggttcaagagattctcctgcctcagcctcccaagtagctgggactacaggcgtgtgccaccacacccggctaatttttgtattttttagtagagatggggtttcagcgtattggccaggctggtctcggactcctgaccttaaagtgatcctctcgcctcggcctcccaaagggctgggattacaggtataagccaccgcgcccagcccagaatggagccttgaaagaaatcactgattttgcttaagcagagaagaaagtaaagagccaagtttatgtcgtagttcaaatagacaatgaacatcatcaggtacacggggtaactttctatcttgtaatacgggtttacttcatcaattctgtgtagttctaatctgaaactatttcttgcctgattgaaggtcactgggaaaaaattttaaacctaggaagaagacagtattattccaggtctgagtgggaatttcttacactggttaacaagtagttttctgtcttctcagcagctgacgccactctgcaacattcttgtcattcattagcctaaggatcaagaagtggactaaaaattgacttcacgtctgttagatggattaagaacagtggtcttaaagcacttgaaaatattcatgcttgtatttcagccttcctggcactacacttttttatcttttctattgtatgatgacacatgctactttaccacacccacctaatttttgcatttttagtagagacggggtttcaccatgttggccgggctggtctcaaactcctgacctcaggtaatctgcccgcctcggcctcccaaagtgcaggattacaggtgtgagccactgcgcctggcctattttaaaaactcttaagccactcaaggtacatgccatactgagatgagattgtgacactcaaaaacatagattagagagcataagatttgaaagtggctgaaactctaggaaaaaaatgtagttcttcagcatacttcaaaaaaacccttaaatgaaataattgttacaaaatatgttaggaaatattatatacaccattaaaatgaaaacttgtagtacttttaaaatggaaactatggtaaattctttataaaaccattataaaatttaataaatgaagaaaaatttaaatagtaactgaaacctgttcttgaattgaaaataagttggatgcttggtttgaaagtcctgaccgcaggaatcaatatttttgtgtgatttatgacaaaaatcaagcagctaccttccaaatggtgctgctttgaaattactgacagtcaactatgtctgccatctatcagtgacataggttaagacatttttactaaattggtattgttgattgctacctaaaacatatttggtatattttcacatgaataagctaataaatgatcaaggtgattggccttgatagaacatttggaaaatctgagcatttcttgcaattcagaagaggaaaatataagaaactgtagttttctagctgttgcttgtaagtttcaatgtgaagttaaaataatgtcattatgaaggtatttttttccctgagtatctctagttttatggttaaaccataaataatctttcatagttttatgggtaaaccatctcaaattagttgttttttttttttttaattctgactacaaagactgagaagagaaaaattatttttttatttgttttgttttttgagacgatgtttgctctgtggcccaggctggagtgcagtgccccaatctcggctcagtgcagcctccatctcccaggttcaagtgattctccggccttagcctcccacgtaggtgggactacaggtgcgtgccaccatgcccagctaatttttatatttttagtagagacgaggtttcaccatgttggccaggatggtcttgatctcttgacctcgtgatcaacccacctcggcttcccaaagtgcagggattacaggcgtgagccactgcgccctgccagagaaaaattatttaaaggagtgattatctcacacagttgagagcatagctgaagatccatgtggagtagtagatacctcttagcattttgggaggtcaaggcgggaggattgcttgagcccaggagttcgagaccagcctggccaacatggtgaaaaccccctctctaccaaaacaatgaaaactagccgagcatggtggcatgtgtctgtagtcccggctacttgggctgaggtgggaggatggtttgagcctgggaggcagaggttacagtgagcctgggcaatgcactcccaggtgtgatgccattccactccagcctgggcaatgaaggagtcagacactgtcttttttttttaaactaaaaatcttttcatttttttctaataccttctaagaaattaaagttagcttgcgcttattttagtaattctgctagatattactctgaaagaatgactaaggacttaccggtaatctttaaggaaatttagatctggaacagctgtttgcttctgttctccgtgaattttcagggtatgtgaaatttttcagaaatattttagtactctagttcttttaattggagaagaaaaagccaataacaaaaatcagattctcatgtaatgggaggtagaatattaactgaaacgtttcctaaccatacatagggatgatactcagatttgtttagatgttgaatgtgaagctaacatttttaaacagcttaaaattgtatcataaaataattttaagttacagtttgttttgagttgcctataaaaatgaatttttaagctaatttgttaagaatttggttatcgggccaggcgtggtggctcatgcctatataatcccagcactttgagaggacgaggcagggggatcacctgaggtcgagaccagcctgaccaacatggagaaaccccgtctctactaaaaatacaaaattagctggaagtggtggtgtgtgtctgtaatttcagctacttgggaggctgaggcaggagaatcacttgaacctaggaggcagaggttgcagtgagctgagatcgtgccattgcattccagcctgggcatcaagagtgaaactccatctgaaaaaaaaaaaaaaagaatttggttatcaagattgtagtaaatggcatttgtgtagtgaaattgtgggtaatgttgatagtttttaggggggtgcaggtgctttcttttttggaagtgaagggttctgcattgatgggcatttacactagtatatagagattttaaataggtaaattggattttgataataaatgttctcccaaagctactatatttaaaattgttttaacctctagtgcagtttcctatagaaaggcaattttataattacaggaaaaaacaatacagtaaaaggagctaatcttttgtaaatctttagtaagtgtctccatattgtgctgcctttgctaataggcagtggggcccatgtgaatgagcctttaaaagtggcttgtacatcttatgttcagcattgacatgatagaggaactgttttcattaatgctttttcaacaatgttgccacatctggtttctcccaactttgttctaataaaaccatttttaagaatttggtttatttgtggtttaatccaaaatctaacttaagttgcttttcactaattttaccctaatatccttgatggagctgcattttacgttgaaactgagtatcttaaaactactaaggtggttatggaattacacgttgtcatgggatttacattgtttgtcttgactcttttctgagtttttctgacattcattttctgtttgtcttaaggttatcctttacctttgcttctcttaactttttccttttgttgatccactgttttcctatgagctaccaaaaaatgtaattcagagctctgtagtctaacagtcacatttccttaaaatatggccgttttaaaaattttaaacataattgtaataccattatataatttctcttagggaaaaaataattcaaaagactgacttttcagtaatgcaaagctttggctacaacatgaaggtcaaagctgcaattaataaccctgatacttcaacatttttattttgaaaaaccctctaaaggatttgatttgtaaaaatatgtgtgaaaatttagagggtccaccaccatttacatagcatctcagccgccattctgtctggcatttataagacatatcaaagaaactttcatctgaagaagtccacttattctcgtctttattaatcttaaagcttaagtagtttacatagtggatcttgtctagaactattaatagtttctttggtgtattttctcaaattcatctttcttggtgtgcaaaaacatcttcctgtaactccagccacctcttatagcatttctgtgtcttttaaaacttgattatatctattttttaaaatccagtctaaatctttcttgcctgcaactttttttatacttcctttgccactgtatttgtccattgtatccttgctttaatctatcattggtgaaattgatcctgtaatagacttgtaactactggatattgtctggttttactgttaaagtttcacatattaagctaccagtgctgagtgtattggtgatcaaaaaatagaaaatttaagcaatgcctcatagaattctgtaccaaacaacttcagatttacctctgtatgtagttgtgattataaaattgtttcactgaagatgttatgtatatctttcaactaatattttatgacaatcgtgatataaaagatttggaaattcttatgtgacagtttctgaggtacaacaataatgatttaagaaagaaaacaatttcatctagaaacacgtcttgggggatcataatcagaacataaatttaccaggtgatttgggctattcttgtgaaaagtttacaggaaactgtgtaaccaagatctcattttcatttttacctgttttgtgctctagatgtgctgtagccctgagcattaaatgagtactgatggatgctgatttggggagttcccttctttaaatcacctgtatttcctgtacctaggttttttcttgggagggctcctattcctgtactgaccagagttagttctccttactttaaaagactagatatgaagtaaacactgcctgatgtaggatggtcagtaagaaggcaattagttgtataacttaaatttgggcagcaatccttaaaactataggaaatgacttatttttcttattcacatctatcttcacctcaaattgattttgctgtataaaggtctcagctattatgtttggtcttatatcttacattaggtacttgaaacctaagcttcatttacttgtgattttacttggttctttctgatagtgataataggtctcattttccaaagcacagtacaactgattcatctttgacttgctgaccttgatttttttgtttttagtcttctggaacttaagcatcatactatagggtgtatttttattcttctaaaagaagaaacccatctatatttttactgaaattttgatgtactcagacatctaacctttcaatttacatgtttttaaactcagtatgaaagtccctttaatagttaagctttagcatgaaatactactttttaaatatctatatgcaggctctgcatacatcaggaatctgtttaagatatgtaataaattccttgtaagtttgagatcttaaatgttttttttttaaatcaacatgatgcataagtttttttttcttaaaaaaacggcatctgcttaaagggatttatgactaaaattgcttatttttctacagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggtgagttaactcaacagatgcttctaatttcttttacattgtagtgcctatttacctatatctttgactctaattctgtagtctgatgacattgagttgatcaagcatttttaaacttttgagaacacttactttatttggaaggtaattgtttttgagcattttaaaccagggctttacattaatatattctgcctagattacttctggccacaaagctatcatccactgagattatcttgttggtttttggcatcaatatgttcttcttaatcatatatttaagcaggttttttttgtctgctttgttgaattgttttaagtattttttttgcagtcaatgtgctctgccattcaggatgctagatttcagctctccatctgtcttgattgctgatttgtatgtagtaaagatgtattcttgaacaattctctttttttccttatctgtggctacagggaaagagttaatgtagagccctggtgtttgtttcagtatgtttcatattttagattagttcattcttccttttttaatttccctttaacacaaactctcatactatgactgaaatttttcatcattttttttctccttttccacaactttcttaaacatacttcaaaactcactttttattatcccatgttacatctgtccctttagagacttggacaaatcaactactacagtatcctgctctgtgttcctcataaacaaattctttttctgagttaggcttagacttctgaaatagtcatttgaaaagaaaatctaattctcctttgctttaattatcacatctggcaaaatgggaactttttcaaaatgcccttttaaatatgttgtcctttctctttcaactttttcagtgttactcattctgactttttttcccccaatatatggtgcagttgacttaaagtcattgttatagcaccccactagcttgatctataatctgtgaccgtccattttttcctgatgtgctctacttaactggaacaagttgctgccatgaaattgatttgatggttactgttacagggtttttctttacagtaacatctggaagggtcattttcttttcatagctaatcctttgataagcattttttagtaaatgagtatggatttttttttagtagactaaatcataccattgtttttaatattctgttaaagagtattaccagtcactccctttccttgtgtttggatctcagtatttttgtcttttaatctttaatctgtaccaaagtaaattaacataaatgctaaatttaggtttatttaaacatttaagaagatgtattttcattaagaaatacaaccccagactcacaaaagccagcaaattttaattggtatatgttttgggtgttaccttttcctaaatttgttggctctactaaatatatcatggaattcattttagtttctgatcagcactaaactttaaattttaggtcccgtgtgaattcatagaatgaaaaggtccattaaacactggtgactccaattttttctgcgttatttcttgcctgtttataaggaaataatagcagaaatgtcagtatgaccaatattctcagaaagggtctctaaattctgaggaaaatagatagttacaagtgtctcaaatgagagtgatgtgaagggacttaaaaaatcttcgctactggagtcattaagctgttgggacatcatgaacacaatggaaccatgagaggacttcgagaaaagtttctgtttttatgtatgattatgcttttttccttcaaattttgctactttctagttcctgaagaaggctaataacttaaatggatctaaattaacaaaagagcagtttttacatattttgatgaaactatggattcaagagtaagatacactaccctagtgcaagaggtacttttagcctgtaaaaatgcttaggtcctagctagttttggtattctgtcaaaatactgagtacatttgagaactattttagaggccttttgtttaattctgtggtttaaatgtgtaaattggaccaactttaagaagtttaaacacatggattatctgaatttctagttttctagttgctttactatgttttttacgtatatgcattatattgaaaaaatctttactcactttagcagtggaccctctataaccgctatagaaatgaccttagagaaaatttctgtgatggaagtagataatgaaaaatttttaaacatttaatcctgctctctggtattgctgcataacttggaaaatctgttctttttacttagtggtattgttaaatagtctacatgatcaaaaattcttactgtgaagtaagaaacttaagttgaaaataatttgtcatggagtgtcattatttttaggtgacttaaagtgatggtggtgtttttatttctttataggtcattttaggtcatcaaattgcttttcttttcttttctttttttctttttttttttgagacggagtttcacttttgttgcccaggctgtaatgagtgcaatggtgcgatctcggctcaccgcaacctccgcctcccaggttcaagcaattctcctgcttcagccttccgagtagctgggattacaggcatgcgccaccacgcccagctaattttatatttttagagccagggtttctccatgttggtcaggctggtcttgaactcctgacctcaggtgattcactgccttggcctcccaaagtcctgggattacaggtgtgagccatcgcacccagtcatcagattgcttttctatgcaatctcaagctttctcagcttcctttcacttaaagaaaattacccactacagcactttggctgtcttgtcacttgagtttatattaagttatacttttttctgccattctgtaagtgcttcccaaattcttttttttctctctataaggtatctcagatacatcaaggtgaatgtagttttcctacagaaatgtctgaatttaaaaagtgcacgaatcctttattaatctgattttacaggagttacctcagtgtagagtccagggatatatatttttataaaactctttcacttagtccccaccgtaaaccaaccagtaatagatcagtagtacagattagtcattggatgagtttgggaggtatgtgattgattttttgatcttggccttccttttttcactttgaaagaccagacacacttttcccctaagtttgaacctttaaacaacgtggaggattggatataatttctgttcagctatgtaccctttctagctcctatgaaatagaagcatgcgtagtaggataacatttatttctctcccacaacttaagaatattttaagtaaaatctgaatatttttagttcagagaattgtaagtcgttaattggtatttgtttaattaatcctttttttttttttttttttttttttttttttttttgagaaggtttctcgctctgtgtcccaggctggagtacagtggcgtgatcttggctcactgcatcctctgcctttcgggttcaagcaattctcctgcctcagcatcccaggtagctgggattacaggcatacatcaccatgcccagctaatttttttgtatttttagtagagacgggtttcaccatgttagccaggctggtctctaactcctggcctcaggtgatccgcctgccccggcctcccaaagtgctgggattacaagtatgagccaccacgcccagccaaggcttctaaattttgtgaacttacctgtggctcctctgacttagagccatttttattttattttattttgttttatgtttttgagaaagggtcttttgctttgtagcccacgctgaagtgcgcttaggtgttcgcagctcattgcactctctaccacccaggctcaagtgacgcatgtaccaccaccacatctggcgtttttttcttgatagagatcgggtttcactgtgttgcccaggctggtctcaaactcctgggctcaagtaatctgcctgctttggcctcccagagtgctgggatcgtatgcgtgagccactgcacccggcccttacaagccattttaaaactggtccccaagaaggcagtggtccattactttccagttgaaactttagatatcccaaatagctgatgattagagagccagctggagagatcttgagttccttagctattagccattattttaaaaagataatctagctttgagagacctggaaatagtagtttatagcttccaacattttaaggaaggtaccattctatttggatgagttccattttagtttacaggattttatttttatttatttatttatttttgagacagtttcactcttgcccagactggagtgcaatggtgtgatcttggctcactgcaacctctgcctcccaggttcaagctattctcctgccttagcctcccaagtagctggaattacaggcacctgccaccatgcctggctaatttttgtatttttaataaagacagcgtttcaccatgttggccaggctggtcttgaactcctgacctcagttgatgctcccaccttggccttccaaagtgctgggactgcaggcctgagccaccgcacctggcctttcacaggattttagataattttactagagcataggaatgtacctaaactgttgtcaggtaaatataaaccagttttttttttttttttttttaggagctcatttataaaataccaatccgcagctttttgaaagcacgtatcttgtaatttggtaccttggtaccttactctaatttagttcagctctcagtgagacatccccctttaaaaacacatcgcctgaccatgttttatattccaaatataattgtattgggtagtgtgggtgttacagaaattacctcaatttgtgggagtttgtgaaacatcaataatagttgtaaagcaggaattgtaaaacaagactgctttataatcagtgtaataatagttctttttttttttttttttttagcacattccatgtgcctggcaagggtctgataagcagtttacctttattgactcatttgcttttcacaacaaccctatgagactcttgtcccagtgaatttaaataacacggaccaaagattcacatctttgtaatttgggagtgaacctaggcagtctaatagcagagcccactttttgtaacttctctttcttacattgcctaaaaagttaactcatttatatctgcatttttttcctaaagaaatttatttgaataaaataagagttacttcaatttaaagtaaaccataaaagagtaaatagtgaaagaatgtcatgtttcccaccctaaatttggaaagaggcactccttaaatttgcttattttggggaaatacaaagggagcataatattttgataaatgggattcgttttctagaaaagccattcctgttgaatcatgttagcattttatggtaatgctaatcatggtgtatttttcattcactgtgtatttagtaggtagtaaacctggaacatcctcaaaagctggatgtgattaaagttttagtttttgtttttgtttttgttttgttttgttttgttttgagacggagtctttgtcatccaggctggagtgcagtggcgcagtctcagctcactggaatctccgccttttgggttcaagagattctgctgcctcagccttccaagtagctgggactacaggcgtgtgccaccacgcccggctaaattttgtattttttgtagagatggggtttcgccatgttggctaggctggtttcaaactcctggtctcaaatgatccatccatctcagcctcccaaagtgttgggattataggcatgagccaccatgctcggcctaaaagattctattttaactaattgttcacatttatagtatatagtttctagaaaagtagatataaacatggatgttttattcagagtgctataaagtagcatacaatgaatacttcagtttggtccacagtaaaaattaataagccttgctgatctcaaggttagttactactcttgatctttattaactctatatcttttccctgtcaaatatcttaagtatgttgacaagttaatccagtttttccaagaatgtgcatagcgtatttgagggcaggatcaagcctcaaggattcagagaaatggttttaaattaaatcaatgtgatttagtgaatgggcaggtgtttgtacagcctatgatactgcatagacattaatatcctagagtttgaatggttcagatgaaaatatttcagctttatttttgttaattctactaatttactttgctgcaggagtggagtcaacatatcaatggagcaagtcacagtcgtcgatgccagcttcttcttgaaatgtaggagtttgaaatacctttaaaacatccttatcgtgaatcagaatcagccattattggtttttgggagttcatcatttacttgtaatatccacaatgttaatatcacatagtggtactgtatggacaatactatttacaagtaaaatgtttagatctggaaatttcatattgaatattagatgcagtaataatattttgttatttaacatttctaggatacatatatattggtcattatacaaattggtgatttttactagacatagtgaaagatagtatttgatatgtagagtggattaaacagtagcatttttaataatacatgctctaaaaatgtaaaagatacggaaaagagggtaggttattaaaagattctaattcattgtccagcaaaatccttggtgatgaattttttttttttttttgcttttgagatctttggttttgagttcaggctgctaccatgaaatggaattcctaaagaaactccctgcttaagcagcacacagtgcccattgttcactggagttggaattttcacatatgcctaactctgttggggctattctttctttctaatgtcacaactcaactgtgctcttggtattaatattggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaatcctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgataaaattcactttggttaacaatttttagaatatatattatgtagtaatttgtattcttttattgttaatgtagactttgacctagttacttcacagatactctgaaagattgaagtggttgtggtcatatattggggtgctttaacatttaatcttaattctttccaatggacctctttattatgatttatattttatgtcttcactttactaggggtgatccattcatgttgcagcagtctacaaatccagcaccaggaattctgggacctccacctccctcatttcatcttgggggaccagcagttggaccaagaggaaatctgggtaattatataaaattcatgttacttttccctacagagccgttactgaaaatttttctttttatttatttatttgagatggggttttgctcttatcgcccaggctggagtgcaatggcacgatctcgactcactgcaacctctgcctcctgggtgcaagcagttctcctgcttcagcctaccgagtagctgggattacaggtgcccaccaccacgcccagctaattttcgtatttttagtagagacggggtttcaccgcgttggccagactagtctcgaactcttggcctcaggtggactacccgcctcagcctccaaagtgctaggattgcaggtgcgagccactgtgccaggccgcaaattttacttatttattttagacagattctcactccgtcactcaggctagagtgtaacggtgcaatctctgctcactgcaacccctgcctcccgggttaaagctattctcatgcttcagcctctcctgagtaactgggattacaagtatgtgccaccacacccagctaatttttatatttttggtagaggcaggggtttcgcggtgttgcccaggctggtctcaaacacctggcctcaaatgatctgctcagcctcccaaagtgctgggattacaggtttgagtcaccacacccggccccattctgaaaattaaaggcaatgattataggtgaaagaaggctcattcaaatattacacagaaaaaacattgcatgaaaagtgatggtaatcatatatttgtaagagcttttcatttgtgtttggaagatgcacgtttttcagtaaaattgcttctttaagcaagtatagtgattacaagactgaaaactttctcttcccataaaggtgctggaaatggaaacctgcaaggacctagacacatgcagaaaggcagagtggtcagtaatgaagcttttggttttactgtatttatgatttttgggaatatgatttgacctaaatccttactagttgagtatgtatcgtggtccttatgggaacattgctgtaatttgaaaacaatcacgtttttctatggctttgataacagttaaaactttaaattttgtatgcccatagtccagtgaggtcaccttaattcagcatcttggaagctttgctgtccagttacgcgtacaatatttaatttaaaaatcactacagagagtatgttttgacactttgaagtagtttaaccgtttggttatggtcagaaagaacttacccagtgacgtttgatatgtagctttaaaattctctagaatgttatgagttgttttacttacactctcctggttaattatagattataaaaagtcctaatgcgtaattggtttcatattgctttaaagagacttaattgcttggtttttttcccctaatggataggaaactagcagagttgttcacatcatggattttcaacgagggaaaaacttgagataccagctattacagctggtagaaccatttggagtcatttcaaatcatctgattctaaataaaattaatgaggtatgaattgaaatattggtattattcatttattcatgccactaatatatgttctgcaagaattaaatgattttgtattagaaaaataaaactcaaggtaatcttaagtttatcaaatgcagaatgtagtagaggaaaaggccagtagttgatgaatataatagggtactaatggattattagtaactataaattatgatccttaggtagtaattgtcattatactactataaaagttgtaaaaggaaaattctgtggaaagccatttcagatctataccaaaatgatggtttcaagtcattatttttagtccaattggcatagtaaatgataaagtaatgcagtagaaaattaatctgaggtggcctttgtaataaaatagcaaattggcaacactgttttttggggtttttttgtttctttgttttgggagtcggagtctcgctctgtcacccaggctggagtgcagtggcgcgatctcagctcactgcaaccttcgcctcctgtgttcaagcgattctcctacctcagcctcccaagtagctgggattacagccgcccactatcatgctcagctgatttttgtatttttagtagagatggggtttcaccatgttggccaggctggtctcgaagtcctgacctcaggtgatccacccgccttggcctcccaaagtgctgggattacaggcgtcggccattacacccggccaacatttttgttcgtttgtttttgttttgttttgtgtttgagtgtcactctgtcacctgggctggagtgcagtgaggttcactgcagcctccacctcccaggttcaagccattctcctgcctcagcctcctcccaagtagctgggactacagacgtccaccattacgcccagctaatttttgtatttttagtagagacggggtttcaccatgttggtcggccaggatggtcttgatctttcaacctcgtgatccgcctgcctcggcctcccgaagtgttgggattacaggcatgagatactgggcccagcctcttttgttttgtattttgattcttgaaagtattttctacttaatgattaaatatatctgaaaagatttggggcattgttattttttaggaaaaaaaatctttagttcaatgtgagaaagctgattggaaaaaacagagaaataactttttgtataatttcaggcatttattgaaatggcaaccacagaggatgctcaggccgcagtggattattacacaaccacaccagcgttagtatttggcaagccagtgagagttcatttatcccagaagtataaaagaataaaggtaatgtttatttttttcaagctgtatatcagtttaacaaatgattttaatagttattaactgtggttatttcaaattattgctaaggccaggtgtggtggctcacgcctgtaatcccagcaccttgggaggccaaggtcagaaggattatgtgaggcccaggagttccaggcaagcctgggcaacatagcaagacctcgtctctataaaaataaaacaattggtaaagactaggatgtttttaactgttaactaataattattgcacatttgtccttttgttgttgttatttattaaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggtaatatacataaggaagttttagagaagataatttattaaaatccttaagatttttcaatatggagctgggcgtcattcctcaacctgtaatcccagcagtttgggaggccaaggcaggcaaatcacctgaggtcaggagttcgagaccagcctggccagcatggtgaaatcgtatctctattaaaaatacaaaaattatccaggcgtgatgtgcctgtaatcccagctacttgggaggctgaggcaggagaattgcttaactggcagggggcggaggttgcagtgagctgagattgcaccactgcactccagcctgggcagcagagcgagactcccaactcaaaaaaaaaaatttgcttttttttttttttttttttttttttttaaagtatatccctatttttagtgatgaaatctggaggactagttgtttgcttttcttttcttttttttttttttgagacagggtctcaaaaattaatatttcatacttttttttcttgtatttaaaaaatatagagttagccagtcgcagtggctcacgcctgtaatcccagcactttgggaggcggaggcaggcagatcacgaggtcaggagattgagatcatcctggctaacacagtgaaaccccctctctcctaaaaatacaaaaaaattagctgggcgtggtggcgtgcgcctgttgtcccagctgttggggaggctgaggcaggagaatggcatgaacccgggaggcggagcttgcaatgactcgagattgtgccactgcacccatcctgggtgacagagcaagactccatctcaaaaaaaaaaatttagagttaggctggatgcattggctcatgcctgtaaatccctagacattgggaggctgaggccagagttgcccaggagtttgagaccgccctgacaacatattgaggccacatctgtacaaaaaaaaattttttttaaccaggcaaagtggcatgctcgtacagttttagctacgggagtctgaagtcaggtggaacacttaacccaggagtccaaggtttgtagtgggctatgattgtgccactgtacttcagcataggcagtggagtgagaccctgtctcaaaaaggaaataaggatgaggagaacatcttttttgtttttctttttttgttttaaacacttctgtaattcagcattgcaagtttgtgttcttccagacttttatttttcttacactattttaatatcttaagcttattacttttttttttttttttttttttgagacagagtctcgctctgtcaccccggctgtagtgcagtggtgcaatctcagcttactgcaagttctgcctccccggttcatggcattctcctgcctcagcttccccagtagctgggaccacaggcacccgccaccacgcctggctaatttttttttttttttttttgtatttttactagagacgggtttcaccatccacaggatggtctcgatcccctgaccttgtgatccgcccgtctcggcctcccaaagtgctgggattacaggctgagccaccgcgcccagccagcttattacttttttgcagagtgtatatagatggcttagtatttggcactaaagtgattcttggggattttgtaaatctgacaggttggttttttggtttttggttttttctgagatggagtcttgctctgtcgcccagtctagagtgcagtggtgccatcttggcttgctataaactccgcctcctgggttcaagcagttctcctatgtcagccttccaagtagctggtactacagtaggcacactccaccaggcccagctgatttttgcatttgtagtagagatggggtttcaccatactggtcaggctgttctcggaattcctgacctcaggtgagccacccgccttggcctcccaaagtgttgggattacaggtgtgagccactgcgcccagccctgatattcagtgaatttttaactctgtgctaaagattaaaatttttagccgggtgtggttgctgtcacctgtaatcccagcactttgtgaggccaaagcaggaggattgcctgagtccaggagcccgagaccagtctaggcaacatggcgaaactgcacctctacaaaaaatacaaaaattagccaggcattggtggtgcatgcctgtagacctagctactggggggctaaggtgggaggatcagttgggcccagtacatcaacgcttcagcaagccaggattgcgccactgcattccagcctgggtgacacagtgagaccctgtctcaaaaaagaaaaaaagtaatgaaaattttctaaccagtaggtagaatacataataaggttttatacaattttgtaaaatataatgtgctttgtggtttcttttctttctttttaaggcttttattgagatggagacaagagaagatgcaatggcaatggttgaccattgtttgaaaaaagccctttggtttcaggggagatgtgtgaaggttgacctgtctgagaaatataaaaaactggttctgagggtatgtagtatttgatttgtcatcatttaacagcttgtttttacatatttaaagccacaacattcttttaaacatttttgtatgctaaaaatacaggattattgaaacctattgaaataagttattgaaagagaacaacctttttttctggtctttaatggcagaagtttttaaacgagtcttccctaaaggacaccttcattgctcttatctgtttaagtttttcatagcgttctgctaccagaatgttttattttccacttctctgttggtatggtcatgatgaatgtctgtaggcagcttaggttctcaaataaggttacgggaattgaataagctgagttgattatagggattgtctccaattattaattcactggataattgtgtattctgcaaatgtgttaacttctgcaaaacttttgtcttttagattccaaacagaggcattgatttactgaaaaaagataaatcccggtaatttcattttgtttttcatatgtgtgagtatattcaactttactttttcagacaacaaattaattgtggtgtgtccttttgatttcagaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtaaagaaagatacattgatttgttttaatagaacattagatcagatcagtatttcaagttatttacctaagcaggatcagatagaattatatgatttaaatcagaaaataaatcagatatgaaccagaatataaacatttaaatctaaactctgcaataaataattaaataagacattttattatagttggcaaaaaacatcagctcaaagaggaaacttttcagtaaaaatgagggagaaagactcaaaatatatgtgcttctgtattgtagtggtgtagtggtagcatataggtaggcagccttatagtgtagctttgaaaaaaaaaatacaggacgtgagtttgcagtaagttaactgacccaacatagttaaaacttttgccactcattcaaaaattattgaataatttttcctatttgagaaatgttggcctggtcagataccttagtatcctttaaaacaattttatttgaacaagtaagtcatttagaagccatgtataaagtgaatataaatataaaaatacacacatgctataaagaagagtaaacaaaggacccacattgagctgactgcctagcttaaggagtagggcattaaaatgcctttgaggcaaactttttatgttaaatggctcataaaatgtcggagtcaggcgggcccagtggctcacgcctgtaatcccagcactttgggaggcccagcagatcagttgaggccaggagttcaagaccaacatggtgaaaccccgtctctactaaaaatatgaaaattagccgggcgtggtggcacatacctgtagcagctacttggaaggctgagacaggagaattgcttgaatctgggaggcagaagttgcagttagccaagatcacatcactgtactccagcctgggtgacaagagcaagactgtctcaagaaaaaaaaaaagtagagcgaaatgagatttttgccatcctattccatattccattggttccttttatgcaacattcaactcaaaaccaatatttacctcagtttttatttgatggcttggtcaaataacttcattaatttttctcactagagctgatcattatgtttacatttgtaaatgctaataattactgatgtttatggcatttaatgccatacgtttttctaagtttaaatttattaatttaatcctcacagtaaccatatgcatctcatactgtgatctccagtccataaatgaggaaaattgaaatatggagaagttaaataatcccatactgcttataagacacagagccaaaatttaaacttgggcagtcattcttcagagcatgattgttttttttttttttttttttggagacggagtcttgctctgttgcccaggctggagtgcggtggtgtgatctcagctaactgcaacctccacctcccaggttcaagttctgctgcctcagcctcccaagtagctgggattacaggtgtccaccaccacacgaggctaattcttgtatttttagtagaaacgaggtttcgccatgttggcctggctggtattgaactcctgagatctcagggtgatccgcccacctcagcctcccaaagtgctggaattacaggtgtgagccaccatgcctggcccagagcttggttttttagccattacactgtttgagtatttgctctaaagagtaggtatttgcagtatactgtcttacaaaggatattgctcaacttttaccaaatcaagttttttacacattgcctagcagcattgtagtctcagaaaagataaaatatgaatattcctatctcatttaacttctgctctttgtgtgaggcagaccttccattttttagttttaaaataagctaaattatttttcaaattatcagtaattttttggaagaaaggaagaagttactattttgagccaatgaataaagacaaagacgcggccgggcacggtggctcacgcctgtaatcctagcactttgggaggccgaggtgggtggatcacgaggtcaggagatcgagaccatcctggctaacacagtgaaaccccgtctctactaaaattacaaaaaaaattagccgggcgtggtggcgtgcgcctgtagtcccagctactcgggaggctgaggcaggagaatggcgtgaaccagggaggcggaggttgcagtgagccgagatcgcgccactgcaccccagcctggtcgacagagcaagactccgtctcaaaaaaaaaaaggcaaagacgctatccgtttcccttcaagtaaagcagacagaagggatgctgcaggataattgttgcagagtaaatttgtctttcttaacagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtgagatttaagtctttgttcttcaccttcctcactctcctcaaaacaaactcttaggttttaaaataagattttaaagttggtcttacataagctgtgatagcattttaaatttgctttgtttctatggggaacaatttataaatcttaattgatatattttcctctcatgcatgtctctgattttgtattattttctgttgttattccacaatgtgttcccttttttcgtaaaatttcttgcaagttacacgcttttgttttgcttttctgtgttgtttttctgtattatatttctttttttaagaatacagttaggtgagacctcaaacatcaattaggtaaaagcaaaatatggttcggtttttgttttttatcttaggctgtattggacttctcaaaaacatgttgtttcatttaaattatgttgacaggtgaaattgtgaatactaaataaaatcttcagtttaatttgtaagaatgtatgtttgtatttctaggtatagactatgtgatacctaaaacagggttttactgtaagctgtgttcactcttttatacaaatgaagaagttgcaaagaatactcattgcagcagccttcctcattatcagaaattaaaggtaaggttgaatgtaaaacagttcttttgtgaaaacttaacaagttatggaaataagtggggtatataagtaaaatgtgtatagtgttctctctagactcagtgcagtgctttctcctgaagataactttttatttacttttttttttttttttaaagacagtttctctcttgttgcccaggttggattgcaatggtgcaatcttggctcactgcaacctctacctcctgggttcaagcaattttcctgcctcagcctcccaagtagctgagattacaggcatgcaccaccacacccagctaatttttgtatttttagtagaaatggggtttcaccatgttggctagcctggctggtcttgaactcctgacctcaggtgatccacccacctcagcctcccaaagtgctgggattacaggcatgagccaccgcgcctggccttttctttctttattgatgggttatcaaaacatctgttgaacctcttgtcatagtttacccttgctacataacaatttagtgttttctaaccatattataaattctgtggtagaattaaacttattcaagtattctcagattgttgttgggctgtactttctctaatttgaaagatgctgggagtctgaatactaaaagtggcatgaccattcatattaaaataatttttaatattgacattattattgacacttcagttatttttatgaccaaaagtatataaagatcaaaagcataaatacataaaccacaacatcactaaagaataattcctattgagatatattgaaatttgtttttgtaattatcagcttctttggactacctattgaaatagtgactgaaacttaaaagtagttgctaaacaagtcaattatagataccttggtttttcacactgctttataataagttaactatagttactcagtcattagatatgttctctgttgactaaatggatgaatgtaatctttaattttggaaataattcaagttcttggctgtgtgtcacttctgtttttttttttttttttaaatgtaactgctctttgccacctatatgtcttttaccatcctgtatatgaagaaagaattgtggctatttgcaatggtagcagcaatgtagtacaaattattttattttatttttttgagacagttttgctcttgttgcccaaggctgaagtgcaatggcgcgattttggctcaccccaacccccgcctcccaggttcaagccattctcttgcctcagcctcctgagtatctgggattacaggcatgcgccaccatgcccagctaattttgtatttttagtggaaatggggtttctccatgttggtcagactggtcttgaactcccagcttcagatgatcctcccacctcagcctcccaaaatgctgggattacaggcctgagccatagtgcccgccctggtacaaatatttttatctgctttgattttaagctgtttggggtcaaaaactatatgtattgtcgagaagaatatggaaataatataaaagattgctaggtgcttcttgtggctccttttattatttccttatattttatttattttttttttatttgagacagaattttgctcttgttccccaagctggagtgcaatggcacaatctcagctcactgcaacctctgcgtcccgggttcaagcaattctcctgcctcaggctcccgagtagctggtattacaggcgtgtgccacttcgcctggctaattttttgtatttttagtagaaacggggtttcaccatgttagccaggctggtcttgaacttctgacctcaggtgatcgcctgcctcagcctcccaaagtgctgggattacaggcgtgagccatcatgcccggcctattatttccttttattaaaaaaaaaaaaaaaactttgtcaccttcatcaagaaactgttaagcattacagtaacttgctaatggtaaattgatactttcctaactggatgtttgtggggtgattttttgttgttgttgtttttctttaaaagatataatggcttttaattcttactattttgcattaactatataaagttgaaattccaatgagatggaaagaagctttggacattttaggttagattttttaatatgtcttttgtactttcattagtgtcttaatggagctcccgtgtctagaaactctagcagtcacaggtttaatggcaggggtcagcaagctacactcgtggctcagtcatctgtttttgtaaggttttattagaacccacagccataatcatttaagtgtcatctatagttgttttagtttataattgagtgcaggattgagtagttgtaacaaagactgaatggcccaatgagtctaaaatatttactgctggccttgcaagaaaatgtttgttcaggtgatttaatgagtagtgcattgaggccagatgtgatagctcttgcctgtaatcccagcactttgggaggcggggacaggcagatcacctgagatcaggagtttgagaccagcctggccaacacggtgaaaaccccgtctctaccaaaagtacaaaaaaattaactgggcttggtggcgggtgcctgtaatcccagctgcttgggaggctgaggcaggagaatcacttgaacctgggaggtggaggttgcagttagccgagatcacgacactgcactccagcctgggcaacagagcaaaactctccctcaaaaaaaaaagaataaaagtgcatgtcatttaaacccatagttcttgaatagtgtcagttcagtgtgactgtggtctttgttttctcatctctaaaaattagggttaattataacatttgaaatacccattttataccttttaccattttttccccgtgccttattgtaatgtcctgaaagtttttgtgtgctaatgaggattaactaattgttgaaaatattgacaaaattatagtttaagtccctaaacttggatataggatatttgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgc

SEQ ID NO: 35616 - DNA, 31893 bp, Homo sapiens
gcggagagcggctgatcgcagtccggaggtgaggcggaactctgaggtgagggtgtgcagcttggtagggattggggtcccttccggggcccatcggcccctggtggtgttaatggcccttctggcctacgcgcgtgtcatgaaccctgccgagagggccggggctgaggccctcaggccgacccggactcttgggcgcggtctcttgaggtggggccggggtgagcagctgagtccgggtgccccggggaggcccctctgcccgatttcgcagcgctgcccatcagcttcagcggaggcctgattcctgaggtgctctgactggaaggaacctccgagatcggagagtcttccctgtctcctgttgatgctcccattgcactgataggtaaattgatccctagagaagaggctagtctgagatatatagcgagtgaggaaaagaatcggaatcatgatcctggtgccttagataaccagccccagttcttcccgtgttgctcggaacctctctaacttgggatggtcttccggtcggtgttgccccgcaggctgctgcaggttaaaggccagcgctgcgtggaacttttttttttctctcctcccaaattgagccgtttgaaatgcctagggagtttttaaaagaaaggcgggcacatccttgtatttacaggcagatatcctccctttcctcctcggctgctgctcttactttgacaagccaggctaacattgaaggtatgtacttctggacctgaaatcagacggctcaggtttggtctggcctcagtgctgagtgtctgtggccataggtgccttaaacttctttcagcctccttttgttcatcttttaagtggagatctctgctgaccccacaagattaaattcagcgtaacaaattgtgtttattctgtgccagcattttcccagatgcggggaatgcagctttaaaacaaaacaatgtagaccctgcccgcgtggagctagcagtgtttgcagggatgtttaagaagtaattataaatgttgatgagtgttaggaaagaacagggtgctctgaaagtatgtaacagggggttcaggaaaagcccttctgaagaagcagagtttttaagatgaattttgaaggataaataggaatgcgttcgaagagtggaatgagaacatttgagacaggttagcatcagaactgtgtcagttgaagctctttgtggggctctctcttcaagagaaaatccgggggcatatcagcacatttatcatttaccagacttttatttaatttatttatttgtatttttagtagagatggggtttcgccgtgaaggccaggctgctctcgaactcctaacctcaggtgatccccccacctcggcctcccaaagtgctgggattacgggcatgatccaccgtgcccggccccaccagacgtttattaagaccttaatatgtatgaggcacattttaatgagatagcctttgtggcaaagaatacagttcttctggagtttacagtgggagaggaaatagacaagtaaatgagggatggcttacagtgtcatagtgcatagcacagggctacaagagcacagtggagaaatacctgagccaggtgcccagggttccaggaggaaatgggaggctaactcttgaaatatttatttagctacatagggaatccggaaaagggatttccaggcagagactactacaggtgcaaggacctggagaaccggacagctgaaagaccatgacgagttcagtgtgactggaattctagtaatggctggggaagtggaggaagtgagatgtggtcaggtcagtcatatgtggaggacattgtaagtcatgctaaggaatttggatttttaccctgaaagctatggagatgctttgaagggttttatgcaggaaaatgatgtcgtcagatttatatttcagaaagttcattctgtcaagtaggaggggaccagccctgtggggaagtaaaacagtgtttggaagctcttgctgtagacatggcctgaactaagacagtggaaatgggaatggagaggaggcatcagatgtgagcaatattaagaagatagaatccatagaattggaggctgattatgggaatgaagaggtaagaatagcgcgattgcctggctttctggcttagggaactgaatgggtagtaccattcagatagagagtatgagaggtaaattagggaagtgacatgggaaaaaatgcattttgaatgtttttagtttgaggtgtttgtagcacatccaggcaaagatgtctaataaggtgggtcagctaaaggaaagagcaagagtaaagatacggaggcaggagagggcctaaattgttcagtgatactggggcctggagttttgcagaagaccagactgcaaaaaaggttagatgtcggccaagttgtgaagggctttttgtttgtttgtttgttttgagacggagtcttgctctgttgcccaggctggtgtgcagtggcacaatctcgggtcactgaaacctccacctcccaggttcaaggaattctcctgcctcagcctcctgagaaactgggattacaggcgtgcgccaccacgcccggctaatttttgtatttttagtagagacgggattttaccatgctggccaggctggtttcgaactcctgacctcgtgatccgcctgcctcgccctcccaaagtgttgtgattacaggtgtgagcctccgcacccggcgtgaagggcttttaatgccttgttgaatttgtttggatttgattttgtgggtggcagtttgctaattgatttgcccaggtccagcataaagaaatttctgggctgggcacagtgactcacgcctgtaatcctgacactttgggaggctgaggtgggcaaatcacttgagatcaggagttcaagaccatcctagccaacatggtgaaacaccatcactactaaaaatacaaaaattagctgggcgtggttgtgcatgcctgtagtcccagctacttgggaggctgaggcaggagactcgcttgaacccgggaggcggaggttgcagtgagctgagattgcactgctgcactccagcctgggtgatagtgagactctgtctcaaaaaaaaaagaaaagaaaaaagaaatttctcgctttttccagaaatacttcctcaattgggtaggcataattgatatctcagagaagtttaaataaaatggtagcagcaaaagtactttgtagaatacagcctgatgtgcaaaccaaaagtggtgatattgttaagattcagtgagtatatttttgctttggagtttagctattgagtctgtaaaatgttttgtttccaacctagggatgatcttttattctcaccctttttcctggttgcagttatttttttagcttttaaaaagtgactttcttgaggctgagttagagactagcctggtcaacatagtgagacccctgtctctaccagaaaaaaaaaaggtgacttcctcctttcagttttttgtgaagcattgtgaatcaaatttttttttacttaagcaaatgcaatgtgtcactggaagccgaacctctggtttgaaatttaatgctgagatttgaaatatgagagttctcgagcggtatcttacccaattttagtgattattactttgaaatgttgacatcagtttctttctttatttgtgctaacctggctttcatgacctatacttcagtttctctatgacaaccagacaaatctttttaaagttctctaagaagaagcatttttcatcttgttagtcttcactgacttcatatttacaaagaataaattctgaactcttttttccatcttacagaattctctacagtttagacccttatcttaatttttattagatgatacaggttgactttctaatttagaaagtcgtgaactagcattttacttaaccttttgcacctccctatgctccttattaaattagaacagggtttctcaacgttggcacaattgacattttgggccatataattcttttttttttttttttttttttttttgagacagagtctctatctgtcacccaggctggagtgcagtggcacaatctcggctcactgcaagctcagcctcccgggttcacgccattcacctgcttcagcctcccgagtagctgggactacaggcgcccgccaccaggcccagctaattttttgtatttttagtatagacggggtttcactgtggtcttgatctcctgatctcgtgatctgctcgcctcggcctcccaaggtgctgggattacaggtgtgagccaccgcgcctggccatataattctttattatggagttgtcctgtgcactgtgggatgttaagcagcatctgtctctacccagtagatgccaataagacttcctcagttgtgacaaccaaaaatgtcttcagacattgccatatgtctcctggaggacaaaattgcccctggttgagaattgctgcgttagaaagtatcgtagctatgattgtacaatgtccccaactaaattctgtgagggcaggccccatagccatacttagcacagtcgatggtacatgataagcactcagtatcctacaatgaatgaatcatttgtttctgttgaagcttcaagaaattactgttccttcaaggaatttctgggtgggcaggttggagtacaatggtgcaatcatggctgattgcaacctccaacttttgggctcaagtaatcttctcgcttcagcctcctgagtagctgggactacagttctttttctttcttttgttttttgtttttttgagatggagttttgctcggtcgcccaggctggagtgcagtggcgtgatcttggctcactgcaacctccccctcccgggttcaagcagttctcctgcctcagcctcctgagtagctgggactagaggcacacaccaccacactcagctaatttttgtatttttagtagggacagggttttgccatgttggccaggctggtctcgaactcctcaagggaaccacccacctcagcctctcaaagtgctgggattacaggcatgagccaccatgcgctcggccaaatgtttgatttttttcagagacagggtcttgctatgttgcctgggctggtcttaaacccctggcctcaggtgattctctggcctcagtctcctgagtcactgggattacaggcatgagccaccacacctggcagatgtgatcttaagagaagtgccattggtttgagtactagaagcaagcttcttgttgatggtgtaagtcagcagatttccctctctattgaaaattgtgtgaattcctgttttgtttgtgttccttgtatttagagtgcttggttttagtggacagggactatcatttattttaaagttgcatataggctgggcgtggtgattcacgcctgtaatcccagcattttgggaggccaaggcgggtggatcacctgaggtcaggagttcgagaccagcctggccaacatggtaaaaccccgtccctactaaaattacaaaaatttgctgggtgtggtggcatgtaccgtaatcccaactactagggaggctgaggcaggagaatcacttgaacccggggaggtggaggttgcagtgagctaagatcgtgccactgcatgatctgcgccagcttgggtgacagagcaagactccgtctcaaaaaaacaaaacaaaacaaaaaaaaacaaacaaacactaaagttgcatatagtttatggagttattcacatttattttagttgataaaattatacagtcatgtgttgcttaatgacaggtacattctgagaaatttgtcattaggtgatttcatcattgtgggaacatcatagagtgtacttgcacaaatttagatgatactgcacatggtgtaacttattactcctgggctacaaacctgtatagtatgttactgtatctaatactgtaggcagtttgtaacacagtgtaagtatttgtttatttaaactttttttttttttttttgagacggagtctcactctgtcgcccaggctggagtgcagtggcacgatcttggctcactgcaacccccgcctcctgggttcaagcaattcttctgcctcagcctcctgagtagctggtactacaggtgcgcaccaccacgcccagctaatttttgtatttttagtagagatggggtttaactatattggccaggctggtctcaaactcctgaccttgtgttctgctagccttggcctcccaaagtgctgggattacaggcatgagccatcgcgcccggccacatttttaaagtacagtaaaaatagggtattataatcttatgggattttgtgttgattaatccccatataatcccatataatcttatgggaccactgttgattttgtggtccatccattgaccaaaatgtcattatgtaatgcatgactgtagtttcataattttaaattaatgcagctacagcattcaccatgaaattatttcttgatgtactatatgttaacctgataaaaacaaagttctaaaaatatgcctcagctacagtgctgctttgtttgccttgtattaccagaccttttgtgccaaacttttccatttggctggaaaatagttgaaatgtttaatggaaggagcagacttgctttgttttgttttgttttttcctccagagggcattgaaattcctatactttagttaattatagacttacagtctttccatattcctacttgtagatgaatcatggctaaggacaaacgtcatccttgaatccatctttatatattagagtgggaaatgctgttttattaaagcaactattcaggctgaaatcagccaatgcagttttcccttacacgctataaaacatgtagaagtagaaagggactgccgagtgctctgtgcaattagtcttcataatattctttgaacgtaggagagaagagaacccatgaccacacaaagttacctgtttgctccagacattgaaacagctagttcccaagtctaatttcactttatacactaactttactcactcctggagtttcaggtagaggacatgtgtaaggagggaacaggagacaggtgttgatgttgggttggattccttccctccgtagaagataggcctttcttttaaaatctaaacctcgggtggcagtgactcaggcactaaatgtcattggtttaatcagtgaaaccaaatgcttagagaagaacagtggctcctgatttgggttagatttagatggcatcttttttttttttttgagatggtgtcttgctctgtcttggctcaccgtaacctccgcctcccgggttcaagcagttctcctgcctcagcctcctgagtagctgggattacaggcatgagccattgcacccacccaccatcacgcctggctaatttttttatttttgtatttttagtagagacggggttttgccatgttggccaggctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgttaaaacctcgtgataagaattcattagaagtagaactaactactacatagtttagtggtaatttagaagggatagtcaagtagagatttttattattattataaaatattatatgttaaaagaaagtttggaaaacaggtagaaattgtcaaaaacccatcacccaaatgtgacaaatattgtaaattttgcgttcaagtttttttccacacttcatttagctattcccctataattagaagtccaagatagatatagatagatcaatagatctaacattgcagcaaacatctccatgcttatcacttttctcacattatgatttactttcttaggataaaacctcaggaacaggattacaaaattaagagaagcattttgaagcaaatcaattgggctaccatagtagacaggctgatttgtatgggtgctttattttcaattttacctaaggatgatgacttagaaaaacaactgtgggacaaagtagaaaacatttcaagcatagcaacttcctactcaagtagaaattcatgctactgtcttaattgcctggtgggatgcaacaagaactgcacgcataacctggttccatttacttctgaatgacttccttgaataggcagaaggaattgggttaagttgttagaagtataagagtgtgaagcagctttggcaggaatcactagccatttctaattttttttttttttttttttttttttgagacagagtgtctctctgtcgcccaggctggagtgcagtggcgcgatctcggctcactgcaaacctccgcctcctggattcaagagattcttgtgcctcagttctggcagaaggtggtgtttttacaagatgatttctaggattacaggcatgcaccaccatgcctggttaatttttgtatttttagtagagacgaggtttcgccattttagccaggctggtctcgaactcttgacctcaggttatctacccgcctcagcctccctaagtgctgagattacaggcctgagccactgcgccaggcctggttttttggtttcaaaccacaatagacattgctggagaatcaagctcatagtttctttttactctgcatgatatccctccaaaagcttgtctgttctcatgacttcatgacagttctttgccaatgatttgcaaacattatctccagtcttgattctttcctaggctttatttctaaatactcactagtcatttccacttagaagctttgtcttcttttcaaactcagcatatccaaaactgacctcatcttgttgccctaactagaacatgccacaacccatttctgcctataatgtcattattctcttaaggcccccatatttgcaaatcaggagtcatctttgcctcccttctctgaatgctgctgtgctcacagtcagtaccatacagttagtacttgttctcagtttaatgcacacttgtttcatatgacctcctagggcagaaccaagattcgtgggtggaagttgcagggaggcagatttgcctccatataaggaagaactttttaatactttgagctgtctgaatggaatggactgcctccagaagtctcgggttctccatcactgaaggtgtttgagcagaggctgcctgactaattgctaattgaaaggactgttctggcataagatggtgtttttacaagatgatttctagaatccctctaatcctgagagccagtgagtcgatagaaggtagctttgtctctcctgctagactcccttaggacagggagactattttacctttcttttatattctgtacagcacttaattcaggtgctggtctcttaattgcctaaagatgattatttacaggttaattgattcttttcattttgttccaatatttggttaaacaccaaatattgtggatttttttcctttgaaatatcttggggagaccaaggcaggtggatcacctgagatcaggagttcgagaccagccaggccaacatggcgaaaccttgtctctactaaaaatacaaaaattcgccgggcgtggtggtgcatgcctgtagttccagctactcgggaggctgaggcaggagaatcgcttgaacctggaaggtggaggttgcagtgagctgagatcatgccatcacactccagcctgggcaacagagtgagactccatctcaaaaaattacagtaataataaataaatacaaatatcttttgtagtagcattattttagatgaataacagcttttaacctaactttctagaccctaatatcatcacttgtctccacatcccattctgtttatcagacagtacttgtaagctctttgctttcatcatattattctttcactcaaaacccttgaatggcttcacattgatcacaacgtcaaatttaaattttccctggctttcagtgccctccatcatctggcccagcttgctcatgcatccttgttccctataatactccatgttccatgcaggctaacccactcacattttctgtacatagcctgcttggtctccttttttgcttttgacttgctctggaatggcttcccttttttctcttgcctcttcaagatgcctcacttccctcctgaaaccaagctaccgccagtcctcattgatttcctctgaactctcagagcatgtagtaatttatgtaattcagaaccgtagcaacaacattctgtgaagaaaaatctgcaagaataggctgataatttaactttccctaatccaactggatattcccataataaaacttttaaaaatataggctggctgtcatggttcacatctgtaatcccagcattttgggaggctgaggcaagaggactgtttgagcccaggagtttgagactagcctgagcaacatagtgagactctgtctctatcacacacatacacacacacacacacaaaagccaggcatggtggcatgtagttatagtcccagtagtcccagctactcaggaggctgaagccaggaggtcaaggctgcagtgagctgtgaacacaccattgccctccagcctggtcaatagagccagaccctgttttttgtttgtttggggtttttttgttttgtttttttgttttttgagatggagtctcactctgtcgcccaggctggagtgcagtggcgcgatcttggctcaccgcaagctccgcctcccgggttcatgccattctcctgcctcagcctcctgagtagctgggactataggcccctgccaccgtgcctggctaattttttttattagagacggggtttcacagtgttagctaggatggtctcgatctcctgaccttgtgatccgcctgcctcggcctcccaaagtgctgggattacaggcgtgagccaccgcgcccagcctgtttttttttgttttgttttgttttttaaataaaagcagaaaaactttaacaaatataatctacagtatttattccattcacattttattttgttgtcttaaccaatatgagtgcttctggaggggagggaccatgtgtcttctatttcttcagtaggcccacaatgctaagcactttgattttattagcatcttctgtgtgcctagtttttctaggtgctgggagatagagtcagtgcaggaggtagaatggataaattcccatccttcttgagcctatattctagtacgtaatatgtagtgctaacattttacatttgaattgcattttaaggcttctgaagtgattactcgtatctatgaaatcacctcctttgatccttatatctgtgtatgctagatgaggattataatccattatgtgactgtgtaaagttgcacagttagtatgtacagcttgggactcaggcctcagtcttctaattttatttggacttgtgtaattttgaccacctgtgtttctgaagcttttatgatgaatgcttaagtagttgggaatccggacattcatttatggaggtttacgtatagttcttggttattgacaattagaaatggcaaggagcaagattaggcagacatacagttctctgctctgatacttctgtgtttgggagaagccttatttatttatttatttaaataaaagagatgagattttgctatgttgcccaggctggtcttgaacttctggccttaagccatcctcctgccttggcctcccaaagtgctgggattataggtgtgagctatcatgcctggcctgagaagccttattttaaacatttgctttccaaatatgtctcatctatcctgaatgtgattgaaaaaaagttggcctccatggagaaaattgaaagcagaaaaatggaagatgctggccaggcgcggtggctcacgcctgtaatcccagcactttgggaggccgaggcaggtggatcaccaggtcaggagattgagaccatcctggctaacacggtgaaaccccgtctctaataaaaatacaaaaaattggccaggcatggtggctcacgcctgtaatcccagcactttgggaggccaaggcgggcggatcaccaggtcaggagatcgagaccatcctggctaacatggtgaaaccccgtctctactaaaaatacaaaaaattagccgggcgtggtggcaggtgcctgtagtcccagctactcgggaagctgaggcaggagaattgcttgaacccgggaggtggaggttgcagtgatctgagatcgtgccactgtacagccagcctgggtgacagagggagactccatctcaaaaaaaagaaaaatggaagatgataataatgtaactaaagacaccataaagagaccttgagcccatagtgctgtgcaaacaagttggggctggatactgtgattaaccatatagtcacttaatttgttaaaagccattgtggagtagcaagaagagctgcagagtaggattcagaatatttgtactctaggcctaggttctttactcactagttgtttgacctctggcaagtttttttttttgagatggagttttgctcttgttgcccaggctggagtgtaatggcgtgaactcggctcactgcaatctccgcctcccaggttccagcaattctgccttagcttcccaagtagctgggattacaggcatgcaccgctactccaggctaattttgtatttttagtaaagacggggtttctccatgttggtcaggctggtctcgaactcccgacctcaggtgacccactcacctcagcctcccaaagtgctgtgattacaggcatgagccaccgtgcctggccatctggcaagcttttaactgctgtgaatgtcagttcagtttcttcattctaaaaatagggatcaatgtctgcgtaacataccttgcagaattattttaagtctcaaaagaatcaacagattaataatgttaagcatttacaactatacagaattactatatttaattgatattatatattctaagaagagtactttccttatggtacttagtttgaagatctctatatcagtgtgattcgtggctgagaaggcaacatttatttgaaagacaggagggtttgtaaggtcctgcaaaagcagataagcaaaaaattaaaacaaaacaaaacaaaacacttctccatggattcgatagagaagatagccacactgtgttgaggggagagtgagtaagagcctttatttatttattttcttactcaaacacctttattagcccactgttcttttttttttttttggaaacataatctcactctgttgtccaagctggagtgcagtggcgcaatctcagcttactgcaacctccacctctcaggttcaagcaattctcatgcctcagcctcccaagtagctgggactacaggcgcataccaccacgcctggctaagtagagacgaggtttcactgtgcttcccagctggtctcgaactcctgagctcaggcaatccacccgtctcggcctcccaaagtgctaggattacaggcgtgagccaatgtacagtgtttttaatgcctcctatgtttatagtagtggaattacagtggcaagacatggtccttgccttagggtggctagttgcctgttgactgttagaggagatcagatgcattcaggggattatggccataaactcttagactctgaaggctattaaataaattattttatttttttattactaatgtcttgagacagaatcttgctctgtcacccaggctggagtgcagtggtactatctcggctcactgcaacctccacttcccaggttcaagccattcttgtgcttcagccactgtagtagctgagatcatagcatgcgccaccatgcccaggtaatttttgtatgtttagtagagatgggatttagtagagacggggttttgccatgttggccaggctgatctcaaactcctggcctcaagtgattgcctgtgttgccctcccaaagtgctgggattacaggcgtgagccaccatgcccggccaaataaatgattttaaaccagtgtgtgcagtgttgtgacacagataagtgcacagtgttgtggtagcacatactagaaatacttccccaggaggtgataacttagctgagacttaaatgacaataggagttctagaggggcagatgggaaagggaaaacatctaagcagagtggatagcattataaaggctcagaagtgagagaaagcatggctttttctggaaaacgcaagtagtcccgggttgctgtagtgtgctaaggaaaggtgtagcaagagataaaacaggagtggtagaagattaagcaggactagatgagagaaacccttgtttggactttaccctgaacgctctggggtatgtgtcaaatgcaactctaatatcatatcttaaatgcaaatataattataaatatttctttaataccattcagtactctgggaagtgttgagatagatcactctgactataatatggagaatggatgaacaaagtttattactgtaactaggggagactagccaagaagtcattgcagtaatcttggtgaagtcttgatatcctttttttttgagacaggatcttgctttgttgcccaggctggagtgcagtggtactcatggcttactgaagcctctaccttctgggcctaagccatcctcccacctcagtctcccaggtagctgggaccacagctgtacaccaccatgcttggaaaaattttaaattatttttgtagagacaaggtctccctatgttgccccggctagtcttgaactcctgacctcaagcaaccctcctgtcttggcctcccaaagtgctgggattagaggagtgagccactgtgcccagccagtatcctaactcttatcagtcaggatggaggcaagaggcatctattcatgagatacactaaatagagcctatggattttgatgactgataagatgttgtgggggagtttatggaatccttactattttccaggactgtgccaagcacttctacatggattccttcatttattctcactgaagccctttggatttttgtgctattattgtcttcattataaagataaggaaattgagtctcagaaagtttgataactgcttatagtcacaaagccactgcatattgttattcaaacctccaatctctctgatttctctaaagaacactcttatccactatataatactgcccaacagtttccagttactgacttgatcaatcaggtgattgatagcagtgctggagcaatgttagggaatatgatttctgcttttggacatttcaggttgcctttgggacatccaggtagcgatgtctaggtgaaagctggatttttttttttttggagacagggtctcactctgtcacccaggctggagtgcatggtacaatcactactcattgcatcctcgacctcctgggctcaggtaatcctcacacctcagcctcctgggtagctgggactacaggtgtgtaccatcatgcccggctaatttttttattttctgtagagatggaattttgccatgttgtccaggctggtcgtggactcctgagctcaaacacttcctcccatcttggcattccagagtgctgggattgtagttgtgagccacagtacttggcctgaatctaaaatttaatcccagatgaatggcctgagctagatggatatgctgctctggtagtctttagtctataggtggttatggtggtaccacctcgcaaataggctgggtgttactacaacaagggtagtcagaggctttaggagtgtacatgaccaccggaagaatgtacgtgtgtatagagaataagaaaaggtgtgtctttcacacaactgaatctcattctctacacacacatacaatgtcatacttaaattctggacattattttccataacatctcaaatctcatcttactcccaccaagagcaaaaaaaacagtttctgttcttttgtatttggttaatggtagaatgagattagctataaatggtagctgtattgtcctttttcattctgcttaagtcagacagcggaactttagcttgtttagcagtgaaagcctataaatacaaatgaaatatggaaaaagggagccaaagtcccatgaagctctattattaagcatttaagattggtaaatgttcacaaactctggcagcctctagcaatacatgtactgtgtctccatgttaacagtggtctcaacctgaaacatccatgtatgaaggaacatgttttaataacagaactgagtggtatctgttcatggaaggtagcttaggagtttattgcgttccttgccttttcccctggacttacagtgtggtggattgtatatatatgtgagtctgtctcttgatcagtatgcataatggaacagggcaggaattcagatatcagttgatagtgtcataacattagggaaagtatgttgactgcttatggtctgctctatttgagagtaggacatagacctggaggcttctgctgctgctgcaggccaaggaatggaaaggtttgtttggttctcattctcattttttttctttgcttctcttttaaacaacactctctgacaagtgattgggcccacagagaccagagcctgtacacagagaatggacagagactatattgtcttccttactttatcttgtgagctgcttatctcttccacagggaggacaatgtgttaaattgagataattctggcatgctgtcatctttgggggaatcataattgctgttgtcattttaggcagcttcaagggagttgagttcattcagcttcagttacctgaactgaattcagttgcctgaattgacgcttttgtgaaatggaatctttccaagtcaaagcttggattgaaatttcactgactggtttttatgagatcacttagggtctcaaatactttatgtagaggtgcattgatcatattttacacttatgtgtgacttatgggcaacttttagcacccttatccctctggagttttggaatgctatttgtgaggtttataacttcataaatatttattgaacatctactacctgccaggtagtagtctagatggtagagtatacagtaaggaacaagctatataaggtcctttctctgttggagcttactttctttgggatattagacattgaattaggctatttcagataagatagtacttgtgaaagatctataacaaattcttttggatgtgtctagtgtccttccctactgcatgtccagatctttctcatcttcatttgaaggctggctcaaatggcagcttctccatcatatccttatctgatccttccagctgatatattactcccctctttgaaatctcatgcctctctatcagcaactttcttatgtcaccttaacatttttttctatttgtttcatagttgttagtgcatatgttaagtctccccattagactataaattactgagggcaggccgggcacagtggctcacgcctgtaatcctagcactttgggaggccaaggcgggtggattacttgaggtcaagagttcaagaccatcctagccaacacagtgaaaccctgtcgctactaaaactacaaaaaattagctgggcatggtggcgcacacctataaccctagctacttgggaggcaggagaatcccttgaacccaacagggtggagcttgcagtgagctgagatcctgccactgcactccagcctgggtgacattgtaagactttgtctgaaaaaaaaaaaattattgagggaagagtaaacatcctattcatcttggtttgggatatttcacatgcaggcagcaggatgttgtaggaaaaaaacacactgaacttagaaccagaaggatcagataaggatatgatggagtactggcttctctattcactggccgtgtgactagacaagtcatttagcttcactgaaactaagttttctatctctaagcgtgtagtaatcatccttctattcctgaatagttgtcgggaggctcaaactgagataatgtatgtgactatcctttgcaaattctaactttctacacacagtatcatagtaaatattgagtatttgaatgagtaagcatttactttagtgaacaccttttcctgagcagttctcttgcttaatgaggtcttttgattttgtaaatatgctacttttttatctgatatttttgtattgttccattttgcagatgatatctaattttattaaattattctgttcctgagaattggcatcctcttcatccacctggggatgaccaggaattttctgtttttttctctgtaggtgctatttaatatttaaataacaaatgacatttgatctgtttcagcaggtggtccattatggctgacatgcaaaatctggtagaaagattggagagggcagtgggccgcctggaggcagtatctcatacctctgacatgcaccgtgggtatgcagacagtccttcaaaaggtaagcagtccacagcccagcagaatgctttctttgagcgtcttggcctgaaaattttctattattctctcctttggcgctaacttcccaaaacttaatctagaaagtttaccttttgtaatttgtattgctgtgaacagataagagaggaaatgacttgtacagggaggcctgtggttaagttattttaacacaagaacttcctgcttgtgcaatatttcctgctctttctttagcagaatgactccaatgtaagtcaaatgacaagtgataataaaattcctctctccaaacaattggcaaattggacattttgcacatgcaccagttggaacatagaatgttagcactaaaaaaaaccttggaggatcattttgtttattttcattttatagataaagaaaattaagctcagagaggaaaaggaatttagtcagggtcacacaaccagttagtggtgatactggacctggaacccaggtttccttactcctgttctgtatcctgttgactgtattaccttgcctccccactttcatgtagaagcacgttttaaagaagcctccttctgatgcatggctgattctttgtggtgtgtttgtctttagcaggagcagctccatatgtgcaggcatttgactcgctgcttgctggtcctgtggcagagtacttgaagatcagtaaagagattgggggagacgtgcagaaacatgtaaggatgttttgcctttttccccttcttttaaggactaacagctttcttcagtcagccaaggtcctcatccttggtttaagagctccttgagaagttcctcttggtttggggcattacacatgttctttctcttttgcctgtactgaggagttcagtctagccacagaaacgattcctcatttttttctaggccccttgcttttatcacgtatttatacagaaagcttgcttggtacataaaatatggttctgttcatctttgtagtgaagaatatgcaccagtttgatcccaacatattacataatcaaacctacagtggcttatttaaaggagtcattatcatgacttagcatttataaaactatgcttgatagttattagttatgctaatgtgggttattttcacacttaacccacagcaagaatatgaagtaggcaatgacaggtgcctttcctcccaccttcctttatgcctcctacgtcatcaccaccaccccccacccccaccccacactcacatatacattctacctctatttttgggacccaaaaaccttcctgctagctcaccgaattataaacagtaaccatgcttgggaacttcttcacctaaacctttctcgaagactggttgcttggcttttggaaaatctattttgagcctctcaaataccatctgttgccaatggttttagctctagagagtgggactgggactttaataagggtgtggaggcttgcatttttacttaatacagttctgtaacatttgaaaaaactttaaaacatttatcatttgtattttaaaaatgcaaatccagaaaaaatagattgctttctttgaatttttgtattttaatagtgcttacagtctcatgtttcttaaattcttttgactgcgaatgacccttagaaagaaagaacatattcgtaactgagataaaagtttcacaagatgatatttatactacttctgctgtactttttttttttttaactttttatttggaaataacttgaagttggtgcactgcactcatacttttgttccattaagctcactaaattgatttaattatttattaatgggtcatggtatctggcatttgagagatagctttaatctaaaggagtaaataccttgagaattttcagcagaaatttaggcctttgcctttactcctgtctccaatttttgagaaaagaaaggtgtttttttggttgctgtttgttttattttgctgatgtgaaataggaaggatttttcagtgcacggtatcacaatgcatgtgtaagatgctaacatgacttcatgtaagctaggtgattatccaattaacttcacttccaactctggatatatatccctgatgagttccaataggaacagtagtgtatgtaattctgctctcagtccctggaatctggaatacatgaggaggataacatgaagtgcctgggttgctatcagagtacatggaagtagaggtttcaggttattcttatcaagacttctctagttataatgtgtcatcaatagctgattcttctttctggcaggcggagatggtccacacaggtttgaagttggagcgagctctgttggttacagcttctcagtgtcaacagccagcagaagtaagttcactactagctggtttcattttggtttgatgctcaggacgagttgagagatttatgtcaagctattataacattttaaaatagacctactaggcttttgataatatatgttcataccaagtcccagaggtagagccatacttcaagtgccttaatgggaaggtactattgggtacttaatggtctctactggctttttctctgtcattttgcataggactgtggttatccctgggactttgcttgcctgcctctttgctgagtccacattcatcatagtgtctccaaagccctttaaagatgattctcttgcttcactgtggatgggctttagtagtgctcctgtggagatcttaaaactcctacagtattgcttctctcctcatccttcactggttgggagactctctctttaattttactcccacctcaaaattttatggtgcaagatgtgaaaagttgaattagagaaaatttagatttctcttggagtcaaagaatataggtttccttcttttgcatttggttttcctagttacagaggaataataaagcaagttgtcctaaatgctgtattaaaacccttgaccctcagcatgcctagataatataaaaatagtgcaagataatgtcaaatatattagattctggttaagtgtgctggctcattcctgtaatcccagcactttgggaggctgaggcaggaggatcacttgaggccaggagtttgagaccagcctgggcaacatagcaagacctcgtctctattaaaaattaaaaaaataaaataaataaaaatagccaggcaaggtggtgcatgcgtatagtcccagctacttgagaggctgaaatgggaggaagatttgggcctgaaagtttgaggatgcagtgagccatgaacacaccactgcactccagcctgggcgacagagcaagaccttctctcaaaaaacattgtgtgtgtgtgtgtgtgtgtgtgtatagatgccatctaattctaatatgtagaattagattttaattcttaatctgtcctgaatggttaagatctgagaattgagatgttcaggaaatggagctttggaggaagggtgcaaacacaaacaaaattcatccattttgccaaggtgcctacttgaatgctaagcccctaattgttttttattttatttatgtttaaaaaaaaattttttttttgagacagggtgttgttttgtcacccagactggagggtagtggtgcaatcacagctcactgaagccttgacctcccaggtgtaatgatcctcccacctcagcctcctgagtagccttgactacagtgtgcaccaccatgcctggcttgcttatttacttacttatttatttatttatttctgagatggagtttctctctgtcgcccaggctggagtgcagtggcaggatctcggctcactgaaacctccacctcccaggctcaagtgattctcccacctcagcctcctgaatagctgggactacaggcatgcgccaccatgcccagctgatttttgtatttttatagagatggggtttccccatgttgcccaggctgatcttaaactcctggactcaagcgatctgcccaccttggcctcccaaagtgctgggattacaggcgtgagccaccatgcctggccctaattctttttattatttgtagagacaaagttgtgctgtgttgttcagtctgtcttgaactcctggtctcaagcagttctcctgccttggcctcccaaagtgctgggattacaggcgtgggtcaccatgcccagactaagccccctaattgcatttgattcatcagttctttacagcagctactatatggctggcaatgcattgggggctttcatgatgataaaagagctcgtctttgaagaattaatgagaaagtaaaacatattcacatgggtccattaatagtttgtattggtgagtgataaaatgccaagattggttatgctgacaacaaatgctgtaggaggctggtgtggctgggttggagggccctcatgaagcatgaggaaaatttggattcatgggaaaaaaagagaacatcatgagtaaggcacaggaatgatgtcctgagtgtatgtcctctgagtggaacaaaaaagagacaggtggctgaaatggaggttctgtggtatagctgaagtatgggtcctgatcatgaagaaccatcaggtgcagcctgaggagttggaactctacgaggagagtgagatgatgagcagtattttagccttaggaatcaggacaggactcatgcagtttatttgggtgctcactagagtccatagagaattcttgccttcaggatcagaaggcatagacacctttgtggaaagatgttaacctgaatcttttcttgtatcttttcctagaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggtgagcagcgcagattccagggctgggggtgggtatagattttaagagggaaggcaatatagttggagaggtcctgagtcactgacagcttgtctctctctaggctcccaagcctggcccttatgtgaaagaaatgaatgatgccgccatgttttatacaaaccgagtcctcaaagagtacaaagatgtgtaagttcagccttttctctctttttttcttttctgagacagtgtcttgcgttgtcacccaggctgaagtacagtggcacaatcacagctcattgcagcctcaacctcccagctcaaacaatcctcccacctcagtcctccaagtagctgggacttcaggcacgctccaccatgcctggctaattttctaattttttcgtagagatgaggtctcactgtttcccaggctggtctctaatgattctcctgccttggtctccccaaagtgctgggattacaggtgtgagccactgtgcccagccaagttcagctttttctcaaggggtaaaggataaacccatttggttacttgctggagtagcactttggagttactgagggctgcccttagccactgtgctggttttatctcagggctgctttctggagagctttacagatattgtctcacagctgcatttgcaagcaggaaatacttctgcttccacttctgctttctctccttttttggtagaggcccttttagtcttctgatccttacccttctgggtttaggaagttttgctggcagtaacatggactaatgccctttatataagattttgttcctttgttgagaatttgttactggcccaatggcaaagggttcaataggacttaatagaaatttttcatgaagtcagttaaagtgagagtaaggctgcctagccaatgcaggtattacgtagggcagtcattgcatgtctaaccacatacgtctaccagttctgacttctccattgctggttttgagctggaatgattgcaggcaaaatttattaagttgcatatctacacaagcctttcctttcttccatccttcatcaatcaacaaacatttattaactactctttttaaggaaaactacaccttcctgtgagtgaaatgtgtcccagaacaacaggcacttccttatccttctagcaacatggaattaagcatgacagtgttttgatatatcccaccattatcccatcactttacagttgaggaaactaggtcttaggctaaataaccttcccagttaatacataagaagagaggggacttgaaccgtaggcacaatgctatttctataatttaaggctgattgtttccccctaagggaaagtttttaagtttgcttttggtcagggtgggcatattttgacataaggcattgtctcataaggcagttaagtttcttagtctttagagttccacagtgatacttaagagctctcctctctaccatggttttatgcacagaatgtctgcttttatcagttttacatattagattgtgtttaaggtctactttgaaaaaagtttcaataagcagcaagtggtcaaaagaaaaaaaaaagttttggtacttaaaacagtttgagaaacattgctatgagagatagagatagaatccagagtctctatcttagtggagtttggtctgattagggtaatagactaggttgtatatacatagaagctggtgatgatagaaaagctgccattgagcggagcctaagaaacaccacgggtaggagaatgtgagcccataggaaagaagggttctggagtcaccactgttatgtacccggatcacctgtgacaagttcttctttaatcctcccagggataagaagcatgtagactgggtcaaagcttatttaagtatatggacagagctgcaggcttacattaaggagttccataccaccggactggcctggagcaaaacggttagtgaatccttcctccctccctccctccctcccactttctctctccagcatggggtccacaggtttcttagacttcagcactaccaaagtctgtgagggaatgctagttttttcagtggaagggaggaagaaaaggaggagaaagaaagggtaaaaagagtagaggaagcaaggatcagaggagaaggaatattcagtggtattcaatttcaataaatatgttagggacagtgattggtgctggagcaggagacacacacaaatgagttacactatcccagcctttaaggagcttaaaaataagaatgcaaaaccccaatacaaatcaccaagccaaatgctataataaagatacagactagagtatgaggaagagaagagtgcttctcactagaagagattgtactttgaaggtatatactcttctgtgagacttgaaagtagtatagggcagtgagaagtgggatactacaaaaggcacagcttaaacaaaatacatgcagagtaaatgtagagattggtcatctctggcttcaataaggggaaatgatcagaattttaggagaaaaggctggaaaggaaggtaggctgagactttgggatgaggtatttgagcaagggagtgataatgattcaatttgtctttaaaagagtctcagtgtataggttagggataaggactcatgctcagattatgaaagtggtcatggtgtttgggggatagtagaaaaacatttgcaggagatagcaccaagataatagagatttgataaggtcgaagaagttggaatcctcaaagaagattgaatagtcagtcttggatagtaacatctttcactgaaatagggacaaggggatgattgtacagggagaggagcggcaggaaatgatgaaatcagttttgaatctgttgaatcagaggtactggtaacacactaaggaagatgtcaagtagatttgtggaaatagtttttagagctggaatcaggtgagttcaaaggcaaaatgtgatggtcaagaaatagaactgagagctggatccttgggaaagggtgagaaggcataaagccaagttgggtatgggtaggacacattaatcattgcctcaaaggctgtggtggggaccccatgtgcactggcccatgtagggcactactgggaatggtacagaggggagcagagaggatgatgatgttacctgcacttattgttccaggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatggtgagtgagcacttggacacgaacagtaggtacaacaagttgtgtgggccagaccccaccaaccagaaccgtctgtaaactacaaccctggcttgtgtggtggagactcgtttggtgtgtcctgttcctttaagggacggcaaagctggcttaaatggaaattgaaaatgatgatcacagttggaggaagccatctgccccatgggaaagtgacttaatattaggtagcatatatagaggaccctcttgtgccaaggcacagagctggcggttttccccagagctttttccgtggcaccacatggcctctgggaaggcattgtgttagggagttaacttcctcagaagatgcatactggttacatggaaaatttgcatgagagtgacctaatgttggtataaagtagatacccttaacacagctggtggaagtctgagttgtccagccacttctaggaatctatgatcatagtagctaaaaatggtgtaacaacctaaatccaactgtaagagaaatggctaactaccacatgtcctcttgatgaaatgttttttatttttttattttttttgagacggagttttgctcgtttcccagcctggagtgcaatggcgcgatctcggctcaccgcaacctccacctcccaggttcaagcaattctcctgcctcagcctcccgagtacctgggattacagccatgcgtcaccatgcctggctaattttttttttttgtatttttagtagagatggggtttctccatgttggtcagcctggtctcaaactcctgacctcaggtgatctgcccacctcggcctcccaaagtgctgggattacaggtgtgagccaccacgcccggcctcttgatgaaatgttgtgccaccattacatgtttttctacagtgaaccatgtaatgtttaagaaaaaaaaaatctagtatgtaaattacaaccacaaggaatggtggagataaaaaggccattcagtatttgttatacagttaacatagatctggccatgttcaaagcgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttctcctgcctcagcctcctaaatagctgggactacagcacctgccaccacacccggctaatttttttgtacttttagtagagactaaaaatacaccatggtagccaggctggttttgaactcctaacttcaggtgatccgcctgccttggcctcccagagtgtgggattacaggcatgagccacagcgcctggcctagaaagatattaaactacaggttaacatgagaaagtttttaagtgtcaatagttgaactaaatttgttaacaatctgtatgattataaccaacaaaaccaaatatatgtagaaaacaatattgtagagttgcaaatgccaacactgactgaggaggtgggggaagtagggttagctgtggggagtgagggtatttttttcttttccttttaccaaattttctttactaccactcatttttctttattgctttaaaaattatatatttgtgcacatacatttgatatgtctttctagacatagaggataaggatttacatatccttatcctcacccacaatatacacacattccatgttgttgttaatggaaccatataatttaatcttggggagaagagaaatgataaaagtacttttccaaaactgcttgcaagagaacatctcaaaggctctggttttggctttgaattttctgttaaggatgtttaacatgacgatagcagctcaaaggtctggtatgaaggacaggaacaaggtagctgttgttcttacagccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggtgagttaaaaatacctagacaggggcaggtatttttattattttatttttttgagatggagtttcactttgtcgcccaggctggagtgcagtggcgcgatttcggcttaccgcaacctccgcctcccggggaaaaggagtaggaacaggaggttaaatggagcttagctagatgagggcagagttctggcttcaattgcaagaacaaaaagtttgggatagcctggttattttttgttcggtgtgtgctttgtgatgagaatcctgggatctctctctaacaggaaaatcaggaaaatgtttccaacctggtgattgaggacacagagctgaaacaggtggcttacatatacaagtgtgtcaacacgacattgcaaatcaagggcaaaattaactccattacagtaggtgagtctttgtcgctgtcccacgcaagccccgtcccagagcccgagaaggctaataccattttacctaccctatccttaaagattcctaaatgtatattactttcctttaaagttacacgttgacacactccctttcttctcctagataactgtaagaaacttggcctggtattcgatgacgtggtgggcattgtggagataatcaacagtaaggatgtcaaagttcaggtaactcgatattttggctccttctttttgtccctgaggaattaattcaaagagacatggtagacccacagatgttgctttggtgggaatctgattctacaaagtctgtaagctgagctgctttggacgtggcagaagaagggttggctcttcaagcaagttcttttcaggacccatcccaacccacccgagtatccagtgtcttgcgcatctgtgagcttttcatgtagttgctgagtcacgtgaaacaggaaaccttttcctgcgacttactgttgtccttcccaaccactgggactcagttctctttgtttactctgcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttgtaagtttcttgatctctttagtatgatgttaaaaacagaagggactgaagatttctggcattgaagaaagctattttatgaacattctgcactgagcaggtaaaaacccaataatgcacaccaaaagtacacagaaatgaggtagtcccatgtagtggagccccaaaggtaggtgctttctgcctaagtggagctcaaggtagcaaaaaataatggggatgagccatggcaccttgtcaggctggtgctataaagccatatgtactgttatttacaccccatagacttaatagtctgtccaagatcgctgaacactagaacatagcatggctctgtgggtttgtctcttgctacattgtaccgtgctcctggggttaagtggaagcaagcattgggagaaatgtgtgagatttagccccagctgttctttagctcagatttaaacctgctgtctcttctttatttgcagaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttg

SEQ ID NO: 35617 - DNA, 24754 bp, Homo sapiens
ggagagaaaaagcggagtcgccaccggagagaagtcgactccctagcagcagccgccgccagagaggcccgcccaccagttcgcccgtccccctgccccgttcacaatgtgagtgcgacaccccgccgagggaaggtcgccgagtgaggccgaggccgcgttgggggctccctggaagcggccccctagcctttctcgcatcggtggtggcagtcgttcctgcctgggggcgggaggtccaggatccttgttccggttaccgttggcgggtggaggacatttttcctccagatgtctgcttcccccacccctgaaccgttccttggcttccccatgccggaaatcctacttttacccctttggctgtctgggttactcgcctctttcggtaacttcaccctaggccttaagctcccggtagctgctcgccatgcggcgccctgaagcgtgaaccttcgtgggtcgcctctcggctgcttgggcgctccggttctgttgctttgtggtcccggggccaggccctgagtcgagtgcacctgtggtgggtgccgccaggtgcctggcggagctcctgggagagccccacgcggacctcgccgtgagctgcaggtactgctaggcaactagaaggaagccatgcccacgccgcaacatacttccctctccagtgtctgggtttcttgagtgtgggtacttccagtccgcctcctaactccagtctcttgaaaacacgggaggttgccaaaactcagccgcttccctggcagcgaggaggagttaccattgagcaggtagttccgcacgtgtcgactttggaaagatacggacattttctgtgtttcatgttctacttgaggtgaggtttcactatcttgttacagtgtaggatgaaataggtatgtagtaggcatttaattaacctacagtcgtcccaaagatcttaaatttgtgtggaggtgaatacagattctatggcagtcttcattttacgatgataaaggaaagccttggcgattttaaccggtaagaattcttggcactgccgcgtacagtgggaactgccggttttacagggtttttttttttttttttttttttttgacgggaggttatttttcaaggtactaactacgtcctaaaaggtatggagaacaattaaggtggaaccttttttttcttttgttttagactccattcagaagagagaagaggggagtgactttatgtctttggaaaagtaataaggatttgcttgattcaagtcatgatactgaggctgagtatattggctagaaatctaaagggatgcgtgaggctgaagcgagtttatcactgggaacaagcttctagagcacagcatgttagaatttttgaaggagccccctccccgaaagtgatacgtaatcggggttttaaaaaatttgaattaggctgggcgcggtggctcacaactgtgatcccagcactctgagaggccgaggcgggcggatcacctgaggtcgggagttcgagaccagactgaccaacatggagaaaccgcgtcgctgcaaaaatacaaaaaaaattagccgggcgtggtggcacatgcctgtaatcccagctactcgggaggctgaggttaggagaatcgcttgaatctgggaggtggaggttgcggtgagccgagatcatgccattgcactccagcctgggcaacaagagtgaaaacccgtctcaaaataaataaataaatttgaatgtatataaaatagtttttgcttttctatttgaaagctctcctaagtaatgtagaagggacatcagtcttaacctttcatactctgaaaatctgtaaggggaaattttttgtcagatgaggcattaagcagcttttaataatagagccaaacaacatatcttttcgcgaaaagtatgtttaaaattggcttgaagtagaagcatttgatggaggccacatgagatatttaaataggtaaggaacggctattactaggaaagtagatttaaaaacttgggtgaaaagtaagtgtaaggccaggcgcggtggctcacgcctgtaatccctatacttgggaggccgaggcaggcggaacacgaggtcaggagttagagaccagcctggccaatatggtgaaaccccgtttctactaaaaatacaaaaactagctgggtgtggtggtgcatgcctgtagtcccagctactccggaggctgaggcaggagaatcgcttgaacccaggaggtgaaggtttcagtgagcagagattgcgccgttgtactccagcctgggcaatagagggagactccgtctcaaaaaaaaaaaaaaaaaaaaaaaagtaagtgtagcagtagagagactattccaaaaagtagcctctctagttaaaaaataaaaatgctactttcatgccgggcggggtggctcactcctgtaatcccagcactttgggaggccgaggcgggtggatcacgaggtcaggagatcgagaccatcctggctaacacggtgaaaccccgtctctactaaaaatacaaaaaattagccgggtgtggtggcgggcgcctgtggtcccagctacttgggaggctaaggcaagagaatggcttgaacccggaaggcggagcttgcagtgagcggcgattgcgccactgtactccagcctgggcgacacagcgagactgtcttaaaaaaaaaaaaaaaaaaaaagaaaagaaaaaatgctaccttcaaaacgagtgattcaatgccacttgaagagtgttgggctgggggaaacaagtgttttgaagagaccagctaaaatattcttttaaaaataatatatgccgtttagtaaattcttcagggactcttaacaagctaaagacttaaattttaaaatgaaagttgtaagtcagttatttgaagtggaagaagcctttaatgggtcgtcatccagtcttaagaatctggctgataagggtttattttgttgataacttgttttaaaagtgttttttttggagacagggtcttcctctgtcacccaggctggagtgcagctgcaacctctacctcccgggctcaagcgatcctccttgcctcagtctcccgagtagctgggactgcaggcaagcaccaccatgcctggctaataaattttttttaagctctggggagagagagatttatgctgggtgtcttaaaggcttgggagtgtgttttctcatttgatttactcatttgctcttcagcgatttcgtagttacatttctttaaatcctaagttataaaagtttgtctcataatttacataaaagctcttaatttcggacctatcttggagaaggctgggatttttaggaccttcccccacttaagattttccgcttaactaaccttgccagagggtgctacttcgcattttctttttgaatcattgtcgttcgaccgattaaaaatagagaaaaagtaaaatgttttatttattttagagatgttggaagttgttgtttttcctgtctaatgtcttgtatataattaggaagttgtccagaaacttgcgtctctgattttggtaaaaatcttcctgtcattcagctgtgtaggaacgaatctccaaaataaaattgtccatctttagcctgcaaaacaaattgtcgtagtgaacatatgctatattgttaattgctataacttgagtatctgatggtgggtggcctttgttcagtattgatttcctgtgcactgtaacctggcaactggatttttaatttttcttcctgtgttcagttagactttaactagaaggcagtagaaactggaagtgaaaaatttcttgagtgcaagccagtgttttattgctaaattaagattctcctgactaattggattttctcggtttaaaaatctacaagctatcatttttgggtcttgtggttagcgattgtctcttttcaggggaaaaaaaacctttgtaaatatcaactgttcagaaccaatctcgctgttaaacacctaagatcatatttacgtgagctcaaaaaatactctagtgagcatattttgctatggaaatagtgtattgaactttttactatttactgtgtggatcggcaattacagttttggggttttttttgtttgttttttttgttttttttttttttgagacggagtttcgctgtcgcccaggctggagtgcagtggcgcgatctcggctcactgcaggctccgccccctggggttcacgccattctcttgcctcagcctcccgagtagctgggactacaggcacccgccacctcgcccggctaattttttgtatttttagtagagacggggtttcaccgtgttagccagaatggtctcgatctcctgatctcgtgatccgcctgcctcggcctcccaaagtgctgggattacaggcgtgagccaccgcgcccggcccatagttttggtttttgtttgtttttttgagatggagtctggctctgtcgcccaggctggagtgaactggtgcgatctcggctcactgcaacctccgccttctgggttgaagtagttctctgcctcagcttcctgagtagctgggattccaggtgcctgccgccatgcctggctaattttttttttttttttttttttttttttgagacagagtttctctcttgttgcccaggctgaagtgcaatgtcacggtctcggctcaccgcaacctccgcctcctgtgttcaagcaattctcctgcctcagcctcccgggtagctgcgatcacaggcatgcgccaccatgcccggctaattagtagagatggggtttctccatgttggtcaggctggtctcaaactcccgacttcaggtgatcacccgcctcggcctcagaaagtgctgggattacaggtgtgagccactgcatctggcctaattttatatatttttagtagcgatggggtttcaccatcttggccaggctggtcttgaactcctgacctcatgatccacgcgcctcagactcctagagtgctgggattacaggcgtgagctactgccgcagccggcaatgatagattctagaatgaggctgcttccctgcttcctcggtatacctttgtaaatttttttttttttcttgaggcggagtctcattctgttgcccagactgcagtgcagtggcgcgatcttggctcactgcaacctctgcctcctaggttcaagcgattctcctctctcagactcccaagtagctgggactacaggcatgtgccgctatgcccagctaattttttgtattttagtagaaatggggtttcgccgttttgctcaggcaatcatcccaccttggccttccaaagtgctaggattacaggtgtgagccaccacgcccggcctttttttttttttttcttttaaatggagacgggatcttaccgtgttgtccaggttggtcttgaactcctgggctcaagtgatcttcctcccaaagtcctgggtttacaggtgtgagctgctgcacccgatccttggtatacctttgaacttgcggttttccgggaatatttcttcttttctgagacactgtctcactactttgcccaggctggagtgcagtggtgtcatcactgtctgcagcctcaaacttgggatcaagccatcctcctgccttggtcccccagtagttgggactacaggtgtgcaccaccacacccagctaacttaattttttttagagacgggggtctcacaatgttgctaaggcttatcttgtctcaaactcttgggctcaagcagtcttccctcctcagcctcccagagtgctggaattggagccacttgctcattgatattttaacttcaccttcagcatatgctcttttcccattttgtattctgaagctgaataaaatgtgctgttggggcttttctgtgcctcaggtgctcattcacatgaagccacacttcatttgatagtgccaatgtcagctgggcacggtggctcacacatgtaatcccagcacttttggaggccaaggcgggcaggtcacttgtggtcaggagttccagactagcctggccaacatggtgaaaccctgtctctactaaaaatacaaaaattagctgggcaccgtggcgggtgcctgtaatcccagctacttgggaggctgaggcaggagaatggtttgaacccaggaggcgaggaggttgcagtgagccgagaatgcgccactgctgcactccagcctgggttacagagtgagactctttttttttgagatggagtcttgctctgtcgcccaggctggagtgcaatggtgtgatttcggctcactgcaagctctgcctcctgggtgttcaagcgattctcctgcctcagccccctgagtacctgggattacaggcgcatgccaccgtacctggctaatttttgtatttttttttttaagtagagatggggtttcgccatgttggtcaggctggtctcaaattcctgacctcaggagatctgccgccttggcctcccaaagtgctgggattacaggcatgagccactgcacccggctgattcttttttttttttttttttttttttgagatggagtctcactctgttgcccaggctggagtgcagtggcgtgatctttgctcactgcaggctccgcctcccgggttcacgccattctcctgcctcagcctcccgagtagctgggactacaggctcccgccacctcatccggctaattttttgtatttttagtagagacggggtttcactctgttagccaggaaggtctggatctcctgacctcgtgatccgccctcctcggcctcccaaagtgttgggattacaggcatgagccaccgcgcccggcctgattcttaaaatacccatttacacagcactaatttgagaatcataaaggggctgtccgaaataggattggggctgtctgaaataggattggggttcacgagatcaagccattgcattccagtctggacaacaagagcaaaaactctgtccaaacaaaaaaacaaaacacaactacaaatggggggaccaggtatggtgactcacacctgtaatcccagcactttgggaggccggggtggatgcatcacctgagttcagaagtttgagaccagcctgggcaacaaggtaagaccccatctctacaaaaaataacctgggtgtgtggtagcatgtatctgtggttccatccaccatggagactgaggtgggaggatcacctgagcctgcgaagtcaaggctgtgtgagctgagatcacgccacagcactccagcctgaatgacaaagcaagaactggtctcaaaaaaaaaaaaaaacttttaaaaaacaaaaactacaagtgggtggagggtgccctacacttatcctgaatcaggaataaacacatatgtattccctcatttgaaaggagaactgggccaggtgtggtggctcacgcctgttaatcccagcactttgggaggctgaagctggaggatcacctgaggtcaggagttggagaccagcctgaccagcgtggtgaaaccccatctctacttaaaaaaaattgctaggcctgacggcacatgcctgtaaccccagctacttgggaggctgaggcaggatagtcgcttgaacctgggaagcaggggttgcagagaggcaagatgacgccgttgcagtccaatcagggcagcaagagtgaaactctgtccccccaaaaaaaaaaaaagaaagaaaattgggttgggtgcagtgactcacacctataatcccaccactttgggggactgaggtgggcagatcacttgaggccgagttcgagaccagcctggccaatattgcaaaacctcatctctactaaaaatgtgaaaacattagctaggtgtggtgacgcatgcctgtagttccatctactcattgtgaggctgaggcaggaggatcacctgaaccccggaagtgaagattgcagtgagctgtgatcgcgccattgcactccagcctgggcgacagcaagactttctcaaaaaaaaaaaaaaaccaaaaccaataaaacaaaaatggaaaaccagcgtttatgaaatctccttttgccttccatgaggattacaccatctctttttctcctattaacatatggagagggctgggtgcggtggctcatgcctgtaatcctagcactttgggaagccaaggcaggtggatcacttgaggtcaggagttaaagatcagccttgccaacatgatgacacctcgtctctactaaaaatacaaaaattagccgggcatggtggcaggcacctgtaatcccagctactcgggaggctaaggcagaagaattgcttcaacctgggaggtggaggttgcggtgagccaagatcatgccaccgttctccagcctgtcactccggggtgacagagtgagactccgtctaaaaaaacaaacccaaaacatatggagagggggctgagtttagctttaactttagcttctaaactaattatactggatttatctctagcctttctgctaacactggctaaactcataaccattgtgtaagactgttaattcattttaatagtaatatccctatagattcaaaactttccacctctgcatacattatgtaaataatctacttaaagcaaaacaacaataaaccccacaggcggacattccatgctttttttttttttttttttttttgaggcagagtctcactctgttgcccaggctggggtgcagcaggggcacatctcagctcactgtagcctccgcctcctgggttcaaccgattctcatgtctcagcctcccaagtagctgggattacaggtatgctaccatgcccaactaatttttgtatcttcagtagagacagggttttgccatgttggcatggttggtttgaactcctggcctccagtaatctgccagccttgggctcccaaagtgctgatattagatgtgagccatcactcctggtctccatgcttctctaagtcagggtcttgctatgtggcccaggctggagtgcagtggtacaaccatgctcactataacctcaaactccttgtctcaagcaattctcccacctcagtgccccccagttagctaggactacaagcatgtgtcaccatggccagcgatttttttctttttggcagagatgtggtctcgcagtgttgcccaggctggtcttgaactcctggcccaaaatgatactctcaccttggcctcctaaagtgctaggattccaggcatgaggcacagtgcccagcctattccatgctgatgtgacaagcatttctaagctcaatagaagggctatatataccaatccaagcaattacattttgcataacctaaaatcctctatagtcctatctaaaaggtctctttgttagccttgaaaggacagagaccgtatttgttcctaaataccataattttaatatgttagtatctggtgagttataactctaatttataaaacactgcaagcacccttcactataaaaaattgatgcaccaaagaagctagatggaaacagtttgctaggaaaagtgtcccagttattttaatccatttgatagttttactatgtgcaatgcacattttattataaaagacaaaacaggctgggtatggtggctcactcctgtaattccagcactttgggaggctgaggcgggtggctcacctgaggtcaggagttcgagaccagcctggccaacatggtgaaaacctgcctctactaaaaaacaaaaattagccaggcttggtggcgggcgcctgtaatcccagctactcaagggactgaggaaggagaactgcttgaacccaggaggcagaagctgctgtgagccgagatcacgccactgcactccaacctgggcgacagagccagactccatctcaaaaataataaataaattaaaaatacctatttgtaatatgtgaggaatgagacatcaaagttctgctatggaaaggaaaaaagtagttcctggagttcataaatggtttttccttcttaggtatcaaacaccttgcctataaatgtctgacaccaagctgtctcccacatactcattgctcagggaaaccgtaagatatttgagatcttctgtaatcagctgtagtactataaaactttctgaataaacctgctagtcctgtggcctgtggctaccaaatcatgtgccaagatgtatcagggccccatggaggaactcacaactaccttgggatattttaaatttcagagtaattcagtgatactcaacataagccaagacactaagcaaactattagtttcaggttgttcagtttcaatatgagattgtactgcaaacccctccattaagtttcatcttctaaaaactgaatttctggtggttgctataactcaaaaaaacacaggtacccaccccaccaaaaaaaaataataataataatggggaacaaggagtgagatgatagaagtcatttcaaagtttgagaagttatatagtatccaaaagccatacacattccattgataggtatggttatataagaaactatatatatttttctttccaataatgtaaattcgtttttccaatagctactaggctgctaagacaatatagttatgttgcttggatacagctatgtcatcaaagcaactgctagttactccttttggcttaagagcacaacaaaactcctcagacaccaagggcactatataccaggaaggcttgtgaacctctgtcctagcgagttattttatgtggtagtttccactctaagatacaaaggtgaaagctgttcaaggtaatgttttatggaaaatgtagcacttttttttttttttttgggtggtgcggagaaggagtctcactctgtcgcccaggctagagtgcagtggcgctatctggcttactgcaacctctgcctttcatgttcaagcaattctcccgcctcagccatcctagtagctgggatcacaggtgtgcaccaccatgcccagctaatttttacatttttagtagagacgggatttcaccacggtggttggccaggctggtcttgaactcctgacatcaggtgacctgctcacctcagcctcccaaagtgctgagattactgccataagccaccgcacttagccagcactattttttttttttttttttttttttttgagtcggaatctcactctctcacccaggctgcagtgcagtggcacgatctcagctcactgcaacctccaccaccgggttcaaggattcttgtgcttcagcctcccaagtagctgggactataggagcgcgccaccatgcctgtctaatttttgtatttttagtagcgatggggtttcaccatgttgtccaggctgacttcaagtgatttacctgccttggcctcccaaagtgctgggattataggcatgaaccaccacgcatacccacttagcacttttctatcaagcaactcttgtggctttccacattccgtcttttgagcactctttttttaaaaaaattactttcttgctttggttttagaccctgaagcattcttcttttaacatccccaggagataaaagaatttttctttgttcaagaaagactcaaggtcaaatatcactctctcactgcctccataacaaattttagactctcaggactccattatcatgttgtcaagtatgcagaagctagtttagattatataataaaacaaactggaagtacagagacatggttagttactttgcaataaaaggaccgctggagaaattattgtccctttttgtgaagtgaaaaaaaataagccttctgtcagaaatgctgggttccaatcctattttggctttttttttttttttggggggggagacacagcctctctctgttgcccaggctgtagtgcagtggcgtgatctcggcttaccgcaacctccacctccacctccccctccccctccccctcccagcctcccaaatagctggtattacaggcatacgccacctcgcctggctaattttgtatttttagtagagacggggtttctccacgttggtcagactggtctcaaactcccagccccaggtgatccatcagccttggcctcacaaagtgctgggatcatgggcttgagtcactgcgcctggtctgcagtttttgtgttgtgttttgagacggagtttcacgctgttgtccaggctggagtgcaatggcgtggtctgggctcactgcaacctccacctccttatttcaagcgattctcctgctgcagcatcctgagtagctgggattacaggtgcccatcaccacacccagctaattttttgtatttttagtagagatggggtttcataatgtttgccaggctggtctctgaactcctgaccttaggtgatgcacccatctcagcctcccaaagtgctggagattacaggcgtgagccaccgcactcggccctgtttgtagttttaatgtgttagccaacttgtataaagggtcagccagtaaatattcagctttgcaggccacaaatatctcttatctcattcacattttttttttttttttttttggtctcattctgttgcctaggctagagtgcagtagtgtgatcttggctcactgcaacttccgcctcctgtgtttttttaaaaatatacatttaaaaaatgtaggaatcatttttggttcatggcctaaccacaggttttgataatttaaatttgttttatctgggacatgatcatatagcttgctaaggctttttttctttttctttttctttttcttttttgagacagagtcttgctctgtcacccagactagagtgcagtggcgtgatcttggctcgctgcaacctctacctcctgggttcaactgattggcctggctcagtctcccaaatagctgggactacaggtacgtgccaccacgcccagctaatttttgcaattttagtagagacggggttttactatattggccaggctggtctcgaactcctgacctcgtgatccgcctgcctctgcctcccaaagtgctgggattacaggtgtgaaccagcactttttttttttttttttttttttgagaccgagtttcactcttgttgcccaggctggagtgcaatggcctgatctcggctcaccgtaacctccacttcccaggttcaagcgattctcctgactcagcctcctgagtagctgagattacaggcatgcaccaccacgcctggcgaatttttttttttttttttttttttttttttgagatggagtcttgctctgttgcccaggctggggtgcggtggcctgatctcagctcactgcaagctccgcctcctgggttcatgccattctcctgtctcagcctcccgagtagctgggactacaggcgcctaccaccatgcctggctaattttttgtatttttagtagagacagggtttcatcgtgttagccaggatggtctcaatctcctgacattgtgatcctcctgcctcggcctcccaaagtgctgggattatgggcgtgagccactgtgcccgcctgaattttttgtaattttagcagagacgagtttctccgtgttggtcaggctggtctcgaattctcgacctcaggtgatccacctgcctcgcctcccaaagtgctgggattacaggcgtgagccaccgcgcctggcctgctaaggctttcataagaaagtatcacacactgggtggcttaaacagcagaaatttatttcttcacatttccacgaggctgaaaatccaaggcgaaggtgtcagcaggattagtttcttctgaggcctttccttggtttgcagatagctatcttctttcttccctctgtgctaatctctttatataggaggacaacagtcattggattagggtctatcctaagacctcatatttacttgtcatttaaagacactttctccaaatacaatcccattcttaagatgtactgggggttaggacttcaatgtattaattttgaggaaactgataaaattctagattgctgaatttgaggaaaggagattgattctcctggtttcagtgaacttaatgtaaaaagtgaagctctgatgtaccagtgttttttgttgttgttgtttgttttgagacagagtctctgttgcccaggctggattgcagtggcatgatctcagctcaccgcagcctccacctcccgggttcaagtgattcttgtgcctcagtcccatccctcaagtatctgggactacaggcctgcatcaccatgcccagctaattttttttttttttttttttttttgagacagtctcgctctgttgccaggctggagtgcaatggcgcaatctcggctcattgcaacctccgcctcccaggttcaagcgatgctcctgcctcagcctcccaagtagctgagattacaggcgcctgccactgtgcctggctaatttttgtattttagtagagatggggtttcaccatgttggtcaggctggtctcgaactcctgagcttaggtgatccacccacctcagcctcccaaagtgctgggattacaggcgtgagccaccgtaccctgctttttttttttttttttttttttttttccgtatttgtatttgtagtagagtcggggtttcgctgtgctggccaggctggtctctagctctcctggcctcaagtgacccacctgccttggcctcccaaagtgctgggattacaggtgtgagccactgcacccagccaagtaacataatttttgataggactagataaacggctaactctactaagcattgtttggtttttaaatctttcctattatgaaattggaatcattctgaaactaaatcttgttagacccataggttttaacttggaatgtagctgttagggtaaaaatgtagtttttgtttaaaattgtaacaaactgccctgaaataatgctataatggtgtcgaaggttagtatgtgaatgtttagttaatgaattccagcttgactttccctactttatccttttgtaggcagcctgcttctgcaaagtggtacgatcgaagggactatgtcttcattgaattttgtgttgaagacagtaaggatgttaatgtaaattttgaaaaatccaaacttacattcaggtaagttaagctttttatccaatgatgtaaaatagtcattcacacaactgaataactttgactggcttgtcttttcattgaagttattattaatctttgtctctttgaagaggcttaattctttctttattattttatacagttgtctcggaggaagtgataattttaagcatttaaatgaaattgatctttttcactgtattgatccaaatgtaagtagtctttatgctttaatccaaattttagttgtgaggaaacagacataccaagtattctttttagcaatgagcattagttctgtttttcttaacagtgaggcaaactatgtatatttacattttgtagaatatttcctccaaaattggtttctgcatactttttgtttttgctatcactgtttgggcttagagtagtatccttgaggctcgtctcatcttttttatttgttttgtttttttgtttgtttggttttgttctttgagactgctgcagtacaatggagcgatcccggctcactgcaacctctgcctcgtaggttccagggattctcctgcctcagcctctggagcagctgggattacaggcacatgccaccatgcctggctaatttttgtgtttttagtaaagaccatgttggtcaggctggtctcaaactcctgacctcaggtgttccacctgcctcggcctcccaaagtgctgggattacaggcatgagccactgcgcccggccaaggcttcccttatctaagaatagaatctttaaaccattctgtggttatatcatttttagttaaagtttttaaggttttattctgtttatcgtgtgcaggaaagaaaaaaatggtaccaggttaaactttaaactttattgttgtgcagattatttcagtaggaaatagaagggaaaaaaaaatttttttttaaatgaaacttaaagggggttggggcagttggatagtttgaagtttttagtagtcaagggcatgtttcagagtccagagaaaatttaggtaaagaaatgagaaaggtgagaaatgacaagctattttctatcatgtagtgatgctggaaagataaatggtatgatggtccttttgtttttaggattccaagcataaaagaacggacagatcaattttatgttgtttacgaaaaggagaatctggccagtcatggccaaggttaacaaaagaaagggcaaaggtaggtttcattttccttttttgaaaagtttgatatttttattttaggtaataaaagatgtacttatttgatgtaaggaatatggctgtgtttttgtttcacagctaagtataaagcctcatgttcatgttttttgtctactcagttttaatacgaagtgtgatcagaatatcagttattaactggtgtagaatcttttgtacttaagagacagactttgcataaattactcagctatcacatgggaggggacaaagcttggtgaaaaaataatcaactgaaaatagttcttactagtaaatttgttttcaaaaggtatgtttaacaattttcagtgttttttttcccccaaaacagggtctctctttgtcacccaggctggagtgcagtggcacgatcttggctcactgcagcctcagtttcccaggctccaagtgatcctccctcctcagtcccccaagtagctgggactgtaggggcatgccacaacacctggctaatttttgtattttttgtagaaaggggtatcacagtgttgcccagcttggtcttgaacttctgggctcaagcagtctccccacctcagcctcccaaagtgctgggactacaggcatgagccacgacaccagcctagtctttttttttaggtagtctcatgccactcatgccagagtgcactggtgtgaacatggctcactgtagcctccacctgggcttaagcgatcctcccacccacctcacctctccaaatagctaggattgtaggaatgtgccaccacgcccaggaaatttgtttttttgttttttccccagatacaggatccactattgctcaggctgtctcgaactcctgaaggattacacaactagtctttccaccttggccacccaaagtgttggggttacaggtgtgagccacctcatttagcttagtctattctttgtgtgctaattacatgccctcctaaaaatacaaagtcacagttcaaaaaatattgttttgccaggcaccagtagcatgtgcctgttgtagttaaaagctactctggagggtgaagtgggagaaatacttgcgcccaagtctgggttgcattgccatatgtcaggtaaccacgctaagttaacatcagtacggtgttgtcccaggaagcggggaccaccaggttgcctgaagagggtaaacaagacccttggtcagaaacggagctggtcaaaactcacatattgatcaatagtgggattgcacctgtgaatgcttgctgcactccagcctgggcaacatagcaagacctggtctctttagaagaaaagaaaacgtagtcttaaggttcatgccaaatgcaaattagcctaatcttagggtgatatttgtattgatttatagcttaattggcttagtgtcgacttcaataattggaaagactgggaagatgattcagatgaagacatgtctaattttgatcgtttctctgaggtaagttcctttaaatggacctctccccattcgaagcacacggtacctgtctatgtagtcaatttaatatggttttgggcacctaatggtattcatgatgcatgttattttatttttaagaccattttgcagtcatagtaaatagatgttaacaatggcaattttaatcctgaagttgaaccattttaatgattttaaaaggaattagtgttagctacaaaagttacaaaagttaatgcattaagacaaactaacacagctagtttgctaatttcatcattgggactttttttttttttttttttaaagcatgattgcagtagttgacttggattttgaagtcataaaataagactataaacttttggccgggcacggtgctcacacctgtaatcccagcactttgggaggccaaggctggcagatcacgaggtcaggagatctagatcatacgggccaacttggtgaaacctcatctctactaaaatacaaaaaaaattagctgggcatggtggcgcgcacctgtggtcccacctactcctgaggctgaaacgggaattgcttgaacgctggaggcagaggatgcagtgagccgagatcgtgccactggactccagcctggcgaaagagcgggactcggtcaaataaataaataaatgcagaacgataaactgttaaacacaagaatcataggctgggcgcggtggctcacgcctgtaatcccagcactttgggaggctgagatgggcggatcacctgaggtcaggagttcaagaccagcctgaccaacatggtgaaaccccgtctctactaaaatacaaaaattagccgggtgcagtggcgggcgcctgtaatctcagctactcagaaggctgaggcaggagaatcgcgtgaacccagaaggcgtgaacaaaattagctgggcgtagtggtgcatgcctgtgattccagctactcgggaggccgaggcaggaaaatcacttgaacccgggaggtggaggttgcggtgagccgagatcgctattgcactccagtctgggcaacaagagcaaaacgccgtctctaaattaataaataattaaataaaactacaaaaaaatagctaggcgtggtagtgcacgcctgtaatcccagctactccggaggctaaggcaggagaattgcttgaacccaggaggtagaggttgcagtgagccgagatcacaccactgcactccagcctgggcgacagagcaagactctgtctccaaaaaaaaaaaaaaaaaaattcatggtgaaatgtttaccatgagatatacaaggaaaaaagtttaagaaagtctgttttctaagatgtcacccaaataacgttgccatggcccaagaataaatgattcatctctatataggcagaatagactttatcaaatgtagtagaataaaactaagtacagaaagaacattagtgtataagtcgaatgcatactgatgaaatccatttcttgttgctatttgaaatttttcattaactagattttgtattttgagaccttaagagttaaataaaaggagctaagtttccagctttatgcaactgcttatttaacagttctccacacgtgactctggcatggtgatttcaacaggaagggaggatgttctattcatattattttttaattgtactttccttacctgtagaaatcggtgccaccatttacctagctgtgcaagccattgtgttgcttaggcaggtcttgaactcctgagctcaagtgatcctcctgcctcagcttcccaaagtgctgggactacaggcctgagccaccacccccagccttataacactgtttttgttttttgttttttgttttattttgctatctttgttgtccagtttttgttgttatctcttacatatctcttgaatatgtacagttttctcttgctgtttatcttaagcacgtagcgttatgcttggtacatttagcatttttcctgcccaaagaaacttaaagtattgagtagtgcttttggaggtagggaaactcccagttactcatttcattcaagatagattgcccaaaatttttatactgaatccttttttgtgtgtgtttaattaattgaggtaagagcacttcacatgaaatctactcttttaacagactatttatttatttttttgaggcagagttttgctcttgttgcccaggatgtagtgcaatggcacgatcttggctcactccagcctccacctcctgggttcaagcaattctcctgcctcagcctcccaagtagctgggattacgggtgcccaccaccatgcccggctaatttttgtatttttagtggagacagggtttcaccatgttgggcaggctagcctcgaactcctgacctcaggtgatccacccgccttggcctcccaaagttctgggattacaggcatgagtcaccagacctggccacgcccagctatcttttaagtgcatgatacagtattgttaactataggcataatgctgtacagtagtaggtctctggaactatgcattttgtgtaattggaatttgatacctatttaacagtagcaactctgcattttccttccccccagctcctggcatctaccattctactctctatttttgtgtgtctgactatcttaggtatcttacataatcttaggtatctcatataagtggaatcatgcagtatttgtcctgtgactggcttatttcacatagcatgacgtgcttcagattcttcattgtgttttgtcacataaggcagatttttttctttaaggctgaatgatacttttaggctgaacacattccattgtatgtttgactatctttttaaggtcctttcccattctaaaatctgggtaatcatgtatttttgaagtttgattttttttccatgcatatgtgattttatttttctaaaatttaaacattacaaaaatggtttaaacttgagaaaataagtttctcatcatctgataatagtttaagtttaaatcatttcttggttcttcacaatatctaaaaccatgatgagaataccaggcctggcacagtggcttgctcctgtaatcccagcactttgggaggccgaggcaaggggatcacttgaggccaggagttcaagaccagcctggccaatatggtaaaaccctgtctctaccaaagatacaaaaactaactgggcgtggtggcatctgcctgtaatcccagctactcaggaagctgaggcaggagactcccttgaacccgggaagcggaagttgcagtgagccgagattgtgctgctgcactccaacctgggcaacagagcaagactccatctcaaaataaaaaaggcttggcatggtggttcacgcctgtaatcccagcactttgggaggccaaggtgggtggatcactacagcccaggaattcgagaccagcctgggcaacatggtgaaaccccgtgtgtaccaaaatacaaaaaattagttgggtgtggtggtacgcgcctgtaatcccagctaccctggaggccgaggcatgagaattgcgtgaacccagaggcggaggttgcagtgagctgagatcacgccaccatactccagcttggacgacaaagctagactctgtctcaaaaaaaaaagaataccttaatacatgttccacctaacttaagatagatagctgtgcaactacaaatgaatcccattcttttccttaaccaccagaggtaaccactactcaagtagaatttttaatgtttgtcaaacctgttgcatgaatagctttgcttttctttagggaaaatttagttttaatttccatatgggtttttaggattttgtataattacctataatcttccttttccagaagggaaagatgcttatatttgcattttgcattttttgatatctgtggcagacttaaggtttattctgaagcatacagcattaataattagggcctaacttaacatcatttttaaaactaatttttacacttcaaatagatgatgaacaacatgggtggtgatgaggatgtagatttaccagaagtagatggagcagatgatgtaagtctaaaaattcttttttctgtttactttcatactattaaatagtaagaaacaacatatttacaaatggttttatatagattcacaattacttcttattttctaaaaaaaaagaaaagggaaaagcaatttttaaaatgtgcccatttttgacgaatgggggtatctattagggaactggttgtaccgtagaccattcctaaatggattagatttccaaagaatcattgtatagagacattatatattaataccgtactcaattataacagtcagtttaggccgggcgaggtggctcatgtctgttatcccagcaggccaggtgggcagagtacgtgaggtcaggagttcgagaccagcctggccaacatggtgaaaccctgtcttaaaaacttagccagacatgatggcaggtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaagagagtcagtttataggtatgattttgactaagaaagtaagttaaataggttttatgtcaggattggtcagagaccgataaaacagatggacattgggaggcggagatgggtggatcatgcggtcaagagtttcaggccagcctggccaagatggcgaaaccccatctctactaaaaatacaaaaattagccgggcatggtggcgggtgcctgtaatcccagctacttgggaggctgaggcaggagaatcgcttgaacccgggaggcagaggttgcagtgagccggatctcgccactgcactgtagcctgggtgacagagcaagactccatctccccccacccaaaaaaaaaaaaaaaaaaaagatggacattggaaatctgtaagaggaagatacactaaactacttttctcaacatctttccaaccccagcatcctgttaacatctcccagaaagttatttaatgctatttagaaaaacacttaatattcactcaacagctaggattagagttcactgtcttctatcagtccatttttcttcatattgatccatgttttctctttgaatgccgagataggttaatttaggaatggattcaacgggtgggctaaattgtcaccaaaaggcacacatcattttttataggtagataaatcctctgctgtacatccattcaccttaggtaaacctagtcaagtccaatgactaaatttctaggcttgatatgactacctacctgtgctactttagtcaaaaatatagcacttgaacttttttaggtaaactgttcagttagcaaacgaatatttgatcagctcggtaactttattttccctctttcaggattcacaagacagtgatgatgaaagtaagtgtatataaaaagtatgtttatacagtgatactttgcatcaaaaaacaaactcaaaatagagatgttaacttctttggaagtaaagtaattttttctttatgaccttgaataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcct

SEQ ID NO: 35618 - DNA, 1688 bp, Homo sapiens
cactcgttgcataaatttgcgctccgccagcccggagcatttaggggcggttggctttgttgggtgagcttgtttgtgtccctgtgggtggacgtggttggtgattggcaggatcctggtatccgctaacaggtactggcccgcagccgtaacgaccttgggggggtgtgagaggggggaatgggtgaggtcaaggtggaggcttcttggggttgggtgggccgctgaggggagggcgtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtagtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 35619 - DNA, 92788 bp, Homo sapiens
cgggagcggcgggagcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggtgagtgaccccccggccccccaccagccccctccgctcccgtcccttccccgctctccttgccctccccgctagtccacccggcggagctgggggcggtcccgggggggacgagggcgccgctgaggccgggccgcgcccccacctgccgcgcccgcagcctcggcgaagccccccctccacgccccagcctggcggctcctccccgctcaccccgcggcagacgcgcccccagcgctgctggctggctcgctccccgccgcccctcgccgcctccctccctctccaccgcaccttagccgcagcccgccccccccacccagcgcaaagtttcccgtttgcgttcttgctccccctcatcggtcccgcctcgtccccccttctagcgcggacgcgctccgggggcggccctcagaccccccagccccgggctccgggcgggtccaggccgcgcccccgcccccgccgcacaggcgccccctcccagccggcgggggatccgcagccggcgcgcccgggtctcgctcgcggccccggcgcacgtgcggtcccgggctgcgccgggcgcgagtttgaagcccccccacccccttcgttcgcgagcacgggatggggaggggccgaacgggctgtacccgcccccaaccgggtgcaacgccctggaggccctggagcgacctgtcccgtgaggacgtggccactcggaccctctccgaaagttcactcagtggccgccccgcgtcccgtcccgtcccgtcccggctccccatcgccgtgccggcgtctctgtctcggctgctttctgttttcctcggcgtctctgcctccccgtgtcagtgcctcccaatctcacgcccctgcaatcccagggtctctccagctgtctccattctttttccccaggtcactctgttctttctccccaggtctctcgattctgtctccctgggtcgtcttgttccctgtccctgagtctgttctctccgcttgggtctctctatttcctctccctgggtctctgtctccctccttaagtctctgcctcttgtctctcacccatctcttggtgtctctgcactctctgtgctaggcgcccccccatttccctggaatgctgcccctctggttcttccaccccggagggggaggggctagactttctccccatttcaagcccccctgccccccagtgcacggcccctgagttggagcaggttgggggtggggagcgctacctgcctgagctgtgaaatgggagagggaggctgccccagcctgggggttgtctggatctccctgaggggccacagggcagggccgggaggctggattaggttgaggaaggctccacttttgaaggaacaggggcagggatccagagcgatctggtgtcggatctggcctgagaagcagggaagtgcactggggtgagaggcgtagaaaaggatgtggggtggtggttccaggcgggtgctcatggggaggaatctgctgagaagggaagatctggtggggaatcctttgggaggcttcggggatctgagggatccagaagagagttctgacaggctatctaaggaaatttctgtgcttagctccttattaactcttgcttcagggagcatgaaaatccctgtttttttactgattatatgaatgagcctagggcttcaagaaggagcaggtgtaactccccaagtacaaccccctacattctcagccccaggcacaggccacactttctcgtaccctcttgccttcatttccacactcagctcaccccctccacccccacacacactccctattcagctgctttcttgccccctctcgcatacctgggcccgcatgccggccagggctcaagaaatctgtgcctgcacactctcgcagcatacctgtgcacatgcacagtcatccttgtgtatttttgtatatgcactttcttgcacattttacttgctcagtctcttatttgaaatgtctttatagtgttttttttagtttcctttatagtttccttttccagctgctcttcctcttccctctttctttcctttaacaagaaaattgttttaacataattccttccttccttcctccctttcttccttcttcttgcaactactgatacctcccctttatccagctttgtgtgccctgggcgggttggcttggtgtacaaggctgccaagagaggagggggtggttgggtgttggtgaaggaatttggcggggcagagttagactgcagcaaacggaaactagctacacatcttttactgggaagtgtatggatacgcagcaaaatactagccctggcagtttgggcacagtccacccttttttccatcagcctgaactatgggagtctagctttgagggtcctccctgggggcggggaggaggggacccagacctcctgcagtagaggggttgtgatacacaccacggctcctccactttccagcttcaggcctcaaagaggcccctttctccctgagtctcaatttcactccctgtaaaatggggtagctaatccaacccggactgggtcccagggctgttgtaagaatccaagggaactgtgtggcagtgcatcgtcagcagtggcagtcacttcccttgtgactgacactgctgtgtgcttggttccagcttgcagtcagggccctaccctcgagaagctcgtggtccttgggggagcaggttgcaccatgggattgcaaaagcaattcagttacctgtcattgattgctgactgtgtgccagaccccggggtaggcgctttcggccccggctgcctttcttcctttgggactaacagctatgtagaagaggcagcccacccctaaggttcaggcatctgctcaactaaagcagctgcggttctgagttgggttagaacattgcaagagttcatcaagagacgggggagagttcggaggtcagggtgaggtgagtcccagaggagaccaagaagaagtgatgtgaactaggtttggagggatgagtaggagtttgaagaagagagaaaggacttgagatagataaaaaccagtatgaataaagactgggaggtgttgtcacttgtgaagtattcagagatgtggcagatcacagagggcattgaatgccctgttaagtacctgtaattttactctgagaacccagagagaaaacaccaaaggtttaaagcttggatagggagggtggagtgtgctgtggtcaggtttatgtttccagaaaatgctctgtggctatgggaaaaggatggagacaggatgcccagtggggcaagagggtgcaggtaagtaaggtgagagaagatgctggctttgataggtggtagcatggtgccatcttgaaggtacacttgtcaggacagaatgatttattggatgtgggagtgaaggagaggaagaggaaggagtccaggttcctcggagtggttgagcgggccttcactgaaggccctgaagcttcactgtgttagggacttggtgaggaggggcagagaataagctcttagttggacatgtggcccttgaggtacttgggacattggaggctcagtgggggaggcacatcaaggaggggctttggtgtgagggtatgggagagaaatgtcggtcggaccaagagaagcgagagctgtatgagagaccatagagctgtgcacctcgagagaaagtaacctccgacagtggtgaagagctcgagttttatactgctaggattggactctgtttactagcagcgtgactttaagcaagtggcttaacctctctgaatccgcttcctcatttgtcaaatgattataataaaaacccgtgccttataagggttgttatgaggattaaagatagtatgcataaagtgtgtgtagcacagggcttggcatctagtgagtactgttgtctgtgtttgcagttactgtaatcatcctcaactgggatggtgtaaacccaccctcccatcaggggtcacatgaggttgcctttaatgagaagatagactgctaaggttagggtccctgtctgcctaaggttgctgcaattctgagctgagattagcaggtcaaggagctcaacaaagggggtgcctgcccctattgttatcgatgggattgtttgtgttgctcaggtgtttgaccttcaggtgggtgggcttgagaagactagaggtgaggcctgcagaagagactccatgtttggggtaggtggaagggaattttgagaaggggcagccttggggtattgagttctccatttcctcccaccctccctgggccctgggcttctactgaggctctttctgccaccatctgcctctgtggtccagatgcaccatgtctctgtgtgaccgtgacttctaggtctgagaactctggttttagctccttagcagtattttagctgctgtttctggggactgttcctggtgcagccacaggggcattctgggggttgctccagagggcagctgtgcctgcattcccctaggtatcatcgacttgctcctgacccactgccgggccaggtttcaggcctggcagatgatggggaaccctactggggccagccctgcgttggccccaagggctttctttcttgatattggacatgactgtggacttcaccccttctgaggccttcctgggtgccaagcagtgtgatttctttctttttctctttggtttgaaacagaatctcactctgttgcccaggctggagtgtagtggtgcagtcgtggctcactgcagcctccacctcctgggctcaagtgatcctcccacctcagcctcctgagtaactgagactacaggtgtagtcccacctggctaatttttgtatttttttagagacagggttttgtcatgttgtccaggctgctcttgaactcctggctcaagtgatccacctgccttggcctcccaaagtgccgggattacaggggtgagccactgtgactggccagcagtgtgatttctaacttgggtcctgaaccattcaggccctttctgagtagctttctagtcaaccttccagatgtcagctctggctctgttctgggggtgtatctggttgtcctggttgttctgggctctgtcccagtgtgagtgtagagtgggttctgggagctgcagttggtgaatctgagtctttatttggttgcctgataggttgttttgaggtcagtttgatcccagactgacgtggttcaaagttactgtttggcttttctaggatcctgccctcatgctgttctgtgtgcctcagggtctttgcaaatgtttagtcttctaaaatggcccctggccactttgggtacacacctctttccaggtgtggcttctgctccatgtagggcctgtctcagtctccaagcacgagaccctgctgtggctgggtgtggcagcagcgcctggccagcttggggggcctttcccattacccagttccctgccttggactctgcccctctgcccagggtctctgcacaatggtgcagccaaaaacctcacttgaatactgtgaggccctgcgggcatctctagacaaatgggcctttaagtttggggcctggaagctggtttgtctggccagacctgctgggcagcctgtatgctgggagcagcagctgctggaaactcagcttggggagcggggagggaagcatgcagagagggctgcgggttctggtgcaggtaggtggggcagtggaggctgggtcgccaagctggcgagggccatcttgggtcagttgggatggccttcagtcggtgagagtacccccatattggcagaggtggttagtgcaacttgagggtaattcccaggtgcagaggtgtgtccttgatttcatgatgagggtcagtcttgggccggtgaggacattcccacgcaccaccctcccactgtggtttctttgtgtccgttataggaggagccaaggtggcagagtggtgtggggtggggatcactgtgcatgtgggggcttgaggtgagaagcctgctgcaaggtgcagcttgcgtcgagtaggccaaacagctgagcttccgtgaagtggtgatgaggtggtatgggtgtgtctgacccccacccccacccaggatggtacccacgctggtggggactcaataatggctctagaaggaaggggctgggctctgtcgctgcatgtgtgccagcggaggaggcatccaggggcacgccttcattttaaaaattatagagtagagaaagtcaaaaataaatattgcttctgaagcttctttgaagactggcatgtatgttggggtgtgttcttccaggctgggctgttttctttgaactcattcatgcgttcatccactcattcagtgtatgctgactgagcacctactatgtgccagctgtcagccaggcgctggggatacggaaatgagctgggcagccacagtccatgctcctatcaagcttatggtagtgactcagtaattgtaaaaatatataaatagtcatgtttgtggtcacggctccaagccaaggtccaggcaggtagtctgggacattgtggaaggcttccctgagaaagtgccactggacttgagatccgagggtaagttggccagaagagcatgggtagcctgtgccaggcagtggcattcagcactggcaaggctgggagacaggaagaaatttggcacatttgaggatcagaagaggaagttcccgttctggcaggaggagagcatgggcaggtagggctgcagaggtgggaggggccgactctgcttggctctggggtcatgctgaggagctgggccacagagtctactgctgaggtcagggacttggtctgtgtggctcacagctatatggctggtgcctggaaggacgcccagcacatagtaggtgcttagggagtatcaaaatgaatgagcgagggagtgaagggaaaagatgggcatttttaccagatggggatggttctacatgaacatttccataacctgcttttttttctgcataaacagcaaatttttaatgtctttctgtgtcaatacatatgctgttgtgatgaaattcttgatgttttctcatgctttcctttctgtccaggaaggagtggaggccctggtgcccggcccttggtgctgagtatccagcaagagtgaccggggtgaagaagcaaagactcggtgagtgtgccccacagagtggccaggagcaggggtgcacaggggtcctatggaccaggctgagcagcttggatttgatgcagggtcagtggagagctatagagggggtgtcagcagggggcatgacatgatccagtgtgcactggtgagagattgtggaggcctggaccagggaggcagtgacagaagtggagagaagggatgtgagtgctatttagggaggtagagtagacaggacgtggtgaaggattgaatgtggggcatgaaggaggggaggtgtcaaggatggtgcctgagtttctggctggagtggatgatagaggtggatggggaatgacatacagctcgtcagctactgtaggtgtgaaataggcttccgggtgatgtcctgggacttacaccaggatctttcttctgcttctccattcgccacgtttctgtagaaaagactgttcccatcgactgtaggttgtcgtagaaagagcttggtgcctgcaggatctgggcatgtcctctgcatctctttgatgtccccttgttctcctctctgtctgttagaagcacagaatgggtgggctggagttgcagggaatgaggttggtaagttggtttagagtcagcatcatgggccttggatgtcaggctaaagactttagactttttcctgagggcaatacagcagcattgaaggttcttaagcagagaagcaatatccatgtgttgatctgtccattgcccatccgttcattctttcacggaacactgtctgaatgcctgctgtgaaataaagtggcaaacaaaagtgcagatttgcatttttatgtgctgaaaggtggcactggtctgtgtgcgggatgggttgggagtgattgaaggcaggaagcccaccaaagaggcaggaagtgatgaggtcttactaacacagtggcagtgaggatggaggcaggtcagattcaaacttattgatgggttagatgtgtgggatgaggacaagggagcatttaaggagggtttgcgggcttggtgactgacaacatggtggtgctgtccccaagactggacaccctggaggaggagtggaattggggcagatgagttctggttgggccatcctgagccaagagctcggtgggtctgttcaccctctgtaagctcctcgaaggcagagcctgtgactctcttgttcatcaccctgcccactgaacatctggacgggtggctgaactaacaaggctgtggaagagatgggtctggcctgggtaggggaaggaaatgtgtatgtcctgggtgtctcctggggtccagaccctacgtttggtgagatgggcactggggttatgtagagggtgcagcaagaggggctgtgtcacaggctggaaaggtcagatggggagggtgggtgtagggacactatgtgtccctttgcctctccatcctcagatgatggtctgacctaactcgaagtccagtcttgccagaataggtacctgaaggtggagccctctgtcctctcgggaggccactagctgatggcatgtctggtggggtgcagatggggtgtgctataggacctgacttctggaggctgggtagggctgatgtgggggtacaggggaagatactctgagatcctgaggccaggcgccagcaaatacaggagttaagccaggttggagcttccttgggtacaaggcccagggtgcccacaggggattgggttctggggcaggggccaggtcaggctctaggctcaattggcaaaggatcttgttgtctgtgttggggtttctcagcctcagcaccattgacattttggatcagataacccttattgtgggggcagggcttgttattgtagggtgtctagcagcatccctggtttcttccccctagatgccagtagcatctccccgctttccccagtctcgacaatcaaaaatgtctccagtcgttgcgtaatgtcccatgggggcaaaattaccctgaattgagaacctctggtctacagcctcttgctgctttcactatactgtacaaacctggaaaattggggagggtcagtggggaagatggatagtgatgggccacttgagcagagttctgaggggtgagtgagtgctggggcaggagaaggacatttttttccaatagacagaacggcaggtacagaggcttggaggcacaaagttgggaaacagtaatccaagggggaccccagccccagaggaaggggcctggaggcttaggggttacagccgcaggaagatacctctgctggtcccctttggtcatttgcctccagagttagtctcctgctgaccctttgccgcctccaagtctctgcgacactcctcctaatctccccctccactcctcagtgagatggagaaactgagagctgcaacagggtgggactcagtccagctggtgggagccccgataccagccgtgggagggagggctgttcctggctctgctcacggattctggccaactggctggaggagggaaggcggcctcaccctcttccccacaggcccctccttccctgggtcaggggtcctggctgagactataatttattcccgtcataatccagtggttggtttggtgagagctggaaacatgttggttttcccttcccaagtataacaaggcctgtttccgcctccgcggccgctgctgcagtgccacgcggtgaactgtccaggacatgacaaaagggctcggttagctgcccgctggttagaagatgaacggctcagagctctccctgccgacaggctcttcccttcctgttgcccaagtgctggcctttcctcttggccgtctgctctgtagggccctggatacccctccttctgctcatgtccatttctgggccccagggtcctggcctggggaggtgagatgggggaggctacagaaacaggtggtatttggagactaattaatatttgtgaataataatgcatgcccaaggaaaacaaatcaatctgtgtttgcgtatttatgatgaggactcaggaatgatcccagctgttctccagccagggaagcccccatcacatggtcccttgggcccccacagaggctggcagggtggttagggtgggctgcatggaggtgacatggcttctgtgttttgcaacgtgaatcttctgtgacgttcatatgcgaatgctgtggcttggtctagtgcctgcttcttccttttccctcaaagcagtgattcccaggctctttggtttcacgaaccaatacaatttccaaaagtactcaagagccagacatggggttggcaattttttattttgccaagtaaaggcattataaaaaaacaactgctatctgctgtccccatcatttcatacaggaaagaacattttaacaccaaggacaatatttgagaataaaggacagttcttcccaagaaagggcagttggcagctttacactgacgtagcaaaggaaaaggatatattaaaaccattctgaatgtggaaaaattgtgtccaattatattctataatatcataccgtatgtaattgtgttcctgcccaagtatgtcagcttggcagaacggatggtccacagtgcaattcagagacgagcttgagtgccccagtgctccggccttgtttttatctcggttgttgaaagcccaggctcacccagccatgctggtgaagtgggtgttctgctgtgaacaccgttgcatggattcacaagatgctcaacctcgcaaccgcagtcaggctagcagcagccctgccccttgttcctctcccaccttctccccacaggtgaccctgggaccctgggactctgggggccaaggtctactcttgaggccaggcctggggatccagggctgctctgctctgatgagggaggccctggagctgggagtggcctgaaccgcctgacaccagggcaggctctgtgcccggagtctcagggcgggaggcagcttgctctcgccaggagctggtgagggagaggccctggctcgtacagctgtgtggctgccagagtagttgcctgagaatgtgtttgtgtgtgtcccttgtgtttccccatctccctgggcatctgtgtccttgtgtccatcatggaccactggaagaagctctctgttctactttctggatctgaacaaagtgtcctgagcaccccaacccagatacacagggggtttctggaggccccacgttgggggtagggttacctgaggcccaagttctccaacacccatggccagactctcatccaggcttgtaccacatgggtgtctattctgggagttttacccccatgatggctctcctgggagctctgcccccaccatgaagtctgtaacagcacgttacacctctgctaatgtatggggagttgcacccctgtaatgtccttatcaggcagctgcactccatgatgtctgtaccctctgtgtccgcccacgtgatgtctagaccacaccattacacctccatgatgtctgcacctgggcgttatactgctatgattactgcaccaaggcggctacaggggattaagcctctgctcattgtactggggagctatatcccatgatgacggtgctgtgcattttattttcatagcagggagatatgctcatgctgggggcctatgtccctatgaagcctgcctggcaggggttgcatgcttggaatgcttgttcctggaagttaacctctgtgactattatattgttatacccgatgatgccggtacgaggccactgtgccctgtcctttggtgcaacacagctgttgagttataaactcatgtgtctcattcaggggctccaggatggtccatcaggggaccatacccccatgatgacctggcctggcataggataccagatgtgtccacaggcccagggaggaagagccactcatagtccaccacctgatggccgctgggaaggtgctccatcgttggctgcatgtggcaccatagcgcaagctcaggcagggccttggtgatgtgtgacctccatcccactgtggccttgcaggcgtcattgtggtctcagccacctcagctctgggatcgtggagcagatccatccccagcttggtgtaaatggggctggacacctatcaacgttcttacttgaagaactggtgtaaatgaaggctggacacccttcaccgttcttactttgttgttcagctcctgtctcagatttttggtgggatcctgggacaggggacaactctcaccccttttcctttgtgtttggccccatcccactttgcattcccacctgctttgtccaacacctttgctcaactgctgccttctgacctcatgaactttgattatctcagttgagacaagggttcaaatttcagaaacgactggagcacctttgagccctgcccattcctggtcacctgccctgtcaccttgcaaattctcttactattgtgggtcagcggggacctgggtctgatcacaactcccctatcaaagtccatgcgtatcactgtggggccccaaggcgtgttcaccgtcatgcactctgctctgttgcgtcttcacagcattcatgagggatcgaccacgtctcacccctctgcccagagcatggtgtgatcagagcttgtgggcccttccatacatcccctggtgccccccaggtgaggggtatgggagagagaccctggggagctcaccagtggggccagggagtgatagcagcgtatctcccatgtatagtgcggccatgctagaggcttcacccaggtgcctgcaggcacttcaggccaggagccttggaagtaaaggcctaggggcattcagccagtcccagacgctactcagtctttttgtgcatagcttcctgtctcaaacatcagcccctgaggttcacaccccatcatccctacacttgtttggctccgggcttctggggcaagggcagaagagatgtgaggtttgaattctagggtctaacaccccattcctggccactgaggcctccctgtggtttctctgtgaagtaggaaggtgccatgggaatgggtaggacgagggtggccaggcagggcagcagcagcttgtcaagagcacgtcctggtgagcactgaggggttgtggctttggctggaagcctctgatacctggagcctgtcttctgctaacaagcctgtgttcaggggcctgtgctcagcgtgctcgtggagtctggcctcccaccttctccctccctgctggggagaggaggggcaacagaattctaccagggagactccagagtcagttggctttgcccctcactgctccttgtcactgtcttgtctctctgtcctctgtcccacgtaagcgtctctctgaccctgtttccctgtcctcttatgggggtgagttagaagctcaaggtttggactggaacacactgtacatcctctggtctcactcactccctgtacctcctactcaggtttagagaatggcccgaaggcctcctgcgctctttctccctccaccgtgactgttgggctgtccttgtgggtgctggggaataagtgaggagcttgggtggtcactggggtcagaaggtctaggtggtcattgcacagcccaagtggggggctctgttgaactaggctctggatggtcagtgaggatgactgggggtcagaaagcgtcaggggtgggcattagggacagcagtaaataccagctaactggctctgcccttctctccattacaggttgattgtcctgggctgtggctggctgtggagctagagccctggatggcccctgagccagccccagggaggacgatggtgccccttgtgcctgcactggtgatgcttggtttggtggcaggcgcccatggtgacagtaagtctgacccctcaaggtacagatctcccaggttgaaaggtggcatccttcccagcaggactctgggatggggacagaccggctactaggagagacagggtggccagaaaccctttagaccttctgtcctagagagcccccactgcttggagagcctccttctaaggaatacctgggtacttaggagcatctttaggcaccagagcggggcagtcgaatcgtgaccctgtcttatggggctggggtgagacctgtcctggattcatgtggtcattgtgtgatgtgcgcgtgtgtgtgctgtgtgcactgttgcagatctgtgctgaaggcacagtgtgagctacagccaggggtcggcatgggaatggggggtggcacgcagggcatgcgtatggatgtgtgcccaggacgcgggtgtgtccataggcccaaggagggtcaaaagcgggagccacccatagctcttcccctacgctggaccctcaggatccaagtatgcagatctgagcccctccttctcctttcatggggaccttctaggcaaaggagcatccccccaccccagctcctcagacctggaaatggggggaagattgtgtttggccggcaggaagctgagcaacgcccctctgtgtgtgtttgtgttggagggaggtggaattgtccccatccagatccaactccgaactttggtccctttcctgctgcccttccccctgcctggcactatgagactggcctcagcccgccccatcgccatggttaccactccttggttactggtgggaggcggggcacagggcagatttagccaatctgcaggctgagggggaggggcgaggtcggagccaaggtccctgggggaaggggccgttcccagcctgtccagagcccaggggtgatccagggccaaccctggggtcagcccacgggtcaccaggccatagggctcccccacctgcctccgtatctctgggtacagatctctccccttgccccaccagggctctttctcctaatggctcattaattattcaggaactgattctggagtggggtgggactggtgtggtcccgccctttgtcctcaagtgctgggtcctgggtggagctagaagggaaaggagaaggggcaggcattcccaaggggtggggcaaagggtcatgggagcaccaggtaccaaagagagggctgggcaggtgagagcaaggaaaaaagacaggtggggaatcacatggggaagtggggcaggggatctccaggcctggctggaacctgcaggggcaggttggagtagaaagccttatcaggtgtgacccacatggttggcaggaaggtgaaggcttgtccacgtgtggtcagtagctcttggacattgaagtactgtccttgccctccccgccgacccaaccccaggcactttcagggccttcagacaggagctctagggcaggggaaggatggcccagttgggcttcaacagataacacatcctgggagaagagctgccctcctcctcctgcctcagacccaacgcgccccaacctgtacccctcactctcatcccccagcctgctgtcttcccgtgttctctcccgtgaaaggcattaccacccacccggtcacccaagtcagaacctgggcctcctccagcctcctccctccgtgatatcccacatctaatccatcaccaagctccgttgcttctaccttctgaatatctttggaatgcatccacttctctctctaccgccttcatccaagccaccctcggctcttgggcttttgcacgcaacagcctcctgacggtttccctgcctccagtcttttccttcctaatccattctgcattccaaaggtagagtcgtgtcacaaggtgaaaacatcatcctgtcactcttcagtttagaatccttcattccctcccacccccaggcccccagggtcgtaacccttctataggccctgcattatcaagcttctatcaacctcatccctcgctgtccctccacccaccccactcacccaccacgctgacttctttcagtggttcaccaattcccagtagtaattggtaggggcaagggggaacagtttttaaagcagagaacctccatgctggttccttaggaaccaaagcccaaacaccaggtcttgacggtagaaagcagctgaagaagctgaaatcctgccttcttcaggtagggggttcaggggactcaggccttctcccaggcagagagccatggggcaggagcctgggctgggggtcagagtgaccgagccgcaggagccagggtctgtcttccaggcctgtcttacactgcacacagttttggatctctccctgcactgaggcagggctcaggctgagcttgggcaactactagccaggggcaagtggccatacacagacagggccactgcagaagatagggtaggcaccccagagaattgacagctggggcagtgaagcgcggagtggacaaatgtgtttcaataggcctcttaacgagacaaatgaatgggggccctggcctctgaggggagtggagggaagcgggtggagaagcagctgccaagagttagcccagaggccccagtgtcagtgccgcacgcgcagctccagtggagatttgggcacacattggggtaggatctgctgcagcgcagcttccccagccaggctttgtggcttctcaggaggggaggttgtggggccagaggtgtcctgagccagggcagaggtttttgctgatctcaagtgcgtgtcgcgtgcctgtcttcaggcaagacctgcagtgtggaggcacaggcttgtgagcagtgaccacagggtgtgctgggtaggtggcactgacacaggccatggcagaagcatcttgggagaggagttgggaggcttcctggaagaggggagccctgaagggtgagtggacatttgctaatgggggggtattgcataatgaggtggggttgcggggaagaagcacgaatgtggctgggcttctctgtggaattcatgggagagccacagtgagaacccgacagcatgggacagaggtggggtccgaagaccaggtgggagtgagaccctggttatggcccatttacccagaatcctaggagctcagagcaggatgcgtgctggctggaggggtgggtggcgggtgggttgacagaggtgggcagaggctgaggagctgggagtgtgtctgttgtgtcatttccctcctccccagagcctgtggagcacacagggtctgttgtctgtcgtcatgctctccccctcgttctatgggtggcctgtctagactctgctccctgtgggacttcccgcagattccgttgctttctctctctgggcctgttttcctattgcacaatggggataatcactcctacctggaaaggttaactgaggtcacatggatgaggtgcctggaacctagtatgtattccccttatctgaggccatgacctggggctcttgctctgtccctgggaaccaggcttgtctctgagtgggctccaggggggtaccaggaacagtcacaggagctcactgagtcccagcttaagctgctcagacccagggatatctgtctctccagaagctccctgccctgccttcgccggccctcatggccctgcctccgtgtgtacatgtgtatgtgtattccatgggaaaggcacaaaatagcagtcagtctctccatagaagagccttgatggtggcccagtttgactctccctggggctggacccctacagcctccctgggaggtggttgcagcccccttcctccagccagttccacttactcctttcttaggccacttcctcccaccctgcatgggcttggtggctcgagaatgttgccgtccataccccgggagctgtgctgaaagggctgtgcggcccccgaccactgtgtgtgtcagggagggggcacgctctcgtggggtgtcaggccaggtggcagtgggtaactggcagaaaggccctcctggtgtgctctggtggcaccctgttgacccagtctcagaagttgtgttccgaccctcactgaacaccagctgtgggtcaggcacggggcagagtagttcaagtagcttggtttgctgcctgcctggggacctgacactgtgggatctggtcagtgctgggatgggaagctctgggcacctcaggccatgggacacagagcaggctcctacagcagcttggctgggtgggacatgagagaggggctgggctgggcacactcaaaggcagggaggagtctgagggcctggcctgtcagggtggcctaggtggtgggtccaagctgtgtgctctgcacagtgctaggcctgtactatagtaggtgctcaaaaaatacttgttgaaagagtaaagaagccgggtgtggtggctcatacccgtaatcccaacactttgggaggccaaggcaggtggatcgccagagctcaggagtttgagaccagcctggcaatgtggtgaaaccctgtctttaccaaaaatacaaaaaattagccaggcatggtggtgtgcacctgtggtcccagctactcgggaggctgaggtgggaggattgcttgagcctaggaggtggaggcggaggttacagtgagctgagattgtgccacttgtactccaacctgggtgacaaagtgagacccccctctcaaaaaaaaaaaagactaaagaaaagtgagcctgagagcttaggaggagcacatttcagaggggaacggagagaggaacatcaggcccgttggtagctgaggagaggtgcggttagatctgtgctccccaaagatcctctgctgaacataaggggcaacgccttgtctcctgtgctgtgtcctgcgggtggaggtggattggagggaagcggagggcgaggcctggttgaggggcggggcctgcctgtctggtcccccgggctgccttgggccagcttggcctagtctgttgggtgggcgggcagggtgcaggctcctctccagcctccaagggaggggagttgttctgcctcctcgatagccccaggccttgggcacagcccagcctcccacggctcttgggccctcctccttccaggccgccggtgacccacacctggctctcctccccggcgtctcctctccgcttctttgtttggagcggaggccccgccccaccccgcccccaggcgcactcgcccggccattccggttcagccggttccagcccccagtttctgccgctgcaggtcccggcaggagctggaggggcactttctccctgggtttctcttccctggtgcagcaggggccgcggtcctcatcctcctggttcctcagttcggtccttctttcattctccacccctgggtgccaggaactgggtcagacactgggacaggaatccagacaggcatgctatctgccctgcccagggttatgttctaggaggggaagcagccattaatcaaacaccaaaaatgtggaaaagtaataatctcacacgtgtgcataataaactgtgagtgaaagttataagctcggcaggtaggtaataagctaggagcagtgctgtgggaggcaagggagttacccgggagtttcaaactaggaactgagctcataggttgggggcagggggactggagaaggcagtgatacttaaatggagagcagaaggatgaatggaagttagagtgtatggcggaggttggcagaagcagcagcttatgcaaaggccctgtggctgcagggaacatgacgttgctctttagaggagccaaagctggggctctggggagagcagctgggtcagaccccgcggctttgtctgccataacaggtgtttggagagtgattcggcaggtctttggagggttttgatagggcggggtgtcgggggaggctgtcagctcactctggacactgagtagagaacagacgggaggcgtggggcaggcctggaggcaggggcttccgcgtgttaggccagtggagtgccagtcaagggaaggtggtatctggactagggtgtggcagcgcaggtggagaaccctgagctgctttgtggagggcttcaagtgtgggggaagagtgcacggtatgggggtgggggacaggagacacccccagtggagcctgagcaggagagtcgtgtctgagagggtctgtctggaaggcgcaacagaggccaactttgcagacagctgcagtcgggagagcctggagcctccttcaaagggcattcaggggaagggcaaggcacgctggggggttctggaccttctgtggtgtcttcttgtctttctggtccctacagcctccctgagctggctgcccgagcctgccctaggcactctaagaacatagtcagtcccaaggtctccctccagggaaggccgtaggtgagcttaggagtgagaaggctggatcaaagcctggctccatgcctgcatccctctgacttgccagtcatttcaccctccgagcctctatttccccacctcttaaatggggataataatactacctaccttatgggattgcggtaagactgataatgctggtacgagtgacagcttccctcatggaaggcccaccacgtaaagcagtttacagccatctcattccatctatgacagaatcctgtgtcactgttttggagatgggaaaaaagaggctcagagatggtgagtgacttgcataataattacataaaacccccagagcccctggcccctggagttctcaaaagttccttctctgttggtacctgcagctgccactccctaccccgctcccatagaccctctcctccttggagactctgccccatctgccgtcccttctctgctggatcaacaccttttccctctctgctggctcccatcagtatttaaacattgcctttcatatctgtcttcaagaaaaaaagaaaaaaaaaattcacaaacctcccttcccgcctcatcctttccagctgctggctgtatagtcacctgtacttccctctctccctcatcgcctcccagtcattctttggccttctttggtctggctttggcccccacccaccactccactgactctgttcttgtcaaggtccctgacaatcttgtgtgaactgttttgtaccaggtgtttgacagtcaaacatgcctgaattcaggtcccagatgtgcccctcactggcatgtgatcttggacaagtgacttgacccctctgagcctgtaaactgaggataatagcaatgaaggactaaagataaagaacctggtgcagagtgggtgcttggcaaaggattgtcatcatcgcacacgtttctgtgccagggaccaggctgggcctgggctcctggggaccaaacaggtggtctgaaaggtcatttctcacagcactagccctttttggagctgttcattggtctgattaataggaaatggatcagctgtcaagattaacgagctattgctacaagattgtagcaaatgggttgggcttctctgggttcatgaccctaggtggttgaattcttagggataggggctgtggactggccctggtatgtgtactgaggtgatgagggtgtggcagtgccatgtctgagcccctacctttcttctcctccctctgcctccctgtggacaccttgaggagactgtcagaaggcaataactaagtcgggggggagggatgggagaggcagatttacaggaaagcattcacctgggaagatatccagagagacttaggaactggactgtctaggcctttgggactgctgctggtatgtgggggctgggagagagggaggagtctcggttcctggccggagccccggggtggatggtggtgccatcactgagatggagagcagggggagggacaactctcagggagagctggagctcttcccagcagctctccagcacgcctttttcctggagcttggaattgatgtggggcgggcaacagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggtgaggtgtccttgttttctttgtaggtctttctctctgcccccatgactgccaccttcctcactggccattcctatagtgactgtgctgtggtgacttggtgtctccatctcttccaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtgcgtctgtggtgggaaggggtcggcagggctcagggtctgcccacactctctcctttcagtgtccctcctcatggaccttttggaggtgggaggacaactgaccctgagcaggctcctgtgtcctgagtaggctgtgaccccatgtctgtcctctgacaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaaggtacgtgctagggagacgtggcacggtgggctgccgggctgaggcgtgggaagagccagccagccctgatcctgtcctgggcccatgtgcatttggcagaaaggaggactggccacctcggggtcagtgaaagtcagtggtggacagggatagtcattggatctggcctggattgtgcggcttatgctgaggccagccatgtggggcatgatgcctttgtattctcctgctgagccgggtcgttggttgggtggggtctggggtctgacttgaggtgtggagctgcagctgtgtatcccttgggttacgtggttatggctgtggctgtttggcagtgaaccggatttccatgtggagcctggccgtaggtgtcaggcaggtgtgttccttgttgcccctgtgagctgagggctggggctctgtccgtggattttagtgtcttctctcacttggtggcttctccattcattcacaaacactccctggaccaccttgaagtcctctgagcaccgaggaggaggaagctgtgtctaagccaagtcttgaggacaggtgggagttgggggtggcagttggcagctaggcaggtgcccaggcccagaagcaagagaggatggagctttcagagagctctgagtagttcaatttgggttttctggagggcagagggggagctagagagcacaggaagaaggagaaagcaattcagcatgagtctggagaggtttggagggcagattacacaggatctggctgagaaatgaacactctcctagggacataggaagccacaaacaaggcgggggtgacatgatcagaccccagccacaactgattcatcagtctgaatgtgtttatgttttcaaaatatagcatcgattgttgcttgcttttttttcttttctttctttctttctttttttttttttgagatgcagtctcactcttgttgcccaggctggagtgcaatggtgtgatctcagctcactgcaacctctgcctcccgggttcaagcgattctcctgcccggcctcccaagtagctgggattacaggcatgcgccaccatgcctggctaattttgtattattagtagagatggagttttaccatgttggtcaggctggtctcaaactcctgacctcaggtgatccgcctgcctcagcctcccaaactgctgggattacaggtgtgagccaccgcacccgggccgattgttgctttctttttaagaatgtgatgtcgatacctgttcctttttgaaaaattggaaagtatagaatagcacagaggaaaaaattaaaatgtctcagtttacctctagtaataacatttggttacttactcgtggcccattttctgtgcatacatatatatgtgtgtgtgtgaacagaaatgggaccacatactgtccgatgatttgtagactgctttaaaaacaaacaaaaaaaaatatggctaacatcttccttgccactaaatattcttctgtatcattattctttttttttttttttttttttgagacggagtctagctctgtcacccagcctggagtcccgtggtgccatcttggctcactgcagcctctgcctcctgggttcaagcgattctcctggctcagcctcccgagtagctgggactacaggtgcgcaccaccactcgtgactaatttttgtatttttagtaaagacggggtttcaccatattgaacaggctggtctggaactcctgacctcgtgatccgcccaccttggcctcccaaagtgctgggattacaggcgtgagccaccacgtccagcctgtatcattatccttaatggctatgggtaagctgtcacatgcaagtaccctaatttatttagccattcccttattgttggacacatatgttctcagttttttcgtttctataaataaggtgccatacacgtcgttgcagatggatgtgttcaccttcctgattattcccttattctaggttcatggaagtggaattgctgagtcaaagggcacatgcatttttaagccttttgatatttccagaagattgtgtcaattcatactcctgccaagcagggcagaagagggcctctttcctgcacatcttccccactgttgggaaatatcttcaaaaaaatattttttgccaagttaataggcaaaaaatggcatctcaatttaatttgcatttctttgattacaagaacagctgcacatgttttcacattggccatttttacgctgtggctttatctgttcacacacacatctccattcagttactctttttgttgttgttgttgttgtttggttttggggggttttttagttttgtttgagacagagtctcactctgttgccaggctggagtgcagtggtgagatctcggctcactgcaacctccacctcccgagttcaagtgattgtcctgcctcagcctcccaagtagctgggactactggcaggtgccaccacgcccagctaatgtttgtatttttagtagagacggggtttcaccatgttggccaggctggtctcgaactcctgacctcgcccgccttggcctcccaaagtgctgggattacaggcctgaggcactgcgtccagtgtcggttactgttttgcatctgtgtcttgtatgagtccgtgggctctacaagcttagaggagccatagaggacagtggttaagactctggaccactcacttctcgtgtgtctttgggttagtaactatgcctctgaccctcatttgctccatctgtaaatggatataatgcctaccacccaagctggtttggaagattgaatgctgtgtatgaagcgcttcccaggagtgtggtggtggttgctgtggggctggaagctgtacatcttgaggcctcaccacgtgagctgaaggtggttggcctccgtgctgcgtggcatcatccgggtgatgcagctccactgcctgctcccacggggggacatacctgtgcaataggaactcagagaacaggccctgggccagcatcactgattgctgagtgttctcaggctcctccctgccacttctgacctgtttccccactcgtgacctgggggcaagtatttcaatgctgcccagtcctcctattggcagctgtcctagcagggagccatctgccctgccctggcatttgggaggtggctgaaggaccagaggccccagagggcttcttttcaggctctcagattggggaacagggcctccttgttagtattgaaagaggagtccttcaaaagcgcctaagccccaggtcctgggtcaggagccctcttacctctgccactgccctgggcagccttacctttcaaagggttgaggaggatggaggtggtctttcaggcctggggtgaggaggacggacttcagactgacaggaggggctgggtgtggtggctcacgcctgtaatcccagcactttgggaggcagaggcctgcacatcacttgaggtcaggagttcgagaccagcctggccaacatggcaaaaccccatctctaccaaaaaatacaaaattaactgggcgtggtggcgcacgcctgtagtcccagctacttgggaggctgaggcaggagaattgcttgaacccaggaggaggaggttgcagtgagctgagattgcgccactgcactccagcctgggcgacaggagactccatctcaaaaaaaaaaaaaaaaaagaggacctgcaggaggtgcctccgtttggtttctctaccaggggccagcagtatatgtttgcgcttctggggtgtgagaagtgtctgatgaggctggggagagtgtggcgcaagtacccagaccctgtccatgctccggggaagggtgtggagctgtgggcctgagtgagcccctcctgcttctgaaacatagcaccaggaagacaaaatgctgacttatcctgctggtctgtataaccttggccagcattgggcttgacagaaaggcgtgccgcaggagggccagagggaagcagcccagagggtgaacacccgccccctgccccgcctcaccccacccctcccctccctcctaggaggatcaagaaagctgggtgcctgcaggaactgggtgaaaggatggttggacttggactggagctctggggtggggccggcaggagccagggccattcttgggaggccaccacagggtacgaggagggctggggaggggatggagctagttggggtcggggaagtaagagtccttcctgagttgcacacagctctccctgtgagctggtctccttggagaatggctgagggctgtctggggtgaactggctcaggtgaagatcagtgtgcccccaaaaaggagtccaggcctgcagtctgttctgtgccctctgcctttgcctcatgtcacaccaggcccaactgctgtggctccagggccactcccaccacagcccgtgggagtgcccccccaaatcccccacagccgtgccctttgcacctcgcatctgagcaggattgttattcccagtgtggcctccccttgacacccccgccaggactgcatacgaggtgggggtgcccagcacaagctggccggggtgagcctgtcctggctgtgatgagcgtggggcccgccgcccagcgttcctgtctgagtggtaattgaagccattagcgcgccagcctctccctcgccgggtaatggcaggaaaagctcttctcgctccgcactcttgaggcggcggctgaatcactccccctccaacccgcccgctgccgccactgagacagggaatctgacattttccctcaccagggagggggagccctgggggaggggagggaggcaggcctggattcctggcctttccctccaggaggttgaggggcagtgaaggtcttggagctcagtctgtaagtcatggattcacctggggccgcagatttcaggcctggaaggactggccgggaaagcccaggaggccgccagacattcagtggtgtggggagggcactgatgactttgggtaggttctgggagggacaaggaggcggggagaagaaagaagctgtggagcagagatgagctgttttggacttctcctggggggcttagctccaagggttctgagtacaggtagcattacttgtcttggggtcattgatagggcagataacgtgcactgttcgtgtggtgtgggtgccctgtgtgccatgtttaaggcagtgtttgtgtgaagtgtgtggtgcagtgtgtgcagcaggggtgctgccttgcaagctgtgcgcacagaacggggtgtgcagcggtcagcgcacacgttaccatcaggcagtggggaaggggcagtgtgtgcaggaggcactgcatgctgtatgggctgtgtatgcagcgcgcagtgtttgtgtgcacgtgtgtgcgtcaggcagtgcgtggtgtggtggtaagcaggtagtgagtaccttatgggctatgtatacagcaaggcatatgcatcaggcagtgtgtgggcagtaggcagtgtgtgtgtgtgttatcaggcagtatatgtgtgcggtgtgccgtgcggcaggctacctgtgtttatatcgggtagtgtgtgtgtgtttatgtgcagcaagggtgtgcagtaggtgtgcagtagactgtgtgcagcaggcgtgtgtgtgtgtacagcaggtggtgtgcagcaggcagtgtgtgtatgtatcaggcggggtgtggtgtgtgtttatgtgcagcatgcggcgagtactttgtgtggtgtacagcaggtggtgtgcggcaggctgtgtgtatgtatcaggctctgtgtgtgtgtgtgtgtgtttgtacagcaggtggtgtgcagcaggcagtgtgtttatcaggcagtgtgtggtgtgtgtgtgcatctttatgtgcagcgagtagtttgtggggtgtgcagcaggtggtgtgtagcaggctatgtatgtatcaggctgtgtgtgtgtgtgcgcgcgtgtgtacagcaggtggtgtgtagcaagctgtgtgtatgtgtcaggcagtgtgtttatgtgtgtgtgtccagcaggtggtgtgtagcaggctgtgtatgtatcaggcagtgtgtgtgtgcgcagcgggtagtttgcaggggtgtacagcaagcagtgtgcatggtatgtacagcagatggtgtgcagcaggcagtgtgtgtgtgtgtgtgtgtacaataggtggcatgcagtgggcagtgcatttgtgtgcatgcagcaggctgtggtgtgtacagcaggtggtgtgcagcagactgtgtgtttgtatgcatcaggccgtgtgtgtgtgcagcaggcagtgtgtgtgtgtgtacatgcgcacacgcaacaggcactatatttgtgcagcaggccatgtgtgtggtgcatacagcaggtggtgtgcagcaggctgtgtgcttgtacatgcagcacatagtgtatgtgtgttgatgtcagacaatgcatgtgcatgtgtgtggagtgcacagcaggtgatgtgcagcaggctgtgtgtgtaggtgtgcctcgggagtgtgtgggggtgggagtggacagcaggtggtgtgtgccttacaacctgtgtgggcagcagcaggagtgggcagcaagcagcccgagctgaagtgtggtggggtcagtctggcactggcaggaggtcggagatgctgtgtctgggctcattgtctctgggaccccgcaggatccctgtttggagctgttggtccgccaggaagttcgacagagttggatgtggccagaatggtctggctgagctgttctcagcacctgttgtggtcgacctcagcagctcctctgtagccaggccaggaggtggggtgcaccagatagggatcctgcccagacctgcctgcaggaggtcttgggaccctttcctctccctcccctaccccaccaagcccacagtcccttctgtctgttcccacctggcctcagtgtccagccagcaccataccacctatgccatgcgggccagggaatccaggtgtctcgatggagtgcctggtgttgccagccttggagcaggctctggggaagggctgtccggcacatgaagtagtgaccagggtgggggctaatcagtgctgtactgggcttggacctctgggttctgcaggagctctgaccctggctggctttggggctcgtgggatgacgaaggacctcttgatataccccctgaccactccacaacacagtccttttggaaatagccctagagacagagggtcaatgatagacatatgaccctgtcctgaggtatcctgggctgggctggaactggagcagagctggtgagggagcttacatttgcaagatgggtacatgtgtgttttctcaaggagtcatctctccctgctccacctccttccctgctccaaacctgtatattccttccacccatggtggaatgacttggcccaggcctgactttgatggctggggagttgggtaaagggctattgcaggcacaagatggcttcccaagtggcaagatgtgatccctttctattgtctacatgtgtgtctggggtaacagtctgctttggcagaagctggggctgtcaactacctgatttgcagcacagaggatgtagaagtggccccagaacctggaacccaagccagcttctacctctcccttagcaactgaggcatgacctgtatacccctggtccagctgctgtagtcctctgtgacctgtccttacacccccatgactgcagtagatttcagatccacgcagacatgaggttctacaatcatttcctggaggttctaggcctcagggatggggatgggagaggtattaagtaagttctcctgtttttattagctgtgatctgccttgaggcgcccaagtggattcccttccgaatgggtgctcctgtttagtaggtggtactcctgcctcttctgttagccatggacactgggcacttcccctgtgcccagcctgcccccctgcccctatactcacaggtacttgtaaggcccactgtacgtgttccctagcctcatgaccacggtggagccaatggctctgggaacaggctcaccaggatggcggtttaaatgcccaaatgccctgtgcatgcacattctccatccttggtaaggtgctccctcctactggtttgcttgctggggagagaggacttgtttttttttttgagatggtgtctgactctgtggcccagactggagtgcggtggcacaatctcagctcactgcaacttccgcctcccgggttcagatgattctcctgcctcagccttccgagcagctgggactacaggcacgcgccaccacacctgactaattttttgtatttttagtagagatggggtttcaccgtgttagccaggatggtcttgacctcctgacctcatgatccacccgcctcagcctcccaaagtgctgggattataggcgtgagccaccgcgcctggccctgagaggacttttttgaaacggagtctcactctgccacccaggctggagtgcagtggcgtgatctcggctcactgcaacctctgcctcctgggttgaagcaattctcatgtctcagcctcccgaatagcttgggattacaggcatggaccaccacgcccggctaattttttgtatttttagtagagatggggtttcacgaaacatgttggccaggctggtcttgaactcctgacctcaagtgatttgcccgttttggcctcccagagtgctgggattacaggcatgagccactgctcctggccaaattttaatcagagcaatgacgtgatcaaacttaagcttcagaaaggtccgtgtgggtgcatagtgggggctggaaggaaaccaatgacaggttgttgcagtccaggtgagtgatggcattggcgcaaatctgggtatgggtaggggaagataggggagcagatcactagaaggttagaaagaggccgggcacggtggatcatgcctataatcccagcgctttgggaggccaaggtgggcagatcacttgaggtcgggagttcgagaccagcctggccaacatagtgaaaccccgtctctactaaaactgtaaaaattagctgggtgtggtggcaggagcctgtaatcccagctactctggaggctgaggcataagaattgcttgaacccgggaggcagaggttgcagtgatatgagatggcgccactgcacttcagcctaggcgaccaagcgagactccatctcaaaaaaaaaaaaaaaaataagattagaaagagtagaggcctgcctggctacctgtaggattggggaggtgcaaggctccaggttcctggctctggggctgggtaggtgggggtgccatttctaagattcatgtactagaggaggaccaggtttgaggaggcgagttggtgagtccagttagaaatctgttgagccaggtgtgcgcaggcatccagggaggtgtcaaagaggcctcgtacacatttgcctggcactccgggggacatctgaagttggaatcttacaggctgagaaatagcaaatctcaggaggccagagccaggacagaaggagccccaggaaccgactctccatgttgggaggaggttcctgagagactggagggaaactgggagtgtgtgaggtcaagaaatgccaagagaaaaaagtgtgcgaaggaggaggagtggtcagcagggcggggtgctgccgagaggcccggcatgtgtccttaacagttagttccgtggagccattgttggctttggtgttgggagacagcagggctgagaagtgagagggaggctatcagtgtctgtagtgactggaagggcccgaacctagggagtgaatggatgacaagagtctccctggagtaggactgaggttggggagccactgaaggagagtccagtgtgggcccgagtctggaactccagtgtgggtcgggtgtatgcgcagggcatggcccctgggttcttgtggtggggaggcctcaactgggttgagtagggcgatgtggggtgccagggaaacccgaggaaggaggggatgactgggagggggacgccgtgcctgccaacaggccccaaacagctcagattgaaaaacaaaacaggcttttaagatgccaagtttgatgaaatctgagtgctggaagaggtgggagtttgctcttggaaaaacagctgaaaatcgagactcaaagctgcgaagggagatgggcccaaggctccccaggccccccttactgcctggaagcctgggggtggggctgggctctctgggagagtgtgggagcgtgcagatctggcagccttcgacttttggaaggcgtctggctctggccctgctgaggatggagctgctggaggtggccttggcttctgtggagcggctgaagggcagggggagccagcagccctgccacctacgaggttccttcatgtgtctcgtccctgcatgtgtctccaggcgcacgtgttttggcataggtgtgtctggctgtgcatgtctccacatgtgtgtttgcgtgtctctgtgtgcaccgcctctggatctgcttgcatgcgcctgtttccacaggtgctagtcactgcaggtgcccctccacatgcacatgtaggtttctatttttacacctgtctgtttctccatgtatatttctgtgggttcctggctgtgcatgtttctatggtgtctgtgtgttgagaggcagggtgaggccaggcccaacactcaagcttaggggaggcggtcaggctcacagacggtgccaccccagggggcctgtgtctgtgtgtgcgggtgcgtgcctgcgtttgcacggagacgccacgaagctgggtaaacatgggtgaaaaggtcatactgacagacggtgctgcctgccccaggaccctgcaaggcgtctccatctgtcagcttccctggtgcagccccctccctctggcccagagactcaccctcaggcgtccaaggctgagctggacaaagagacctgtgtgtactttgtagggggcctcagcagcctccacccccatcttaggctcctctgtcaggaccccaacacatgccccagctcccaccagactcgccttggtactgtcatcccaccaccttcccccacaacagcctttacaaaggcagttttcccctcctccctggaaagctttctgcctcccatgctcatgtgtttcctgttcttgaatctccctcctccaggaagccaccaagatagcaagtgagctgtggagtcaaaccgatcagctccaacactgctgtgggaggttagccaagcgctcatccacttctgaaccttggattcccaccatcgacccccgaccctcccctcgctagggcttgtcatcgtcttctgcccatggggcaaccaaacctctccacggaaggggacaggtctccttgctgcagtgggtaaaggccagcgcagttaggtgcaggaggcattcacacacacgtgcacactccccaccttgcacacatatctgcgtgagccggggagaccctagggaatgtgtgtgcatgttgtctatgcatgcgggtagaatccgcaaacggtgtggagactcgggctcttgggtacctctgaaggcccctgaagtccccatgggcttctccttccgtccagggcaccctcttatcaggccatggccctgagacgcgtagtgcagacgcccccggcgctgaggctgaggaggcagatggcccctccccgcactgtgcagggcacccggttgggggtggaggggagggccgcgtcggtgaagcgggaaagcctagtgggaggattccctggagctgaggagccggggcctgggaaggggcgcagaggctccacccaggcgggggcgggaagggcggtgccagggcggacagcggacgcgcgcgcctgcacggactcgggcacacgcagcccttccgcggcagcgcccgccgctccaccgtcgccatggctaccggctggcctggagcggggaggggcccttcctccccttcggcgccaacaggaggcgatttgaggggactcagcgtgactggtgcatcccggggttggaaaatgggtgggtgcttgcgactgtccacgtgtgggggaccctggggttcgctttgcggtagatgcaaacgccgcggcgcgtgtgcggggctctgcagtggagcctgagccgtgccggccgaggcgtggtgtgggggaggctgccggccctctcgcgcgcggggtgttcacgcctagagcgctggggctgggggcctaccacccggtctcctcccagccccacctccgatttagctgtgtgaccttgggcaggtgtccagatgtctagatctctctcagcccctggttgcccatgtacctcataagggtttggtaaagatttaagtcattttgtaaagcattttaacatagtacctggaacctagtaaatgcttcataaatcttactgtccctcatacctgggtctcagttttcccagttgttgatgggtttggagtgatcatgtgacatcatctgaggagttgcccaggtcctcagcctgagtgttgaggctgcggtagacccagcttccgcgggtgcccgtgggggaaggtggtaagtgtgccagtctggctgatagatcagtttacaccaggatgcccagtgctcagccaggccaggcgcatggtgggcgtcaggaaagggctgctgtacttggctgagttgaatgttcagaggcgcctggatgggagagaaggaagaggcagcagcaagtcgctcctgaggggctggagccctcctgtaagacccacttcccttcccgggtggcagagtggcagacttccgagtgctgcctagaagcctagttggcacaggggactggcttttgggtcccgctgttttatggacagctctccacacattctggttttaggctctggcggcagtgcctgagggatgatctgagccaaggacagagccactgagggcgtgataattgagggaggaaaattaattgtccttaatttggcgtaaatcccaaagaccttcctcgtgtaaggaattcagagtagattccgagacacagggctgcacacatttgtacttcccttcccttccctatctgcgggtggagatgaaggccacttgactcctgggccctgactctggcaggccatggccacgtcttccccatgagctgggcaggtaggaatgaggtcttgaaagagttagactggtgctctggagggcacccaggatggccctagcagccccgagtgtccccaggtgttggggaggtgagccctgcacctctggtccccctcaggccttcctatggaagcaagcagcagctgggccaaaggaggctgatcccctgcctggtgcatctcagtcctcttcatttccgtcctccttcccttctcttgccactgttgaacattttacttttaaaaatctgaaagggcactgtgggatcatatttacagccaaggagacactgggtttatatccagaacttctagggctgcaggtggggaaacgtacagccaggtcccaggaaaggctggggcggcaaggccgtgctgggaatcctattgctctctagcctgagacctctgctcctcatgggccacagtccctttgggatgtccctggcagctagagccttggggagcatcccctgggactggcagcagatagataggtatcttgctcctgcctgttggggctcgtccaactccctcttctacccgccccccagtcgctctccctgggtctccaagaggctccagggagggctagtttctgccagcctttaccttcttcatgtctgaggatgccatgtgcctttactctggcatagaagcctgacttcccttggcacatgttcccatacacccatcttgtgctgggcttgtggaaaggaggtagagtggtgctggtctcccccaccatgagcccagctccccgccttccccaggagacagacaaagaacacacattccccttgccccacattgggtgtgtctggcatccacactgggagagacactctgctgaggccttgaaaattggtggtttgggatggggcctggtggctcacagctgtaatcccagcactttgggaggccgaggcgggtagatcaccagaggtcagaagttcgagcccagcctggccaacatggtgaaaccccgtctctactaaaaatacaaaatttgccgggcgtggtggtgggcgcttgtaatcccagctactcgggaggctgagacaggagaattgcttgaacccaggaggcggaggttgcggtgagctgagatcgcaccactgcactccagcctgggcagcagagtgagactccatctcaaaaaaaaaaaaaaagaaaaagaaaattggtggtttggtcctagtgggaagggcctctcaccagcctagagtggaaaagggagttcccgactctagtctcaatacctgtctgccccagtggctcagcccttactagttacaccagctaatattcactgggagtgaattccgcatcagatgctccgcaacaccttgcatgcatgatcagatacagacctcacagtagccttaccatcaaggtgggcacttgaaccctgtgtacagataaaggagacaaagaatgagtaacatgccaggccctaaagctagttcgtggtgaacgtgggagtcccatttgatctatactagtcctgagcctgtcctggacttgtgcttccaaggggtggagagtagatagccttgccctgcagcccctcggggctgatatgggagcccatgtacagtgggagtgggtttgctgctgacatctgttcctcttactctatgctagtgactcctctgtgtgccgccaacccctagcaagctgggagaaggcagccaggagggagttttttctccccctaccaactttttgtgtctttagagcttttttatctcctttgcctccacacactcaggcatggtctgcagccctgaccgtgactcccagggtcaggactaagtgagggagaaagctcaaggtcaaggctgcagtaacgaataggtcaaggtcaggatcggagttagaaggggatcattggtagggctgggggtgccccgggtcagggctagagaccaggcggtgacctggggctctgccatgtgatagagctgaaggctggatgaagggaacactgtgtgtgcggacaggggagagggggctggacagcacagaggccttcaggctgagctgtggctgttggatgctgcgcgagctccctgctagcccccccccccaccccctgcagccccagcattcatgcagtgctttctgctgtgaccagcagagcattgattctcgttcttctcagggcctggagagataagtgctgacgccttcagtctgaggcgttgcctctcagacctggaaactccctgacagggcaggggtgggccccactgcagcctctgccctgccaaagagacttaggaccctggttcctcaaatcggggtatgcttcatgcttagaagtcaaggaaaggggaggggagtcttgagggccctggccaacctgcagttggggaggttacccccagaggggtcatagggggcaggcagagccagccctaatacacacattgctgtttgtctgcagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgagcagagggcaggggtcaaggggccatgcagacctcagaacaagcgtcttgtcagatcccagcacagcctactcccttgggcctgggcacctccagggctgagcggagggtacctggtggggtgggctgggtcttactgcaggtgtgcctggctcagggaagagagctcgtggttggctgtgccgttaccttcttcggattgtcagactccagactttgggccagttctgcccctcccagcacatgtgatgtgccagtgtggtggactcttcaagggtgctctatggatgttcaccctcctccttccctgtagcctggcctgagacagggcctggatgatgcttctctttgcttcctcagatggcagggcttagctgggaaaagaggctaaaggtgcctgattcatcaggcttcaaaaggctggatctcaggggcctggaactaaggggacttgctgttgtccctcgaccaccagagccacctgtctcctctggatgtctccgtcgagccagctcggagccctgggagcaaggatgccatcgtgcaggagggaggtgtcaccccattgatcgatctgcctgtgaggctcctgccaggataattgattcagtttttgtgggaacagagcaggcgggaaaagaggctcagaatcagcttggctgcattctgcatctgctgccagcacggcctggaccaatagtctttgcttcagaagccctcctgctagctatgggatggttggcctcgggcaggatggccagtgccggccagagccccttctgcctgtcagttgtgatgtcaatgatgaaaaggaggacatgactcttgcccctttcaggggcctgcaggcttcagaggtgccctcccactccctgggatgccagcccctccccatcaattcccaccagcctcacagccccttggtgcccagcaggaggagggagagacaagctgcccagcagggcaagattctggccccagccacggccgcctgagacagcccacgaagtgttagctcatttaatttaattaaaactcaacaagatggaggcagctgtagcgcagttaattaaaacagccataatcaaggcagcaaacggccggcagtgtttgtggccgctgcccagcgcagcacagcggccagcacggttcggctcctctgcattttctcatagttcctccaggcaggctccccaagcagccagacgctcctccctgctggcctgggcccctccacagaaccacatggacttgtctggcagcagctctgggaaggctcgctcacacattggttcatctagtatttatatagtgcttggggtgcccggccctgggccaccccttccttgcctatcactccactggatgccactcaggccccatcctccttgtcctctcggcagcagctaacattcctccctccttcccaaccacactcccatttttccctagcctttcagggctctgtctcttgcgacttccctcttcctagtgccccttccctgcagcagcatcttcccttccaccaagccctgcctttgccctatggacacagccttgccctggacgagctcaccccctcctaaagctccaactgccatctcctcacctgcaactctagctttagtctttccagcccaaacctcttacctgagctctagatccaaaattcgacctgccttctggtcaccctgaccagtggtgatcagtgatgagtgatgaccttcttttcagacagctgtaccctctttccataagtggcaccctccaacctggaacatgggtctcaagttggtttgagagctctcaaatgtaccaccctcgtggctctcaaattggcccccttctcccctcctgctgcgtcagtcctatcccaggcaccagacactgctttccctgcctccgggccctcccgagaatccatcatcctgtaggtcaggtttgctgctcataccttcctgtgcctcagtggtgtctccttgcctacctggtcaagtgacgctcccaagcaaggcttagagggcccttcttggtcttcccctgcccgtgtctcatcgggtcctggctacaccacttaccagctctctggcattggttaactttttcgtgtgtcagttttctcatgtttgaaaaggagttacagtaagcagtgagtgagtcaatggcagtcaaaccttgagttgatggcctggcctctggtaagggcttcatggagctctttctactttctgtgcccttgaccctcctaacactgagctgtgctgacccgtccttggtccttgcccacctccggccctctgctcaccttccggctgctccacttgaaaacctccaccctgctcagcctctggctgctgcctcaggcctcaccttgctttacattgtcaccatctggctccagttctgctcagctaggccttgcagggagggcctgggtctgatcacacttggtgaggtcagctgtaggacaggtcttctctgagcccttgtcaagtgaatgatttcatgaacttgacctttggcacttgtccctgtaggctaatatctgctctaatgttcactcctccttctgctttccaggtccaaggaagacttccttatttgtcttcctgccacctggaagttgtgacctcagggtcgtgggcccagggtccagctcctgggatggagccagatggcacctaaggggcctcaaccatcccacctctgcagtaataactgggctctctcccctccctgcctgacctggcctgggaccgttggcctcagttgttgctggccttatcccattaccatttagaagggtgctaaggctattccgtgcacatttttcagggacagcccttcatggagtggactcaggcccctgagcactcagctgtttaccgggacctttacggtttacgcatcaccgacagtttacaacagagctttccccgcttttgttgcagctgattctcttgcagccctgtgaagtaggacaggctgtgattaccatgcccccttcacagctgagttaagggagtcacttggggtcacacatcgagactcggcctaggagctcccctgtgagatcacctcaggacctagtatcacaatagcaaacctggggacctgaggagcagctggacccttctggggcttcagagctgcacattcccagcttctccagaccccaggcccccactgaccagtacccagaagtcctccaccatctgcaacctgagccacagcacatctaaccagggcatgaccccccaagtaggagctggacaggaggtagctgacggcatgcgctgcccagatgtgagctctgctcagcaggccttttcttctctgtagtgatgtgacatgctgccaaaaccacctcctggagaattggaacttgagaccggggtaggcccaggaggaacaggaacaagcttatagagtggaaatggagttgtgagcaggggctcagagcccctgctgggtcctgagaggagctgttggcctgcaggctgtgccgagcctggacagggcttgaggagattcccgcactcctgctgtggcctgaacatatgagctgccatcctttgtcgtagaggacagcctaactcactaagtccatgtgctcatccagagagcagtctcttccccacccccagcaccctgaggcgaaacctgggggtcttaagaagagatgcagcatctggctgcaggaggaggcccgtgggtgggacgcagagggcttgcagcccctcaccctgctggctggccccagctctggctggaagagcctgtccccaccccactctgctctgccatctgcggggcctgccaggaaggcacactgccagtgcatgctcacaatttccctttggcccagagctccctggcacctcttggacacgaatacacccctaaggatgctgacttctgggccccttcagtcccccacacccatcttgtgaaatggaaaagtcagattctctgtttggtggggaaattactgttagattctttcagaataggttaggttctggaagagctgaggccaggagcgagggatgccagccctggaccatatccactgctcccacccccaccaagtcctggcgtggatgacaggagatcagcaatgtcaactttttggtctcaggacctctacttgtaaatatcagagaacctcaaagagggtttgcttgtgtgggttcttttttttttttttttttttttttttttttttttttgagacagagtttcgctcttggtacctaggctggagtgcaatggcgcgatctcggctcatcgcaacctctgcctcccaggttcaagcaattctcctgcctcatactcctgagtagctgggattacaagcatgagtcaccacgcctgggtaattttgtatttttagtagagacagggtttcaccatgttggtcagactggtcttgaactccgaacctcgggtgatccgcccgcctcagcctcccaaagtgctgggattacaggggtgagccaccgtgcccagccattgtgtgggttatttctattgatgtttaccatattagatattaagactgagattattttaaaatatttattaatgcattttaaaataataaaaacctattatatattagcataaataacatttttaaggaaaaatagttatttttttaaaacaaaaatatttaccaagagggacaacattggtttacccttattacaaatctctttaatttgggacttatatagaaggcagctggattttctagctacttttgcattagggcaattgtgatagcacatgtcatgtagcctctgaaaaactctacgttcatgagagaaagtgtataaagcaaataatttcttagtattatgaaaacagttttgaccttgcagacctccttatggacctcctgaaagggtctcttggagagagagaatcattgtgcggattcttcccacataaccctcactcccaggtcccagcctttgccctctcccctgcctctgcatctgcaggactggcagcctcatcctgtgggcaggctatgagttagatggaccttgtcaagtccttccacttcactcacaagctggtgtgaccttgggctttgagtaattccctgaatgtctcttggcctctgttttctcatttgaacttagagatgaagaattcctctaggtgctgttgtcaagttccatgaaacggattggtgttgatttttctgcacacttcccaatccccagacgtgggcaggaagcaggcagcagggcagggtagacgtgggctggacctgggcccatctgtgggctcctcactcctctggggaaggcagtggttgcacagggggcttgagcctcagagaaggtacctgttggggatgaaacccgctcaaatctcctaataggcctggatatggagggtgaacgcctggccctctgggttaccaaccctcagggttatgaggtgctagacaggaaaagggtgggccctgatctctgcctctcgccagccaggccaaattggggaagttcagtagtcccccagtttttagcagggttgagtgggctttctagggactctgtctctgggctgtgagtttgctgagtcctgctgcccgttcctctcggctgggctgcgtgttgtgggaggcccagtgtgctagtagcccatggcaagccctccctttagcctgtgtcctgtctgccttaacaccaggctttgttttggtaagtgctttgttttggaatcttacccaccggtgggatttgggtggccctgtggggtggggttactacctcttttcttcaccttccccctccattggccccagccagtggggtctgcaggagtcctgactcacctccctgattctcgtcacccccagccccactgagccccctcctcctccccagagcagagccagtgacctgggacacagcttcactgacactcagtctggctctgcctgcttgctcacacactgtccgtgtcggcctaactcaggcctcaatttctccatgtatttaaggccctttcttgtgttttattttacctgatttggctttgtgtggctttccttccttttatactaatgcttctctctgatcttatttgcattcaaattacctcgccaggtggttcaccaatcagaggtaagaatgctgtccgtgcctctcgccacaccacgccttgccactgccgtcacctccactccatcccgtccagtctgtcacctccccatccccatcccaacctcttcagcctcctcatctccagctccagcacccccaacaccaccggccaccacacacatccactctcagtcattccctcctgtggactcatccattgcaagtctgaattgtgaagatactcgccgggccccgcctaggacagcaagccctgctgcccaggccttccaggccatccccacagaagggaccccatcagctcctactgtgaaacttagcctgtcccccggcttccctagacagaagagcttcccttgaggttgaggagtgtgaccaagccttgccttttctcttgacagtctcttttggggggacctcaattattacttgactttccctttagtatcccggctctgtaccgtggtagaatgaggatcatcccttcagcctggcaaggattaggaggaatgttcacttaagagttctgtgtaggtgctaggatgacaacagggaggtaaacaggctcgtgcgtaactccatcacctgacctgtcagctcggagtccccgctaggctgcctccacgcagcagggccctgcagcctaagagttaaaagcacagattctggactcaggaagatccaggttcaaatctgacttaccacctatgtgatcttcagaaactcagttcatctctcagaagtgtatttcctctttaaattgggtcacggccacctgccgcacagggtcatgagaattagaggagaggaggatgtgtagtgtctggcgcagagcagacacctgtaaaatggtggcttgtctattcacatcattttctctccagttctctcagtgtctgggcacatctagaccttcagagctcaggaccaggatggtctcaggcaagagcagctgccttcctgggtgctatcttgcccatcacccggaggctggctcttgcttcacctgggagccccccaatccccctgcccatctactcagcctgtggtgactctttgttgtccctgctcctgggtcctggtgttggttccagatttggggatttctgtatgcaaataggcacccagtctctgttaggccccctgaccactcttaggctcttgttgcagaggaacctcctattttctgggtcagaaatttcacccaggaaccactttctgccccaagcctgtggcaccagccaccaggtctccctcaccccacccacacccccctgcctcactcaggtgaccttagggcagcctcgacccctcagcggcctgaacccgacctgcttgaaggaacattttctgtactagtgtccatccatcccatcagcatgacctgttgggtgcccatcagggctgctcttaaaggagatggtatttggcatgtgcactgggccctggtgctccctggcatctggtggggagggctgaggccagcaccaaagaggcaggctggtcctgtgtcctgcattggtggcctcccctcttccttcacctccagctgccagccccctgggggttcccagtccctcctgctgccctgggttagatggtggaagagggacatcaggtagtgaggtggctataggtcagacccagggtggtacccctttgggccccaaccgtgagagcatgacttggaactcttcctctggctcctgtccagtccaggcagggggggcccggcagcttctgtccatgtcctgtgtgggtgtgattgtccatcagcctgggccctgggaaggtgggggctgtcaggttaggctggctgttctgtgcaggaggtggttttgtcagactgtgtcctgtgggggttcttaactgttggaccgtcctgtgtgggtgtaattgtctgttggattgttccagggaggggtgtgctgcctgtgcccgggggtgtgtctgtcacagacagcttgcccagtgtgctttcacaagcagttttttcaagtgtttattggtggggccaggggacggccaagtccagtggatccacccccaccttgccgctctgccttggcctcccccgccaggacctgtcagaactggcctcaagcccaagattcctccaccctttctgagggtccttttgctacccaccccgatcctggctcctgtctgtccgtctgcggccagagcagcccctcagggcactggcccgagtgagagctccaacctccattagcctcttgaattatgcaggagccgtggtgggtcgaagcactttagcaggaccgggctgaggagtggagctggaatgggtggggctggcggggagggggtggagtaggaggggaagatggtgctgggagcagaggctgctgggcaccaggcccccagggcaaacccattccttcctggtgggcggcaaattctcaagctccagcctgatgagggcatggcgtgcttgtgaatcccaggcccgccagtctgcaggctgctcccacacctggctctgactggcttagtggggctgcggggccaggaacactaacagggatgttgattgggaaataggctccagtactggcaagagtgtggcagaaactgaatggagctgggggttggggtacagtccctggcagagcaaaggtgggtcttgctggactgtggggagcatgagattgtgctccaaagcacaaccgttggttctagacaggaggccactgggctcttcagggagagcttcctggaagcagcaggggtgccagggtgtggcctggatgagcttcgacatctggtcaacatcagccacagatgctgtcgagacctctcaccgtgttccaggccacactcgacatgggccgtgcctgacctctcgcttcgtgtacccacaggtgccttgcagatagagagcagtgaggaatccgaccaaggcaagtacgagtgtgtggcgaccaactcggcaggcacacgttactcagcccctgcgaacctgtatgtgcgaggtaaggactcaggcagtgcctggcccctgtcaccacagagctgtgctgcacctgccgggctctctgcccagagcccttggtgcagacacgcaagggactgccatgggcccagtctcttctccttcctgcttctttctgcagcagcagcaacagctcccactgggcaagttcctggcgtctgccactacttcgccttccttccttgcaggcccatggggaagcagccactcttgggagcatttgtatcttttgtaggtcttgccgcatgggcccggagccccatgggaatttggagccatccaatccgacttcttggtgtatgtgcatgtgtgtgtgcacacacgggcacacttatctgtgtgtaaatgcatgcatacctggcctggctttccttcagtacatcctcctgcctgccgcagcatggtgggctccagaaccaccatggctctgggctttggggtagtaaggcctcaggaacggaccaggccaggtgagcctatcctctggccaggtcttcctggagccttcctggaggaacccttgtgttcagctgtgagcccctgtggttatgttgcctcgggtgagcacctggtgtgttccagatgttctttgctgggagcgagtggacagtgtgctttctggaagtccaagttcccagcagagaggaacctggggactgttttggggtttccaatctctgctatgctcacagcctaggggtgactaaagctggccaccttgccctttcctgagaacacactgggtctggtatacatgtgcccagaaggggccctgagagccccttctaccctcatactgtcccctcacctagccttcttgtacagatggatgtcattaaaagttaaactgttgaccgggtgtggtggctcacgcctgtaatcccagcactttgggaggctgaggcaggcagatcacgaggtcaggagatcgagaccatcctggccaacatggtgaaaccccgtctctactaaaactacaaaaattagctgggcgtggtggcgcgtgcctgtaatcccagctactcaggaggctgaggtaggaaaatcgcttgaaccagaggttgcagtgagccaaggtcgcgccactgcactccagcttggtgaaagagcaagactccatctcaaaaaaaaaaaaaaagtacaactgtctccacccaggggattgtaaaggaaagcggacatggctccttgcagtgatgattccatcacgccaagtgcttagcgcggcttcctgaggggtgtcgtctgactctccacccagtgcacgtggtgggtgatggcggtggcctgtccgactctttggggccatgtggtcagacttgcttactcagagcagagagaattaggctgtcaaggctgtcaaccaaaatacacttatcaaggagttgctgtctgtcatgggagagggtggttctggagaggccacaggctgccagcccattcggtgaccagttgagctgcagaggaactatttgtggtgggcaaattgtgcttcagagactattaaagatgcttcatgagagttgggggcatgggatgggaggtcccctagcttactgtcaggtgtcttactcctcaaggctcaggcctcaggtcagcttgtctgtcttcaggaacaagagcctgaaaacttcccaaatggcctagaggagtggagttgtaagcggcacagccttggccccaccctgccccaggcagagtgtctggcaggcattggggctggcgagtccactccaacagaggagcagctggaatgacccttctcaaagatctgcctcctcccaccctgactatcgcaaatgctgtgctctctagagctctgctcacaagactgtagggtcgagagtggcagttccaggcctcagcaagaaagcctttgcatgtggctgcaccagggagaggagaggcccagtagagccactgtaaacccaagccagctgcaagggcgtggcctatgggcacatttcccagggcacagctacaggaggcagtgctgaggcagaagaaggcccagaggtggatggacccccgcattgtcctcttgactaggcagcattctctgaagtcactgttacactggccccagccctggaggcagagcagtgggtctctttggagatcgactgagctcagctgctgtagctggcagctcagtcactgcccagggagctcttatgtgcagccccttggagcatccctgtctgtggggctccctgtttacacatggtagactcaggcagggccctgactggctcttgccatggcccaacccctaactctaccagctcttcttgaatctacccttctggctccatccccacatgccttttggtaggaaatacgggggttcctttagttccagccccacttgccagggactccaaaacagccaaacctgacttctgttgtctctctcacacacacatacgacgttcctctaggccctgatgtctcaggaccgtttctaagctctgtccccaggacctgcctcatgtagaccctaattgaatctacaccaccctgctttgccaagagcaacctgccccataggccctactgtcctactgacaggacttaggcacacctgaaaggccctgctccctgggtgccttgcctctggtgcccccactgctcgtcatctcatggttggcaaaacccctgccttctgccctcagcagtactaggggcccttcagccccagcgcctggggacagcctgtactgggctgaccaccagctctgcatcctgagccctgcttgtgggtggatggccgtggaggagtccccagtgccagcctgctttctggcctgcaccccgtcccatctcccagcagagaggcttcgaggtttcctcccacagcaggctcctgagcctcagacggcttgatgtgggctctagccctgaacttctcagccgcagcactgttgacattttgggctggacgattcttagttgtgaggggccatcctgtgcattggagggtgtttagcagcatctctagctcactagatgccagtggcacccctcagtcaaaacaaacgttgcaacgtgtcacctgggggaaattactgatggcttcccactgccattgtctccacccatctgactctcttcacctgtgtccactggccgcaaggcttcgtctcctcatcagacttggcttcggtgtctacctcacatctcccttctgtcccccaaattctcagggctcccagtgtcgctctctgaggccacgcgactgctacatttaatgggacagtacacgtgaagcaccaggcacattgccaggcacacaggaagcacttgctagtcagtagcctctgcagctagcactcggctactagtcagtagcctctcggatagcactgtggggggatgtgtcatccagttacatctgactttgttcacagttgcctgcagctccacccacagtctagcaggcccaggcatgctgggtgggccagagcctttctccttcaccacctgactctccctgagtgactcattctctccttccatctacagctctctgggtgtacagctgctggggccagggtggagccctgccctcctcagagcctggcctacctgtgccaggactaccagccttccccctttctctagggacctggctgcgggccacagctgtctaaaacagggacagtgcctttttccccacaggtgcccagacatgctccttacaccggtggtgtgtgtgggggtggcttctagtggctcctgtaccttggcaggtttgtgggctgggtgggccttgaccccagagcccggtccacagggtctgtctgagctgtggggtgcgtgtgaggcatgggggcctgcctgtgccccattttcacctgccccggccccaccctcggcctccctggcgcctgctggcgggcctcagccctgtccaccatgtcctccatgagtcctgagtcttttgtgagtgatgtggttcgtgtgcacctgtgtgcatgtgtgtgtgcgagggggcacaggagtctcgtctcgtctccgtgctgtgtgggcagatgaaggttggcctgtttttactctctctgtgtttctccttgtcttttttttattccctcctcatcttcatcgcactctgccatcaacccaaactctcatctctcagatcagcgagaaggttggtccttttcacttcttatccatctacagttcgcccatcgatgggacacgcctgtcagtagggcccagcgggctcggtcagctccctcaggctcactgcgccgtgcctgcctgccagtctctgttgtttgggccggcgggcaggcaggaccagggatgggtgggcagacccctgacctgcatgttcctgctgcttgggtccctggtgcaccacgtgtctgcatgtccccttagcctggttcccctgcaagggtggtggggtgggcatgctgcatggcatgaaactgtaccccacctttgcacccaggccgggccagctgtctgatccaggcggtgctcaggaatggttgtggggggctgtggtcagagagaggtgtaagacctgtagcgctttgtgtgcacctgtgggacctttcaccgccctcctcgcctagagacccaggctcagccgaaactactggaacattaaggcgagaggctagagcaggctgtcctcccagtatcctgcagcacagggcaaaagtcctgcagtgtgtaccctgtccttgaggccctcaggtcccccaccagggcttaatggggcagtcagccctggtctgcctcagggagcttggtgtccatggcgcagggtgagtagcgtcatcttggcaccctgaggaagtctcccataaggttgtcttttccttctccagccagatccaaattaagatcctcctacctgccccaggcccctctgcccaagcttcccagctagctcccgtgtctgtttgagggtggaatttagcccaccagccagctaactgacattccttagcttgatgctttgcattcagactcaagttgcttctacctggagtaactgaacggtcagctgcaacttagcaggatccatatgggagcctggaagtggcccctgactcagccacaggttaggaagggtttcctggagactgtccttgagcccattccagagcaggtctgtttggggcttggttttccgccccacccttggagccagacccccaccactgatgctggggttggcagcaggggctagtggtcattcatgtatcacatggtctgtgtggtcagaggagactcacctgtccattgggttttgggggttcaggatagcagtgtaggacaggctgagcctcagggagcaaacccaggccatcctcgttccctctgccacatcctccgtggcttgagtttcctctgtgagggtgagggagccggtcgagaggagggctatagcctaggctcagatatcagccctgagcatccatccatatgcacagctgagcactggggcatttctgttacaccattttgctgaccgggcagatctgcgagggcgtccagaaaacagtcatcagcagagacagcccagcccagagtggctccttccatgccccttcctctaccctcctggtccctcgtcccctcccttcccccaccccaccctatggtcccaccaaaaataagcacatggacaaatatttagcgggaaggcagacatgagtttctaaatattccagggggatttgccgggctggtaatttgtttggtgctgataattgcatcttacatttttccagctttacttaaaactgtgtgccgggtttgccggcatttaattactgctctgcggcagccacaaggttatttattaaagagttattttatcttgatacagtggatcctgcccctcatcccctccttaatgttgtgttattttcatcagagaaatttctctgagtgaatgcagattgcggggctgcctccccctgcgattaggctgtcactctactgaatgctgatgcctctgggcgccgcaccgccctattatagggggttgtcagcgcaaataattagacttaaaagttacagctgaaatataatccagaaatggcagggccctgttttggaaattgtctataaaatgtcagcactaaggatgcacagggaacggtaatatactggcattgttggagcctaagattagaccctgagtgcatttttcccagctccagtttttctttccctgctgttgcttctgtcaatagactgtccagggtgaggcctgttcctttttggaggccctgtgcctgcagcagtgggtggaggatggttggggctgctgcagtgagatgccagccactccagctgttggcatgggggtggctgtctgggcaggtctaggatgcgggtccctgttggcacttggaatacaaggaggttgtcccttgcctgtttcccccacccttcctctgtagacataccctgacctccctcacatggaaaatgtctcagtctcagtaacgtttctgcgtggctgaagcccagtgtccttgtgagagtgaaggtggtgtgcccaggagcctctggacctgaggcccttgcttggtgttgcaggtgaccctaaaggccactgttgacctctcacacttatgcctagcccctagagctctccctgccccctgcatctaggagggaaaaaataaacacaactcttctgtgaagcgcctcaatttcctgacagccgcaggagttggaggctttagaagacgtggctcagggcgttggcctgacctccagggctgatccatgaagtccgccttttggcctgaagaccctgtcctccagggacaatttgggggtaaagtccagtcaagtttctaggttggtgcccaaggtttattggccaaggacctacttccttctgctggggctctttgtcctggtatccaacgacgtgattaggccccatgattccaccaccgactggggtcaagcctgcaatcatgacctctccctggcacaggctgtctaaacccatccttacgcccgctggagcagcgtcctctcctgccagcctctgctaattctgatgcttctccccagagccttctgggtcttttttcaggcctgtcagctagggctcgaaagggtgacagtttttcatcacacagacctactcctactacgtatataaacttggtcatgtggcttggttttaaaacagttcccttgactgtaattggcaggtgatagcatctacagcatggaaacctgcacctagtaggtgcttaagcatagcttcccttcccatgaagaggaggagacagggcacccactggccgagaggacaggagagatttagttcattaaggctgctcctctgtgctgcccccaccccgcttctgtggcaggcctggacctgatctgcaaacagacttgcctgcctgtgcctgtccctgaggcccatctccagagcagagggagggcatgcaccgctgggctgggtggtggtcctggctgagcctcctgctctcaccttggaccatttgaggtgcgtgctcagagagtcctttgttgccatgagacacttgccagccatgccccgggatccacctgttctgccacaagaactgtgtctgtgacatgctgtcatcattggtagagactcctggcactagaacagatgacagaaacccacttataccagcgtaagcaaaacaaggaagtcctgtgttacaaatctgaaaagtgtagtagatttggtgctgggcagggctagatccaggtacttaaacaggttggccagtcatttgtctgtctgtttctgagctctcctctcctctgtcgacatctttgttctcaagcagcttttcctgtgtgttgggagaagccatccccagctgctctaagcttagctacctcagtagagagagaaggtcgcttttctaatagtttctgcggaagtccaaaggctgtttctccatagtcagatctgggtcacacaccccatgtatgaagaatgcaggtagaagtggtttccttaaagacaatgggaatgctcattgatttgaggagaaagcagaaccctgaatgtctacaagatactctcatgccctaggtgaacctggggacacagatccagcccaccagcacctgtcaggcctggtctctggggctgccagggtttgggttctgtctggagcaccagagtaaggcaggctgtggaaggagttgaagcaagtgctaaattaggtagggtctcttgggctgggcagaggagtcactgggagccatgcaggagcttgttaaacagggagtggcatcagatttgtgccagctgtttgtggagggcccgtgagcaggaattggggcagtggacaacaaggcaggaggactgacgcagaacacattgcagcaactcagggaaggatgatgatggcttggactttggtggtggcagttgcctgtgtgtatggagagaaatacatggatttggaagatatgttatgccacgctgttgacaggacctggtgacttgctgaatgtctgatctctgggtctaagttttgacccctgtatggtgaggtcagacgttggaccgggaggtctctgaagttgcttctagctctagttctgtgatttggggctgtgtgagcagcatagtctggtgcttatagtggagatgctccttatgtggtgctgtggggtctttgcatgcctgggccccccagcgagggtcctcagagaccagtgctctcagcagtgctcttgggtactgactagcctgctgcctgccgcctttggccctgcgtgtgagagtgcccgtgtaggacacaccctggcctctgctcaccagctgcatggcccatctgcatgccagacatgcctgcccacggctgggtttcatcacctcccttccctctgcatgctcctgtgtctgtgtcaagcttccaacttcgggggcgggtggttctaggctgtaccctggactgagaagctcagaacagcttctggtcaggggagtccaaggctggaggtcgtggccaggcacagccacagccacccctccccttgagacccttgtttgttggcgcaggaagccgtctgttcggcgccctcatcatgttactgccatcgtcatgcccatcctgcccgcagaccatgtccctggcctgccctgacccctgcccctccccagtcctcctgagggcagcccttttgcttgggttcccaggttgtgccctgagcatggctgagaccctggcaggcggccctgctgcttgccttatttcttcccctcaggccatggcctggaggtggaggcagtgactccacggcaggtggctgtgtccctctggactggccttctgctctgcccagccatgctctgaggaccctccaccctagggcctgctttctctccttggtgctccagccaggagcaggcagagataggccctggagaacaccctgggttgtggtcctgaccaggcctggaccttgtactgagtccctgtgtgaccctgggcagacaggaccttcctgacaggcctcagtttcctaggctataaaatgggagcttggttgcaagatctctcattgagtaagtcatcgtgctccagacagtccctgagtgtgggggccacttctaggctggaagtgggtggggtgggagtggatgatgagctggggtctggcggtgccacccctcctgtctctgagcatgggtttggctctgaccagaggggcttcctgaatgaggggcccctgcccttccatgcagtcgtgtgtcctgcccggcctgtgagtgcctctctccctcctcctgcagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaaggtgagtgtggcaggtgctgtaaccagtgccctccctgtcatctgggaggtcctggtggtgggcgaatgtgagctggctgccatgggcacaggcatggctgagggattcttgccctttcctgggtgtccctgccctggggtcctccagcccttagagggagggagggatttctgttattagccggcttaatgataatagttaaggcatattgagtttcttggtgggagacatcatgctagcaagcacagttgattttgtttttttctgttttaccctgggagataggtgctcttattatttccatttttgaaacgagggaaccgaggcacagagagggtgtatcacttgccccagggtcacataaaaataaatgacagagcagggacttaaacccagtgtggtctgaatccatatctcaccctcaccactacatagtaccagaccttcaggtttaatagcctcccagcaagaagggtgtggtaaaatagtaggggaaagtgtgttctctctgccctgatacctggggacaggcacacatgtattacacatatgtcacatatatgtaaccgattctggccaggcacggtggctcattcctgtaagcctagcgctttgggaggccaagttggaaggattgcttgagctcaggagtttgagaccagcccagttaacgtagtgagacccccatctctacgaaaaaaaaaaaaaaaaaaaaactgggcatggtggcacacacctgtggcccagctacttgggagggctgagacaggaggatcacttgagcccaggagggtgaggctacagtgacgcagtgagccatgatcacaccactgcactccagcctgagtgacagagcgagaccctatgaaaaaaaaaaaaaccagattccttcctggtctccccgctgcaattctcaacagcctctgatccattatctgttttgcagcttgagtgatctttaaaaaatgtaattcaggatcaagtgactcccttttaggaaagggagaaacaccttccagtggcttcccgttgttttaggatacagatcaggatcctcactgtggtctcccagggccactggcttcccaccctgtcacgcgccagctgtccagacacatgctgctttccgtttgccgtgctccttgcctggccccttctgtcactggctccatgtacccttccaggcctcagcttggtgatgctttccttccctcatcaccgcatccaaggagattccctggatcttactccacctcagcaccctgattcctgctgtccttgcacatggcagaatcatgagtacgatcgacttgtttattgattctctcttgtactgaggtgtaaactccatgagagcagggatgtgactgtgtggcattgtagccccagcacaatgtctggcattgagtgggtgcttgttaattatttgttgaatgactgtggactcaggacctttccacttcaatttgagccaagctgcagggtctgtggggccagcagccccatcactctttctatccgggccagtccctaaggaaatatctccccttcccctgcctattacacatactttccaccaggtgggctcaggtgacctgcagaggcacatagctgctacccagtctgggtgtctttcatctacatgggactgcaagggtcacatcacctccaggtctgtttgttagatgagtctggtgtgctgatgggagggtccagtgaatcccacagttgatatgtgtacatactaaatgacccaaggccctgggtggggcactgacaggcctggccactgtccctcacttgtgccttcagaggtcaccataagcttttccagccatttttcaaggtaggctgtgggtatcagccacactcaggtgaccccaccagatatcctggataatccccaagtctagggttggttcctaaggatcttgacctcgggcagctttgagccttccactttgtctccagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggaggtaggtgggggcatgccggctgggcagccaacagcagagaaggggaggctgaggttgtggcggtgcctttccccctccctcggctgtgaggctgggggctcttgggaggatcaaggtgccgtattccatagatgtgtggtcagttgggatgtaggataagggtgtgaggttaggacctgacttcctcggctccctcctccctgggcacccctgacctcacgcagatgaggctgacctgcctggtgtggggtgttgcagtgcctgcccagcccgcggacttccaggccgaggtggagtcggacaccaggatccagctctcgtggctgctgccccctcaggagcggatcatcatgtatgaactggtgtactgggcggcagaggacgaagaccaacaggtgtgcagcgggcagagaagcactgagggggtctcctggtccctgagggtctgtgatgggcttaacccaggagggtattttctggattctgtggcttatgtgggcacagcctctaaggtttctgctggaggcttagtggtgcatgcgtgtcatgtggcccgcacagcctgtatgaatctggagtcattgtcaccctgtgctaggggcaaagtccccagggtctgccttgggtttcctaggctctgtggctcatatgactggcagagccctgaagtttccccagaagccatgcgtcccagatggctcctgtggtccatgtggtctgtgaggtgtctgtggcatgggctaagccctgagttccttttgtgctccatgtggccttatggtgtggagccagtcctggagccgtggtgggtccagaggtgtcacattgcagcccatgttggggaacaacctgtgagtgactttgagctcagagctgtcagtgagtgctccctgctcttcccagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccagtaagtgtctcccaagtccgctgcctgttacacctgggctgggacacacacacacacatgcacacacatccttccccctcgaccaggcaggtggggtggtcaggtctgctggccaaaccgaactctggcctgggctctgagtctgggcctcgggagagggccaggtaagtgcctcccagtctgtccagtccaggcggctgctgccctccctgctccctgcccagcctcctgcccctcctcccgcccatgccccacacactgcccaggtaagttctgtgtctgtgcctcatctccgcccccactctgtgctggtcacactagcttagctgatgggccatcctcggtgggtctgccatgtcccagacctgctttggcggctgtttctcctccctatggccccgcatctcgtctccccatcacccacattcccttcctcatactccccatgaaagttacctgagagccatgtgatcaccctgagctgactgcactcggggacaggtctgagaatgcggccatgtgacccagcctgcccacgtgtgccttgaattgtgaccacgtggccgtgcaggggactgtctgcaaggctgtctgtgtgagactctggtgttgtgtgtgagagactccgatgctgcagctgtgggagtggcactgcccatgagtgtgagtgtgtgaccacacctgaccagctggctgtgcagcacctgtgtatgtgcatcagtggatcttgggcatgacccttgtctttgtgggcgactctggcctgatcctgtaaccgtatttgtgggtctcggtagccccccagacagtagactgtgtgtgtgtgtgactctgtggttgctgctgggcgtcctgtgtgtggtcacacagccacagtcagctgctgcgtgagactctgtgtgatagggtgtcatggatgtgactggctgggtagcattgtgggattgagatggtgaccacatctgatgtggccatgtgatgaccagaaacatggcggtgtctgaagtggtccttatgaagtgggttatggtcacaaggtaagccaccgtgcctggctcttccatcctactttacacaaatgtcattaaaagctcatttggaggccaggcacggtggctcacacctgtaatcccagcactttggggaggccaaggtgggcggatcacctgaggtcaggagttagagaccagcctggccaacatggtgaaactttgtctttactaaaaatacaaaaattagccaggcgtggtggtggttgcctgcaatcccacatactcgggaggctgaggcaggagaatcacttgaccccagcaggcagaggttgcagtgagccgagatggtgccattgtactgcagcctgggtgacgagcaaaactccgtcttgaaaaataaataaaataaaaaagctcatttgggtaattacaggtgcaatgtctgtctgccctgctggaatgcaggatccccatgggcagacaccatgtgtctggtcatgctgccagccctgtaccgtgcatggggcctggcccccagctgcagcacagcaggtgcttctggaatgaatccatgaatacaaggtcacacacagcctcttgacatcactggtacatgcacatgtaccctgctcctgttcatttaccagttggctcccacccttccttcaggccttgggaaagtgtcacctccccaaggcctgaaggaagggtgggagccaactggtaaatgaacaggagcagggagcacacaggcctccgggagagtctgcaggcctgaaggccttccagctgcaaggcacatggttatggtcacaaggtaagcagcaggccagtgtggctgcagtagctgccggatctatggcagtcagggccttggggacacagggtaggcaggagagctgactctggctgctctgtgagaatggacagggcagcctgtgaggaagcagagaccggttaggaggctttgtagcggtccagggaaaagatggtggcgcaggtgaggtgatggcggtggatctgagaactgtcagggatgctgactggtcagacttggtaatgggttatgaataggggcccagggggagggaagtggaggtgaatcttgtttctggtgtattaacctgggaggagagtggtgctggcgtagaatgggaaatggggcagaggcaggtgtgaaaactacagctggtctcagacacccaagttcaagatgccgtgtgccatctacatggcagtgctcggcaggctgtgggaatccagggctgggctggagctaaaggaccctgagaagaaagactgcagatgagaggaaatcaggggaggggagcgacttggaggttggaaggagagaaagtttcaagaactagacgagatgctgctgagcggtcaggagtacctgttggaccgagcaacatggacgagtggccctggagatgaagcttggtgcatggtaggaccaaagctggtggatgtttcatgaggcctgtgtgggtgctgagaatgtggaggcagcaagcctagacgttgccagaaagtgtagctctgaacaaggggaccactatggctagagagggccgtggagctgagggtgggattttgttttgttttgttttgttttgtttttgtttttttgagacaaagtgttgctctgtctcccaggctggagtgcagtggcatgatcttggctcactgcaacctccgtccacctcctgggttcaggtgattctcctgcctcagcctcccgagtagctgggtttataggcgtgcccgccaccacacccagctaattttttttttgtaattttagtagagacagtgtttcaccgtgttagccagggtggtctggatctcctgacctcgtgatccgcccgcctcgacctcccaaggtgctgggattacaggcgtgagccaccgcgcccggcctgggatttttcttttaagatgggaaaatttcaagcatatttaaatgctattggaaacagtcaataggaaaaaaagaaaccgtggaaaagagggtaactggtggagccttgggaggtggagagaaggggaacagtatgggtggtgagagagcttagccttggacagggtggctcaactctccattctcatgggtggaaaggagagaattgctgcagatgcaagtacggtgggggggttgtagcaagagatggagggagctgctgtgaaagcctggtcttctctgcagtgtgggagacatggtcatgcgccaagaggaggcaggcaaagggagctggaggtctggggagcatggaggagggggactgtttcatgtgaggtggcagagcgagccaggcagggggcagaaacaggcagcatggagagtcctggaggatgaggcctctagggacgtgtgcataggacgccagcctgcctcagtgccgctgtagagaaggagggggagagctggattcatctagggcttggcagcggccaggaaggagcatggaaagatcaggaggcgagggaccttgcgatattggtgagagtgtggtaggtggtagaccgtggaagctgaacatggagggtgggaaggacaaggttgatggacaggcatcctgaggagctggcgagcaggctcagtgcccggggcctggagtgactgagcaagaacaagggggtggggtctgcaaggggatgtgagagcccgtgattctggagggagggccatccccagtactggcagcctccagggcatgaccacagctgtgcaggggaggagaaagtcctggagatgaggggctctggggccagtgggtcaaggggctgctgaagtccccatggcagggggtggtgacagaacttgaagaggaaacctgtgcattgcagcagagtcctcggtgggcgtggagtctggacacatcactggacacaaggagacacgtgtctgcctcctaattcccaaagaagctgttgagtgagggcacctctgttggtgggtactttttctccacgccaggggctgttggccttcatgttcggcctcctgttggtgattacctgtggcactggcaaagagactgtttccaggcaggcacaggtgaaggctgccttatgccaaaagggccactggggccactcttcctcggaagagcagaaccgtgggcacagcagatgtgaagcagttctccatatgtggctgtgtgtgcgggtggcagtgggatggccacgtgcttgtgtgtatgtgatatcgtgtatgttttgtgtgagacagcatatgtgtgggagagacctcgtgtgagagatgctgtgtcagaactctaagacattgtgtgtgagagtgtgtgtcagatgccatgtgtgagacaccaagacacgggtatgtgatactctgtgtatatgtgagtctgtgtgagagacactgatactccaagacattgtgtgtgtgtgacactgtgagacaccaagacagtatatgtgcgagacagcctatgtatgtgacagtgtgtgtgtgagacaccatgagagactgtgtatttactgtgagagactgtgtgagagacacgtgtgagacactgtgtatatgacactatgtatacgtgagactgtgagacactatgtgtatgtgacactgtatatgtgtgagaccgtatgagacagtgtatatgacactgtatatgtgtgagactgtgtgtgtgaaacactatatgacactgtatatgtgtgacactgtatatgacactatatgtggagactatgtgtgagacactatgtatatgtgacactatgtatgtgtgtgacactgtgagagacactgtgagacaccaagacagtatatgtatgagacaccctgtgtgtgtgacacagcgtgtgactgtgtgagacgtgtgtgaggcactgagactgacactgtgtgtgaggctgtgtgagagtcagtgtgtgtgataactgtgtgtgtatcaccgtgtgtgtgtgtgagagagggaaggagagagagggaggcaggtcagagggagtcaggtgtccttggcgagagtggcagcagcctgcctggagggaccctgggatggccatttcagcacctaaggggtagcctgcccgggtgagtctccagtccactgtgactcagtcattgtgcctgtgatccccaccctccatctgcttgcttcccccccatttgtcttccccagccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacggtaggcagtgccaccggggcgggaggggaggcgttctgcctcagacaccacccaccaagctccccagggccttcctttcctgaacacaggcccaggtcaactcatctttctggttcaggtgtaatggcctaaagtggggggatgtcacttacgggataactgaggcccaaatcccagcctttggggctgtctccaaagcagctgaaaccttcacaggctaagatgggagaagcagccctgtctaagatttgaaaggtcaagattgggcagattggtgtaaaagatactcaaagtagaatcagcaagactccacgttggctggacattggcatgattggggcctaggaggagtcaggacaggttgtgctgactaggggtggtcaaagacctggtgccccacctccacctgttcccccatgtcgaccctccccaccaagtgagaggcctgggccagaggggtgggcagggccagtcctgggctcttacccgtggcgggcagagggagccttccgtgtgcctcaccagggacagatgatctaaggaaactgtatcagggcctttcctgggggagtggggtgctgaggcaggaccctcaagtttgctgtgcccacctgagctagggttgatacctccaggcctgacttccttctctacctgaccccccagtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggtgcagcattgggtggtggtggggtggcagggtgagcacagaccagcatgcacaagctcccttttggggcccagatatgtccctcttcccctgcctgccctcagcagtgctgtgactgcctttccttggttgtgagacccgagatgctttgcagcatcaggggttaggctggggttttttgggtgtgggttttttgtttgtttgtttgttttgagatagagcttcactcttgtcgcctaggctggagtgcctcctgggttcaagcaattctccttcctcagcctcccgagtagctgggattacaggcgtctgccactgcgcctagccaattttcgtatttttagtagagacagggtttcaccatattggccaggctggtctcgaactcctgacctcaggtgatccgcctgcctcagtctcccagagtgctgagaatacaggtgttagccactgtgccccaccaggtcggggttttgagatgtgcctttcccctagacagtgctgggctggcatccactcttcccacagaaagggtagagagagtgctccagggctgtcttaccccactggcggccatgggtccgtggttgctgcaaagctctgtgagtagccaagtagagtgttgccctgctcctggccctgcagggaacgattcagcccctgatgttcaccctcaagagctaggcctgctggccagcctcacacctccctctgtgcacatctgtcttcctgggaggatggtcctgcccttgagcttggggtgaggtccctggggtattctgaacactggttgctattcagatgaagaacttggaatgctggggggttatgagagtggtatggaattattcagcaagtaggtggctgctgcgcttggatgagaagccatgtctgtggacccctaggaaagggccacagttgctgtcatgagccccctcccaaaagaccctgctggagagtcacaacacctggtgtggtgctctcaaggtctccctatccaggagcagggcctccccattgagcctctcacctctgcctgggtggagagcaggggtgcgtgtaccactcaatgctgtacacactgtgcagaggggtggggtcacccacacagacaggagccttattcctccagctgggctcagccatctgaagcaaaattctttctgcccagagggtgctctcttccccctctcagcctgcccagtgctaaggcatccggggtggaggaggcaggcatgtgcacccacctgcattcctggggcaggttgagggctccttgtggagcctcagtgaacacacctacccagaaacatcccaggaatgggttcccctagcccctcctctctgagggggccagtggccacagctgtggccagtggggttccagagaagccacttcaagtgcccccttctggtcccaagaggttcggaagggagctgggccagaggctcagggacgctgcccatttagtctcagacatcccatcatgggggcggtaactcgagtctgggctcccggaggacactgaagatggaggcctgctccgtagccctctcaggactgggtcattctgttcctcgccagtgggagagcagtggggcctggtcccgagcgtggccacagggcccagctgtccctgtgcttctgtcaagggcggcacattctgtccttcacgcaacagcaccatcccctcagctcatcccccatcatgcctgaaggaactatgtggtgcaggttcccacccccagcctggaagtgtggagccagacctgtctccttttacgtcagattccatctccctgcctccctttttcccctctcgtggcctgcatttctctctccttcttggagtctctgtttttgtcttgctctttctcttctctctcctccttccttccctcctccccctgccattcctctgacccctttccttcatctccatttggtttcatcctccgtccttcccttctttcttgctctgcctctagcgcaggacagggtccatgtgatgtgagaacctccacgccaaggcttggttgggacagcccaggtctccccgcaggcaaggagactggaagggacgtgggcccagccacaccctataaagtggccatgcactaaggacctgtccagagtctcctctcatattctgttccatgcttcttgcaaggactttccaacagagtgtcccaggacaggaggaacttaggccacccagcatggaggccagtggacagaggccagaccggcactgtgggggtgcttgggctggaggaccccaggtacttccggcttggagacatcctggaccatctccctgtgatgtttcatggggcctcagaatggagacctcacagtccctccacctgtccatctagaatatctacatgcaccaaaggcccgcaacactgccagccccgaaacattccttcctaccttaatcctcagacaccccgaggaaggaacgggtataggtgatttcccgtgcctgtgggctacagcccaggctctgagcttggcactcacagccttcatagtcttgctgactggcttgcccttgggcccaccctggccatgtgccctgttcacccccaactcttactgttgtgggacacttctcatgcctggggtgattgtgtaatgtatgatcacatctgggatgctttggcgggtggaaggagacactgaatagtcaattccatggcaacaagcacaggccaggactgtccgaggcaaaccagggcatatgggcaccccattcacccctcagtgtcttcctttcccttggcctgagctgttgaacccacccttcttgtctggcagcctctccctcccagcaagcccaaaattgtcagagcatctgtagctgctttgtgttcttagggccttctgtcagcgggtcctctccctgcaggctgcctgccctccctgtctccctaccctcctcagccctggcacacccagttggtgctcagtgaggcagggattcaaatctttgaaccgggagttgttctggggtgctacccccatgggtactttgaggcccaaaagccctccctctgtcctccctgggcaaggtcccttccaggccaggccctctccaggtcagagtccttcaccatcctgtctccctttctctccctctcccgcggtcagtggcggccagaggagtccgaggactatgtaagtaacaggtgtgcgaacgcggacaagacatgggtcaagctgggctcgtgggacgctcctcctctccctcctttcctgctagcctgcactgccaagatccacagggctctagccacatcaggagaaaattggcgtttagacacaagcactgagctgagcagcgattggcatttcctctaatccttacttcttgcctgtcgagcagcaatttgaggccagtgttcatgatcgaccagggcctggcccctgccccggccagacagggatggagttaaatccaatcctgatcgttaggccttattgatccctggagtgaaaaatcacctgctttagggcccaggctgggagggctgtctggagagtcggattctggcattggtgcattctggagccccagccctgggagaccctccagctgtggcaggaggggtccatgagggggtggtggcagctgcaggggccccactcaaggccagagctggagggataccagggttgatgacggctctgttcccactgcacggtggtccctgccctgcttcccactcttctctctgtgtggtgtggcttgacctcccatggtgtttctccgcatgtccagagatgatgcctttgctgcagatgggtatatgggcagggtctgccaagcggggaggacattgccctggctgctgtctcaggcatcactgagaacagatgtggaagccagttccccaggtgtggaggttttcttattctcctagcccctcccctgcctttctcaagaggtattgcagggtatagacattcacagagttagtggcctatatgggggcagcggagtcctgactgggtcctataggatggcaccttagcccatcctgccaccttgctctgtctgtgcatgcatgcactggtgtccacaggcagccttacgcctgcttatgcaggagctgtaggctgtgtgcgtgtggctgccaagagccacgcaaggtgctgggtgcgtgcgaggctgtgccctgttgatatcctcagtctccgttcacagcacagtggagtgagggaaacagtctggccctttgttcttgtctgaaaagaataatgagctgtctgccccaggcgtgcggctcctgggatgggcggggtcctcccaggcctgcatcctacctgcctgcttcctctccagcagaggccaccattgtatagccccaccttccacaacccctggccttgtgtgccccggggctcccctcaggctagggtcctgaggtccctgacaaggtctggcctctccctgcattcttgtgatgggaacgaacccctcctcctccctcaggaaaccactatcagcggcctgaccccggagaccacctactccgttactgttgctgcctataccaccaagggggatggtgcccgcagcaagcccaaaattgtcactacaacaggtgcaggtgagtgaggggtcaggacggacctgagggtggggcagcaggagggcagcgccagagcccagcccgtggtccttcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaaggtgtgtgctgtggacatggcatcccttcccgagtgtggctgcatctgggggtctctgctctccttgagccactgacctctggcgactgtgatccaccagcctctggtgtgtgacctccaatctctcatgactgtgaccactaacctctagtgaatgggcaccacattcttgatgcctgacctctgctgtccttaacctactgacctctgctgtatgaccttctgatctcttgtgaccttgacccactgatctcttttgactgtgtcactattcttgggtgtgcaacctcctgatctttggtgtgtgacactaatctcttggggccatgacccaccgacctctagtgaacatgctccaccacgctctggtgtgtggccacatgcttctcatgaccgaaacccactgaccctctgatcactctggcctggtgtccatcggctcaagcttttacactcgcgtttctggagattctgaccctggttgctgtggcatcccccgccctgtttggtgctcactgtggaagagcttgggctgggagttcaactgtgccgtttgaagctggctgggagtggggcgcttggtactctgcagccatccttcaaccccctgttccccaaccagtgtctcatcctggccattcaccttccacccttccagcccattcaccccacctcatatacccagcagagctgactctctctatgcctttgcagtgtttgccaagaacttccgggtggcggctgcaatgaagacgtctgtgctgctcagctgggaggttcccgactcctataagtcagctgtgccctttaaggtgagtaagggccacggccagctgagcctggcacacacacaggcctgctgggtgctgtctttccagtcctaacccatgtgcatccggctgtggagcaggaatgtggttgtgtatccgtgcactgtgccttgcagcccgtggtagggaacctcacccaaaggcattgattgcccctcccgtcccccacagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtgtgcacacgaggtatcgggggaggcggggcagggctggaggtaaccagcagtgacagtcctgattcctgccctgcccacccaggtggttctacattgttgtggtgcccattgaccgtgtgggcgggagcatgctgacgccaaggtggagcacacccgaggaactggagctggacgaggtacctggggaggggatggggacactgacagccccattgcagtggtcagctgtggccttcctgccctgagcactgtcccagtgactctcagattcactccccaaattgaaatctctcttctggctggcagcccgcccctctctggagagagggactctgaggaaaccatctgggagtattcacagaactcccggagggcttacgaagaatccctggggtgggatgtcgtggagatgcctctgcaggtctagagaatgccaagccctgtagacactgcagagcctcgcagatctagaagctatggagggcttagtgagccttatagccaggagtccctgaatgtttgaaatccttcagtcctttctcatagccagtgtggcaacagcctggttagggtggggcagcttacacacagggctgcttctcatgggctggtggggaggagtggcttcacggtgtctgttactctgtaggggcagtgggttgggcaggtgtgggctctgacacggaaggtgagccttgatctcggcccagggagctgacatcccaggccacagcctcagggctggccggcatgctccaaggcccctcatgacccccatgctctgctctgccagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccaggtctgcctgagccggcttggctgtcagcaccctgattccctgggcctggcctgagacgatgccagtctcaaacaccacaagaccccaggtctttatcagtttgggggcttcgagatcctggggcagcactaaagacccaagatctgtcccggggatcctaagacgcggccctgggacccagaggccagacctaatgtggctccagggacccagtcctgccaggtccaccttgtagggtctgggagaccaggcccagggtaacccagacccagagccctttctccaggattaataggcagagggtggggggttctcacgctgagctcacagcctgctgttctccaccgggccacagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggtgagcactgccctcagagctccgggaacggccacctgcccctcgcctttcaggccctctccgggtgtggtgcctgtggagagcgtgcagccttgcatcctggaccctgagcctcaggctcagcaggaaggcaggaagggcaggagcagtgtgtgtgcctacctgtgtctgcaggcctgcatctgtcaggtgagggagcctctgcagcagcctgggcgtgaggaactaaagcctcagagggttgtctcatgtgcatccctggcacgtctgtctgtctctgtgtttctgtggataagagtgcgtctgtctcctcttcagttttaagacaccgccatctcctgagctcctacctcgagtcctttccttctgccaccattcctggatgattccccagccctactctcctgcttaggcctagagaggtcgagctggaggcccacaggccatggatgctcactaacagacatgactgatggcctgctgtgcccgtgccatccgcagcggcctcagcctcagtgtgtctttcccactcagttctctatcggcagtggccaccacctgccctaggagtctcccttcctatccgtgcaccttccagcctgaaagggatttccaaagatttaactttgtcactctcagtttaaaaccttttgatggctgcccacgtaaagcccaccctctttagcctgacagccaaacacctggctaatctgacccctgccacactcctgacattgcgacactgaactcattcagtgttcaggcccacacagggtgtgccctctgcggatctccctccccctgcccacttggcaacagcaatctcatcgttcaggactcaagtccatgctctggtgcctgcaaggccttgcctggcccctaccccttccttgcacagctgtcccctgtgatgctccactgcaaacgcagctgggcctgtgtgccaagccttcagcccccagcactgggctgagcccacaggcatgtcagtgagcacctggcagatgaagatatgctagtctgtgtgtctgagcacatctctgcaccatgcaggagagcctgtatcctgtgtgcctaccctggacccactgttccttcctaaagagtccactccttcctcccagggtggatggacctgtgggcgggtccctaaggagtgtcccacagatgcactcatccttcccacttccacctgcattctgggtctgtccagagaggtagaccccctccctgtgaatgtcatgtgggtgccatataaggggcctgcagggtccccatgtcattagagggctgagtgcttggtggaaactgtgaccgttcctttcttctgtccttgcttgtctttcgggacctagtaaacaagaaaggtaggagttgttccttctctcttcacacacctccccctctacttctaatccttgggccagcagggagggatgacgctttgaccagaagtcccctggcctatggctttaagcagcaaactgtccagtcagctcagcaggctccctggttcaggactgagtcctcattggtgtgaggaggcagtttctgtctcactcttgccagttcaactctgcagaggatgcttcttctctggggcacatacataatacagactgcattgctttccctgagcgtacagagctcaccagaaccatcacccggctcccagttctctgagaagttgcctaagtgctgcgagagacagtctcgcacagagcaaagagcagtcactgtgtggaacagcagagaggcatgtccttgtacccacctgagcacactcactcaaattcttctttccgaagcacatgcgtctgcagaccacaagtagcctctggctatttgttggcagctgaatcctatggtctgtctctgaccctgtccttgtagatgggaaaactgaggccagtgagagaggactctgcccagctagggtgacgcctttcccgtccctcccctgctgccctgggcatttaccctgatactctgagggccaaaaagctggggccctgtctcctgtgctgtttgtgtattttatgtgtcatttgcatgtttgttcccggtggttcctgctactcagctgggtggccttggagatagcagtcactgtcctgcagtgacctgccttctatccaaaggagctgctcgcccctgcaaccccttcctccctgctgcactgcccctctgctcacgccacactcctgctctccctaccccctccctgccctgtgttctctcatgtcaaggctgttctggccctggctcctccgcgctcagagatcctgggaagaggtggggcagtaggaggacagagccgtggacatgggggctccttggcagccagccatgccatgtgtcactgtctcagcctggacctcaggttctcaccagcctcccttctgtctctctaggaaaaggacccactctccgtcctctaaggatgagcagtcgatcggactgaaggactccttgctggcccactcctctgaccctgtggagatgcggaggctcaactaccagaccccaggtagggcactcctatggcctgtgtgcccccagcccagacctagcaggcctgtgggtctgttctgcaggtctcagggtcgccactgaagttcctgggccgcatgcacttgttcctgctccttttcttcctttctgcccttctccctgtgctcatccactttggttggaatgactggggagcccccatatcctgcagctggacaggtgccccaggccaggaccctcttaggtggcaaagccacttagccactgccttgtcttcagtcaaggcctctgaatatgggctgaggacctcccagagcccacgtctctgccacagggtggccagtgtctggcgcacgctctgacgcctccacatgaaagaggggcatgttagcagtgggagatgcctcaccagacatctgtggggagatgaagtgcctgcacctgagccttcctggaggccgaccccaggtttaccataccacgtacctgccccttctcctagccactctcatggggctgtccacctcttccttctacctgaaatgttactcctcccaacacccagcagacacagctcagacctctcctcttgcccacacccccacagggttaggtgtctcttcttggctccaggaacctccctccttcttccttttgacgcctctcacagtgagctgggattacctcagtgacagtctctgagctctgtggtgccaggaactgtgtcttgtcatcccccatcccttgtattcagcgcacgatgggttcttgttgaatgcctgtgaaatgaacacacagacaaatgaaggaatgagtgaactaatgcatacacacagggtttgtgtatgtatgagctggttattctgcatgtcaaattaccccaaaacttagtggcttaaaacaacaataattatgtattatctgtcacagtttttgtgaggcaggaattcagacaggggcacagcaggaacagcttgtctttattccagaaagtctgggccctcagccggaagacttgaaggctgggagctagagtcatttaaagcaggggttggcagactatggcccgtggccaagtacagcccaccacctgtttttgtaaataaatttttactggctgggcgtggtggctcatgcctgtgatcccagcactttgggaggctgagccgggtggatcacctgaggtcaggagttcgagaccagctaatgaaatcccatctctactaaaagtacaaaaattagccaggtgtgtggcccctgtcatcccagctactcaggaggctgaggcaggagaatcacttgaacccaggaggtagaggttgcgtgagccaagatcgtaccatcgcattccagcctgggtgacaagagcaaaaccccatctcaaaaataaacaaataaataaaattctactggaacagacacacccatttatttatatgctacctacctatggttgcttttgcactgtaaaggcaccattaaatagatgcagtagataccagatgtccacaaagcctaaactatttacgctctggcctgttatggataccaagtttgccaacccctggactctaaagcctctttcatccatgtgactggtggttgatgagccagctctgagccttgctgtggctgtcagctgggacacccaacatgaggcttcttcaggtggcctgggcttcctcacaacatggtgactgagtttcatgagcatgtgtctggagagtgtgccaggcagacctagcaggctgttgcaacccagcatgattagatctctgaagaatcaagcaccaggatgctgggacctggagtgcagagaagcctcttcggggatgggatgctgagccatgtggttattggtctggaaaagaaggatgggagagagctcctcagtggaagcatgtgcagaagcttgggcagattgcatgtgcgtcaaattatgagcacctgagggtttctgcagcatgagagttaggggcttggggaatactgagccaagagaagactggagggctaggcagaggtccagtcaaaaggaccttgaatgtcaggctaaggggcttagacttcctcttcaggatgccagggaggtaggtattaaaggttttcagcgggggagccaggtggtcagaaccatgctttagaaatgtcactctggctccttgaggagactggattagagaggagaaattgaggcagggagaccatttaaaaggccagcaaccaagtgaaaggtggcagtgggaacagaggggacagacttgggaaacgtgaaggaggtgaggacagcagagtccgggcttaagcccacttggggagaggtaagggtggctctgcagttgctggctgaatgagcagggggtaggggtgtcctggggctggtgggtctgtgggtctgaggacttctgagctgacatcagggctgaagccctgtgggaggggccaaggagcatgtggtagtcaaagcctgagaatagatgggctctcccagggtgagggccagaaggagaccgggaccaaaaagcccagggcagggaaggtggtgcagcattaaggaaagatggatggagagcagctagggagattgagaaggagcagccacagccagacgagagcaggagcgcagtgtccctgatgccagggttgggggagttgtgcaagggacgagaggacttaatgaggtagggcagtggggacacccagtgggaggaccgttggctttggcagatggggccttgaagagagggtggtggccacgtcctgtgggcagaagtgttgcagtgagcagcgtggcaagtgggggctgagaaagtggagaaacccctttcaaagatcctgggaagatacctgggaaggaggcaatgagcagggcacagtgggagagtagagggtgtgggatctgagaaggagggctcttttttccaacgtggaaatcatctgaaaatcgccaagggcaaattttggtatcaaaaggggcagggctggtttggacttaagtatttagtcatagagccccccaaggctgccgagccaccagggtttagaagtgctcgcctctgggggtgggacacccagtctgtattaactgggagacagaaggagccttgacggaacttgtccgcagccccagcccctcaccgccccctcctcttctccgccagcccctcgcaagcccgctcggcacctccactgtgtgtgatggtgctgtaagcagaaaaagttaacgggctttcttttcttgccccgttgtttttttcgtttgtttgtttgtttttttctctgcaggttccagtgtccccagttgcccgaatacctcaagttagttttcaaagttcccgtgtttgggggatactttggcttctgtgtctgtttccactccttacttttgtttaccccatcgcctccatccttccttgaattcttctctccccttccctttcttctcccccaatcccactgtctcctaacctttttccttccctaccctcccctctgcccaccttgcttcctccaggcctgttttctctcccaccggccccgtctctgttctgcctctctggcctccagtcccggcctgacacccttccttctgcgtgcctctacctctcatctcctctcctctgtctcacacccccctcctggtctctgcttctctctctattgtgtctgtacttcatgaccactccatctacacacttggtgcccgggatgacgatggctgtgagtctcccatggtgactgccaccggtgaggggcaggagggctgtctgcaggcagatgcgatggagcccagctcctgtcacgtctgctgccaccgacctgggcgtcccacccctcctgggaggaaggaagcctctcttccatcttgagagacctgccaggcagggcctagtgcccccactcagcaccccgccaccaaaacaggctccacatgctcatggcacaacaccgccctctgtcctctcccaccctccgccatccctgtcgccgcatgtgctgctgtctccatgccaccagttccaagtgctccatggtcacacatgttcacatgtgcacatacatgcgttggggctttctctgccacactgctcaagcctcacactaatgctgcctgtgtatgccctacctcccctaggtatgcgagaccacccacccatccccatcaccgacctggcggacaacatcgagcgcctcaaagccaacgatggcctcaagttctcccaggagtatgaggtgagatgttcccgccccctaccatgtgcctggcccaggcctacccaaaccagctcctgtcctgtcctaggtcccagctgtggtgggtgaggaagcaggggtccagctttttcaggagcacagagaggagggttggcagtggtaagggtcagctgggaaccgggtgcctcagatgctgggtctggccatagcctggcccagcaccttcttggggtcacccttaggagatggtttcaaaaggctgtgagtgacaccagggtctggacactcagacacgtgctcaagtgctcacaggcagacacaaggccacaggcatacagacatagatcagtgataacagccacagtagctggcatctatcaagagcatcctgcaggccagcaccggtctgggcacttggcatgcattatctcttttggttcccccacagtcttcagaaatggggactgttattatcccatcttccaggtgaggaagcgggggctcagagaggggaagtgacttgcccaagtcaaacagctgatgagtagtggagccaggattcaaacccaggcctgcctgctgccctgtgctctgcacatgcatgtgctcacgtgtgtactccgatgccacagctcacggggagtcggggcctcgagactggctgctcaggctgtacaagtcccgcttggagccctccacacgttcatcttgttctggacttaactcctaggagcctgctgggggctgagccttcaagagtctgagggtttcccacccacagatggtgtcggggtgactctgagcatccccaggctgcccatctaggaaggggatttgttagagaaggaggtgatttaaagacaagactcctggccaggcgcagtcgctcacgcctgtaatcccagcactttgggaggccgaggcgggtggatcacctgaggtcgagagtttgagaccagcctggccaccgtggcgaaactgcatctctactataaatacaaaaattagccagctgtggtggcacatgcctgtagtcccagctatttgtgagggctgaggcaggagaatcgtttgaacccgggaggcggaggttgcgttgagccaaggtcatgccattgcgctccagcctgggtgacagagtgagactccctctcaaaaaatataaaataaaaaaaactcttaaaaaagagtatttttacttaaaaaagagagagagagacctcctcctcttccacctcctccaagcagcagcctgtgcttgtcgttctgccttgtccacagctgtttcctcagcacctggcactggcctcagtagatggttggtggacaggcaattgaggggttggctgagcctaacctgtgagtttgcgccccttctgatgtccaccctcagctgtgtttgggggatgcatcctagggctcaaagattgcctttcccaagggctgtgggccaggtttctgaagagaaagctgggcttggcaggcaaatggatgagtatgtctgcggcacagcaaccgtgctgcctctgcctatagggcccccctggggccctgctccacacaaggctgggctttgggtcacggagcccgtaaggtgggctccctgcctcccatggcctccacccacactcatctgtaccatgtcctacacctgcccttccttccagcgcagccctgcttccccatctgggctcgtggggcctctgttcacagtagtccccttccatcttctacctgcttccctcctctgatcagagctttccttacaagaccctcctcctccaggaagccttctcaggctccccaaggctgccgtgggctctccctcagccaggaccccatagctctgttgtcttttttttttttttttttttttttttttttcttttttggaagtctcgctccgtcatccaggctggagtgcagtggcgtgatctcggctcagtgcaagctctgcctcctgggttcacgccattctcctgcctcagcctcccgagtagctgggactacaggtgcccgctaccacacccggctaattttttttatttttagtagagatggggtttcaccgtgttagccaggatggtctcgatctcctgacctcgtgatccgcccaccttggcctcccaagtgctgggattacaggcgtgagccactgcaccaggcctgctctgttgtctttaacgttcagtcagtcattgatcacacattttccatgtgccagtccccgtgctggggatgtggagacacatgccctcagggaacccagtcgtggggagcatgtgcagacagataatcagcattgaatatgtgactctgacagcatgccctggtgttgaatagtaccgacaggcgtgcaaaaggtgggctgacagcaccagagcagcctgaggtgtggggtgtgctgcggggtctcacggaagcagtgacgcggtcctgtggagagtaatgaggctggggacaacatatggaggacattgcgtgctatgctgagaacttcagatagtatccatctggaaaatgtgaagataataatggaacctatctcgtatgagaatttgaggagggaatacatgcaaagtgctcacagcggtgccaggcacactgtgggtcctcactaacgcttcgctattatcattattgctctccgaggtgaagaagagccacagaaggcctttaagcaggaaattgatattcacatctgcattttggaaggattattctggctgtggggctgagtgggtcagagtgggacaagaggaaagaggcaggaagaggctgagcctcaattggggtggcctggcccagggcagtggcagcaggttggagagagctgagggggtgggggagcaccagaacctggtgactggcagggcggggttggtggaggccggaggaattttgagcttgacttctaggttctggcctggcactgaggggtgagggtgcctttcgctaaggtgtagtcccagcagcagcgccaggtttggaggggaagctgatgaactcagctttgaaaggactgcggttgaaggacctcccggtggaggtgtcagagaggctgctgggtactcggggaagagctctgtgctgctgctgaggttatgggcagctccagcatgtggtgtaagaatcaggtgagcaaatgaggtcacccaggaaaggttgtagagagagaagagggcctagaaggaaccctggaggagctctgcgtcctgcccacgggaagggcaggggagagagaggaaacagagaaggagcagctgaaaggaagagagccgagcagggagggatcctggactacctgagaggggccaccatcccttccatctgtcctggctcatttcattaggtgaatgcagggcttcgggagggactctgggtgttcagagccctcagcagtttcgggactgcctgagagggggccaccacctgtcctagctcatttcattaggtgagtgcagggcttcgagagacccttcacctgccccatcccagctcagaccactctaccaggcaaggggatttggtaccatggtcagaggagtccccagtccatcacttttctgataggtgatgtggcaacctgtgagctccatggctggcaccacgagatagagggcctggctgtggcctgtggagtgaaggcaggatgtgagcatcaccgggaaggctgggtcccctgcaggagaagcaggtcaaccttggctcttaccccaccccacccgctttctccattctctgcagtccatcgaccctggacagcagttcacgtgggagaattcaaacctggaggtgaacaagcccaagaaccgctatgcgaatgtcatcgcctacgaccactctcgagtcatccttacctctatcgatggtgagccaagggggtgcccctcccatccccttgctctcccccttgctagctagggcaacatgtcattctacagaggatgtccacgagtctcaggggtgcactgaggcatggtgggctgggctggggaccctgtagtaatgccctcccacctcctttcttatccataggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtgaggctgcagggccctgccaggaggcgggtgggaaatgcccagccacaaggtgatacagggcaccttcttctgtgccgctttcttctgtggaggaagtcgctcaagtgatccccagatgctattgttactgggggtattatgctccccaaatactgggtgtttctgggatacagcatgttccccacatgctagtgggttccttaagatgttaatatgtttcaccaaatgctgtcattttcggagaatgttaatgtgttccccagttgctggcgtgttcccggggtattcatgtgttccccagatgctggagtgttcctggggcattaacacatctcctaagttaattagtggaaagagctgctgttatctgtttttggactgcaaagcattgactggaacgtaaaatttacagagcttgaaaatggcacataaacgttatgggtaaatttggcagaaaatgtgcctggtgcgatctggcgttgaataaataattttcaattatgacccttattccactagctagggcagggcggtgacatagcttgaggacctgatgtggcttgtggaggacagggggcaatggatctgagagctcagggctggggggctttgtagccagaaaggctacagccagggagttgaccagcctccaccctgcttctgcccgtctgagcctgtgggcttccttcagcctgccctgctcatcctcctgcaggtaaaatgtgatcagtactggccagcccgtggcaccgagacctgtggccttattcaggtgaccctgttggacacagtggagctggccacatacactgtgcgcaccttcgcactccacaaggtatagcctttccccagtgcatatctcttacccagacactgtaaggacagtggcctgggtgtggtgtgctgggtcggggggaagctggagcctgggtgttggagggtcggaggctcaggtgtgtgagtgatgtgatgatccatgttatgggaacagtgctaggagcttcaggctactctgtgtggcttctgagtcccatggggaagtggcgggtatggcctcagcatcaggtcattcagtcctgagtctatggcaggtaggctcctagtcgccagtatgtccccactttgtcccccagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcaggtgagagggtacagtgccacccagaggggtgggtggggtgggaggtgggggcgcctgtgcctcaagctgagcccgtgtcctgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaaggtggggctcgggtgggcctgcttggctccagggcctagactgggtcatgcagatgacccccacccccacaggaagcctggcctgaccaatccctgcctctcaatagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttataggtcagcatgcatgtcactgccccaccatgccctacaggggcctaggcctgtgcctggctggtgggggtgggcagcagagtagggccagcctagaagaccagagagggctgggtagagcagtgaggacttcctggaggaggggtgatctgagcagggccccaaggggctaggcagcctaaggggagactctaggggcagcagcacctccagcatgtccagtcttatgtccaccccagacagcagaaggcctacatagctacacaggggcctctggcagagagcaccgaggacttctggcgcatgctatgggagcacaattccaccatcatcgtcatgctgaccaagcttcgggagatgggcagggtgagcccaccctttcccccagggcccctgtcatacctgggagaacaccagccacccttgggggagctgccgcctatgttactgtctcctttgacaccccagctgcttgtcagcatggcctcaggcgcccgttattactacctgaggcatctgtcccagaatcctgtgaagcctggcacccctcccctattccttctcacctgattatgggggcccgaccctctgtccacaggagaaatgccaccagtactggccagcagagcgctctgctcgctaccagtactttgttgttgacccgatggctgagtacaacatgccccagtatatcctgcgtgagttcaaggtcacggatgcccgggtgagtgagtgcattgagtgtgtccataacgctgcctgtccacacgctgggtggatggctgcctgcatggtaccttagctcaagcttcagaaatctgaggcggtgggtgggtattagggtgtgagcacatctccccctgtggcctcgggtgcagtgacacagatgcatgcctgtatcatggtactaccctggtctagtccagaggggtggctgcctaaggcacgaattctaatcatgtaccccacccacctttcccaggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcaggtgggactggccccctggagggctggggtgggtgggcctgaaggcctggcagacccactgcatgaggcaagcaggactcctgacccaactgtgtttctgagcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggtaacgcagaccaggctgcagggccagggccttggcagcagcgctgctgggaaccctaggctttagcaacagtttgatgcccacaggcatgtgcattcattcatgctgccaacctttcacgtggcctgcgataggcatggtggtgtgtgcttatggtcctacctacttgggaggttgatgtgggagaatcacttgaggtcagaagttcgaggctgcagtgagctatgattataccacggcactccagcctgggtggcagagcaagaccctgttgctgaaaacaaaacaaaacaaaacaaaaatgctgcaacattgcctgtgctgcctgggggctcaggggattgatgagtaagatgtgttctttcattcggcagctctctgctgagccccagtggtgtgcctggctctgggcaaggttgcacagagcaatccttatggggtgcccagtcaggagcagagaaacatgattgggatggcagatggaaggcaggtagatgtgggggcctgagagaatgacaggagagagatgagccttcagaggctctttcaggctcccccgcacactgcctgatgtagctgccagggtccagcacctgctcttggccagcagaggctaactccatggctgcagtgtgagtgtcagctgtgtagtgggggtgtccactggcgcgacccacactgaccagccccctatcctggcaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttac

SEQ ID NO: 35620 - DNA, 92788 bp, Homo sapiens; identical to SEQ ID NO: 35619

SEQ ID NO: 35621 - DNA, 34656 bp, Homo sapiens
gcccactcccaccgccagctggaaccctggggactacgacgtccctcaaaccttgcttctaggagataaaaaggtaatgatcgtcatgtgcagtatgaggtcttcacgtgaaagctttatttgggtaggaaaacctagcctacgagaaacgggtccgtgcggtcacgcctgactgcctgtctccgggtcaaggctgccaggaccagctccagccctccgcccgagaaggctgtcctttcccctcggaactctggcttccctaaagcggccgcgcctccttccaggcctcacctcctgccggctccgcccggcccggcccacctcgcccccacctcggcgcccacccattgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcaggtaaagccgcggcggcgggagggaggccgggaggggccgcgcgccccggtcggcccagccggggaaggggagcggcgggcggggcggggggcagcgcaccacacacaaccctcccttgccgtgcgaccgcgccctgcccccgccccggggcccccgccccgcaagtcctgatcacaatgccggagccgccgagccacccttgtcatcctgcccggggacggccctggggcagttactaccgcgaagcacggagggtggggcgggccgggcctcggggaggggtggggggatgtgaaaggtcccggatgttgctgaacgggagccccttccagagggagtgactggggcaagcgcagacgggctgagcgaaagctaaggtgggggtagggagagaacgccttcccgccggctgagaggaagagtgggccggcagaggctgcaggggagagggagagagagggcgttggggacccaaagggaaggcgaggagtgggggatttgcgttggggaggaaaaggaaaaaagcagcctcctgccctaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacaggtgaggaacccggccgccgccgcgcctcgcttcctgtcccaggccagccttccgaacgcgtgggagccgtcctcgctccgtcccctcatccccactcgccccgcggtggcggcgccgggctgaggcggagtctcctcagcggacacgggcggcggctcctcttccgctgggctcgggagggcggctagcggccgcctccggctccttgcttccgcatcgacgccccggcgccgatcggtgctcgctcccccgtcctgcccccgggggtgggtagggcgcccacacgcgagatccctggggatctccctgtcgccggctcccgaaggtggacgaggcatggccggggcgccgccggccgcgatccatccccacccttgtctctgcgggcttccaccccctccctcgccgcccttctcgcttccgcccgagataatgactcggcggcggcggcggcgggcatcgcagtggcgcaggtgaggccgccccctcccctctccctcggccgccccctcctttccctccccctcgcgcagcctccgcgctgggcgctgcggcggcgggacccggccctcccccaccccgggaggcggtggcgcggcggggaggggccgggggcctcggggacccaagcgcgagggaaaggcctggccgagagcgggccggagcccaggcctggcgcggcggcgcccgccaggtagaccggggcgaggctgcgcgccggcgggaggggagtccactgcggggtgaggttttggggtggggctcgcctgggacctagagctgaatttcctgggctccgcggtgggaggaaggacttgaattttcctggtgggggtgggggatgggtctgactttttttgctccttgtgaacgggcgggggaggtgtggacgggggctgcaagtccaggtcggggtagagaacagggtggtgagcccgcagtcggctcccgtgcttgatggactagaactggagggtccctgcgctcggtttggggacgcatatcctgctttgggggcgggtgagcctgagcatagccgctggtggcccgctcggctgggtgtggctctcgtcccctcccccacctgcagctgtcggtcccttagagacgctgtacacggtcaccggcgctgatcggtggcggggaaggcgctgggtgggagagcggggtgtgtccgcggcggggctggtagtggttccgcttctgcgggctgctgtggcgtctctgccccggggtcgggcggcttcgctccccatctctcccccccccccacggcttgggcgggggcgcgggctgctcctccctctggctccggtcggggggaggaattaacactctgcagtaggttgggctccctgacacagatccgccatgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcaggtaagggttaaatgggtgcggtgagtcctgcccgcagtgtagaggcgaggccttggagcactcgttactgtgtgagaaaccttatccacttcctcttgtaccgaagtgattggggagagaatcctttgtactggcttaaatcattttttgttagaagcagaaataaccagagagcgtttctgagatcctaagggaaaaatcagtaatttagagacctgacgaaaataatgccgtcataaaggttaaatagtttacgtattgagccagtaccttgcatccaaagtggttaattatttgtttaaaatgtggcgacctgttctctcatttggttaaaaaaatattgtgggatttccctgggaaggtaaaagatgattaatattcgggagccagctgccaaggtggactcttctgttcaccttctaacttaaaagtgcacttcattcagggtgtgtattttcctctgaagtcatttattctgtggtgtcactgtgtggattagtatctttgtgctgttcggcaacttgcaaaagggtatctttccagaaaaatgtagctgaggtaaatcgaaaaggtccaggaaactaaaatgcgagggaaagagaattagatgggtagtcatggtaaaggacagcttgagtggtaacatccaattacattatgatggctagaagcaaaatgcagcacttctgcatttcaactggagcgatgacattggaaacacttataaattaagtacttccaatgtgatatattctagtactcacagtaagagttgaagtgtcatgacttgcggatatttttaaagcatgtggacatataacaagataaagagttgagacattagggtcagatattgatcctttgtggtggatttatactcaaaatatctgaaaacaaacagttggtcattcccccccaaattgttatgctattattggctggcagttgttgcagagatctagtaggtttggggtaggggtaacactaaagctaaaatgtaatcactcttgacaagagtattatgaaagtaaaaagacgtgagttacattaaactgatatgaattatgattctggaaatatgatagaaatccagatgttctctgtaaacaatgcttttactaaaggaagaaaagctgcttaattttggatcacttagtggtattggaaatgagttgagattttgatcaggtaagattaggggtagtttttgaggcagcttttggaagtaattttgacatgtgaaatttgggtcttctgaacaaattttaagttttgctacactgatgtgttaatggctgtaagtttacctctgatgctgagtatgctaaatttttttcccttttttgactatccttttgtgaggctgcattttaattcctcatgtgaacagtctttcacaggcagttaggtttcaggtttaaaaaactcatttaccacaggtataattttgagtctgtttattttgatgggaaaaattttaaatactccttttttcccccctgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactggtgagaatcaattcagtctggcttcattatactgtagggtccctatgagtatcagttacattactcttaactttttgtttggtttttcttttccttctaaacattgtgtgttccaaatttaaaagtcttcatggtgtcatgactaaaaagatgttaagacaattatagatacgtgtatgtaaaataattgcaacaatgattatgaaacagttcagttttgttaaaaataacagactttagtattgtattttatattaattgaaaatataaactaattgtgttactgttttacttatggttagaatatttgtagtagctctatagctggttatcttaaatgtacatctgtggataaaggaattttacatactttaggtaagagagatgtaataggatactcattgtagaaatagtactcttctcaggattagccgctataatgttaatgtaatgagtcaaccatgcagaaaactctggcgtcacaactatgaaacctcttcctgcattgaattcttgaaggtaaattttgaacactcacaaccatgatgaaaggttatgaacaactcaagcttgattttccagtttgaatcgagtattttaagtattcagtacttactgtgttgaagcactgcgcttaaaagaattaaactacattttggttaattttaatctgtcatataaagtagggctttttgatcaagaatagtttaaatttgaggataaaccagtagagaatccaaccaagctggcagtttttggaataatatttaaagtggttttactaaatggttacacttaaccagtatggaagggctctgatatacaaagaggggcagcatctcgatttttctggacagattactgaatctggaactcagtatggaaatccaggtttgttacttactatatgaaccttgtttatggaagaagtgctataatgagcaataggataatgtctgatgtggttgtgggtttggggtttttgttaaagttgtgatgatactatcatttctttacatttgtatttactaatggaatagcatcagttcctaaactgtaattttctcaaatgatacttacttgacactgtctttttaaagaatagtgattttttaaacatgcttatttgggttcacagccacaaactcaatgaggcatctgtcttggggcatttttttgttctttgcttattgaaacctttagaatgatagctactatttgtatctaagttgaaaaaaggaatatcttgcttttattggggccaagtgacaaatgtctgttttgtgattttgctaaggtaataagaatatttaaattttgttttttgtttttttttttttttgagacggagtcttgctctgttgcccaggctggagtgcagtggcgcgatctcggctcactgcaagctccgcctcccgggttcacgccattctcctgcctcagcctcccgaatagctgagactacaggcgcctgccactgcgcccggctaatttttttgtatttttagtagagacggggtttcaccatgttagccaggatggtctcgatctcctgacctcgtgatccgccctcctcagcctcccaaagtgctgggattacaggcttgagccaccgcgcccggccaaatatttaaattttgaaaatgtgattttttttttctataataaaaaatgtattgggtttttttgttttttttgttttttttttttgctcaccttactaactaatatctgtgtatgtgtaattcagttttgttcagtctggagtgtttttcccaattattacacctgatcgaaaagtttttattttggcttcaaagggtgtgttacacattaacatttcccttaagacaaaagtcaattttaggaataaaaaggaatgtaacatttaccttttactaacacgcttatttgcaataccaggtaggtatgtgcatgttttccatatacaaagtataaaagttcctgtcattgtgagtcttttccaaggaaaagacttgtagcaggtttgttttttgtgtatgtttgtttgtttgtttgttttgagactgagttttgctcttgtcacccaggctggagtgcaatggcaccatctcagctcactgcaacttccgcctcccgtgttcaagcaattcttctgccttgacctcccgagtagctgggattactgggcgtgcaccagcacgcccagctaatttttgtacttttagtaaagatggggtttcaccttgtcggccaggctggtgaccaggtcacgtctaactcttgacctcaggtgatccactcgccttggcctcccaaagtgctgggattacaggagtgagccaccacgtccagcccaacttgtagcagttttgactatgcttccctttagtttccttatgaagaaactttgtttgcatagaaccagtagatgaggataacaagataatctcttcatataaatagtttcttcttgttatgattattaaggaagttcactctggtccctacccacatcgttaccctccagaatagcactggcttcccaaaaagttttaatggtatttacactttgaaagtttggataaatgagagtttaatttctttactatacaaatggctttgaagagaattctaaacaagcttttgcttccagccttggtcttttcaggagtaagacttagtgatctttgcatactcaacgtgtaatagatgctcaaatatttgttaaacaagcagaaaggcttctttagagaaagagcatagaattaggtcagcagcactgcaaaatttccctagctttttctttttctgcttgggaaaatttgatatttaccgataataggcttctttttcctaccatctttttcaaataggtcacatcgactctggaaacatattgcataaaattccttctgccctttctgtgagatggaagaataaaatgtagcagaactgatatttctactagaaaaagttattgaatcattattaatgattagtaaaaatattttaaattatatttttaagatcttacatgataaaaaatcaattataattttttattactccagccttttctgggctttgatatatatattttttaatttgagaaaaataagcaggtgtccctttgcagaaataatagtattggcttgtggcattagtgataaccagattttttatattgagcacctattttataatagctatgaaaataaactttcttcctacaaaaagcagctaatctccaaagttctgagtttttctgaagagctctttagtaacccattctggttatatgtatttatctattgtttaaccatttaataagcaaagagcttggaccatgttgcatattacaagagtaaatagagcattatggcgggaagtggtcactggcatgctcttcacaatgtggactttgcattatgtaaaagaacttgggtttcttctcttccacgtgttaatttcaaactgcaatatgtgaactaatgcaatctgcctttcctgccagatgcttagacaaaagctctcttggtagttggggagggactcaacactagtacctctttaaacctgaaagatggcagccaaaaattgggtagtttttatcttgcacatgatgaaatgaataccaaggaaatacagtctaggaagcctctttcaaactcaaagaagtatgtcgaggtgaataatggagctcaagatactgagtcaaactagttttaccatttaatagatgcatggcctgaggaaatcactcagtccctctgagaaaactaagctcaattaaataggaataatactcatcccacagggttgtggggaatgagagtcaggtaaagcaccttgactaccttctgtgtcctgtttatcttagcttttcagttctatttaaaagtgtgagcctgcctataatagtgcaggggtctcttaacttacagtccatgaatggaatttcgaagattgaagaagcctttaaaattgtgtatttttgtggggcagaaggtccatgccaaccatcaaattttcaaaggtttcattttaaaatttaaaatccactgctgtaggcagagaatgactttatataggaggtctccgagaggaagcagtgtaaaattgtgtgtctaacatttataacagttggcaactgcagttgagtaatcttaatagtgattctgttaatttgactgagttctattttattgctgctctacgtttttatttgctcagggcaattttaagttgtggttatgggtcactgatttttatctccagcccacagaactaccattaaacagaaataagaaagcaagcggctttgggtccgttttagtctgaatatattattacgtgccttgggctttaaaaactgctatgtagagttagcagtttttaagatgaaaatcactagacagctcattggaataagggcttctccaaagaactctgtagggttatatctattgttactatttcattttattaagatatactgtatatttacatgtcttcatggttttggtatgtttcaaagtataaataatcccagttctgtggtctcaggaaggaaaaaattggacagtgtcttttttttctttttttcttttttctttttttttttgagacggagtcttgctctgtcgcctaggctggagtgcaatggaacgatctcggctcactgcaagctctgccttccgggctcacgccattctcctgcctcagcctcccgagtagctgggactacaggtgcccgccaccacacccagctaattgtattgtatttttagtagagatggggtttcaccgtgttagccaagatggtcttggtctcctgacctcgtgatccacctgcctcggcctcccaaagtgctgggattacaggcgtgagccaccgcgcccggcctggacagtgtctttggtaataaagttcagttttttttaatgtaaagtgccacacccaatgacatattttgtacaaatacaaaaagtctgaggtatatgaagtggaaatgatgaaaataaaggaaagggaatggaaaggtgtagaggcctttgctgtttgatgggaagggaaactagctctgtctttataatactgaattaaatgtcattggacttttggattaatttctcaaatttttgattccaaaataagttactcttggcatatttatattgaatgtgtgtgtgagaatttttaagtcagaatgacaggtgttctgatatcaagtaagttttaaaagttagcatatagtttattgaaattctaataagtttcttagaattttttgtagaattcctggttccctattgtgatttcattctagttcccatagcttttgctttactcttgacagttccacatagagaataaacaccgctcaaggttttaggggacttagaactgctgtcagtttcaatatactcaaagccagcattccttttccttttgaaactgcctgttctttataactacccaattttagcatgttttctagacttaatcacacgacatgttggactcaactttgacttaattttcagattacaagctgttgatgtttcccatatcattggttccctatcctttacattcacgctgaattgtatagttcccaggattatactcagaaaagtgcacattgccaaataggaaaatgatactgtatggataaacttgatgtgcttttaatggacaaaagctaaattataaacatctttttactgctgcttgtggtcattcacttggacttgttactcttatttttcctttttcagttctatgttgcatgtatttcttattctaatctttctaaaatgctgatttcattccatctatttgcttgatccttgccagaattccctgcaagaggcttttagctttagtttggtcgtctcactatccctgatacaaactgttgctaattaccatctttatggcctgagggtttctgcttcattactcgatttaggacttattttaatcttgattatctgtctttcagcatcagaagattggctctgttcttttctccttgaaaacatttgtgtatttgtaaagtacactgaaggagtatatgctttgatatttagatggcacaaatgtaaattttggtgtgggaagaacggtcgtatcagcagttctctcttttttattatgtgtatttctatgtaaccgatcattcacttgttctctagtcagtaattccatttaattatgaaaagcttgtatatgtgaaagttactgtgcaatagcagttgtcattgatttagttttgttttctggtaaggtataatgtgatagaagtagtagtgtagtgtaggatagagttttacatattggcagatttcactagtttttttttctattgccattcaggcaccaaagccatgtggatgaatatagctgacttgatatcagtaagatcattttgtgtgacacctgcccttttgtttacattggataggttattaaaaagtttcagcatgtaagctcttgtggatttcttttgacaggatttgttgtgagccttccttccccaaataaaaatgtgcttacagtggtaacaacaggtaaaagaatataaggatagtttcagccaagtattaatctataaagttaagcggaccaacataagatttgcttaatgggttggcctgtatgcatgtgttgaattttaaaatctaagaaggattattgcattaaatttgcagggactgcccaatttttgttgtattagtattttattttaatcgtttaatgagttgggaagttagagatgtttttttttttttttgtcgttttttgttttgtttttttctgagatagcagtctcaccttgtcgtccaggctggagtgcagtggcacaatctcgcctcactgcagcctccaccttccgggttcaagcgattctccctcctcagcctcccaggtagctgggactacaggcgcccaccaccatgcctggctaatttttgtatttttagtagagacggggtttcgccatgttggccgggctggtcttgaactcctgacctcaggtgatccacccaccccggcctcccaaagtgctgggattacagtcgtgagccaccatacccggcctagaaatgttttttagtggcagttaatttctaacttgcaaacaatttttgggatctagagtttttaaaaattagcgttataccaaggaacccactggtatgcggaatgtttctcatctaagtgattaattacaaacgcttttctgagacagacctatttgttgatccaagacttatgaacactcagcttataatttttttgctccttaaacgtaataaacattgtccagtttagaatgacatacttggaccacattcaaccaagagacacttgatgaaaatattatgcaaaatacctacttaaaatgtgattctgtggaattgacagttgaaggtagtattatataggcaagctgtagttcttgcctagaacaggcaagttctcaattcaacaatttgatgagtcctttagcattgtgttaggaagatgtttagaaataagacaactcaagcaatctgctttttgtaagagtaacgacttttccttcccagttgccctttgattgttgccatctaatggaggactagcatcaggctctttttctttaattggagcagagataaaactttaagcatatccctgtgtaacatttctaaaaataaaggatactaaagtgtatactaccttactttaagagaggtgataaaacttagcatgagccatgcagtctttttgaatttttgattcattgtgtgatttggggcaagttttactgcatttgtctgtgactctgtttccacatcttcaaaatgggaataatactatctacctctaggatgttttgaggaaattgttgaattaacacacccctgtggtggtgttaaatagcaaatacactgctttaccttttgtacctctgtgatatcactttattgtggtttcatttataaattttggattaaatttaagagaactttagaaagctgaaattttttatttaatatttgacaacttgctattttataagccctgggctattacaaaaataaatgtaaaagcccctgctcttcagtctggagagggaaatagacgtgcacaaataatacaagtcaaagagggaaaagtactgcaaattcattgaacatagaaaagctggtctttagccttttttaaaaaggggctgataaaatatagtcccccatgtagtttatccataatacatagcgtgccacttacaagctaaaaagccctatgaaaaatgaggcgttttaactaccaccaccaccaacaacaaaaagcatcgtgagggaaatactggtaaattgggccttggtttgtgagaaacttcagcgcaggcctagatcctgggggaggggagaagaggaacgccttcagtgagtgtcaataatttttaagtttatacttaactactcattaagttctttttgatataagttctttttgatacttgttagtgtttcactttttttttttttttttgagacggagtctcgctctgtcccccaggctggagtgcagtggcgcggagtctcgctctgtcccccaggctggagtgcagtggcgcgatctcggctcactgcaagctccgccttccaggttcacaccattctcctgtctcagcctccctagtagctgggactacaggtggccgccaccacgcccggctaattcttttgtattttttagtagagatgaggtttcaccaggttagccaggttggtctcgatctcctaacctcgtgatccgcctgcctcggcctcccaaagtgctgagattacaggcatgagccactgcacctggcctagtatttcacttttaatctttaggaacaacatttcaaaatttgttttcagatgttcctttttttatttttattttttttgagatggagtttcactcttgttgcccaggctggagtgcaatggcgtgatcttggctcaccacatcctccgtctcctgggttcaagcgattctcctgcctcggcctcctgagtagctgggattacaggcatgcaccaccacgcccagctgatttttgtattttagtagagatggggtttctccatgttggtaaggctggtcttgaactcctgacctcagatgatccacccgcctcggcctccaaagtgggattgattacaggtgtgagccaccgtgcccagcgttagatgttcttaaaacactgattccttctaggattattttgctagcattcatgattcggagggagacaattctctgaacctgatttaatttggcagtttttattctcacttcctgctagccctttcacccagttgattaaaaaaaaaaagttttagaacagaacagatggggctttctatcagcattgtttagtgtaggtatcttttgttttggggtaaatatcagggagcagctactcttttaacaggaattatattaataaagttttaggctggctttaacagttcttgaacatcaggaacatcttgctttgccagatttcttgttgattaaaagtgcagatttgccatctattaatggaaaatgcgttaagtgattaggcacaagcctgcttatagatgaccttatttatagaacatatgttcacagcttaaaatcttattctgttaggccacattgcatagaaaggtaataatttaaagtcaaaatgtctaaaagacttaataaattagttcttgacacctcctaatcattagcatttctggtggagcacttttctaattggttgaaagcaagtgaggaaattgcaaatcaaagaatggaagccactccggccacaagggggagtaagagattaaatctatgggcccctaatgtgtgacagattatgggcttcttgcatgatttctttttaaaattttaagagatctaggatttatacaaggcccagtgtctctacagaataaaaattataggaaaattatctctgcataagagaattgtacaagaccagaaatttgaactacactatgctgaagagttggaattaaatctattaatgaggatgttattaaaatgacatttgtggggtatttttgtgagtttttaaattgaataatataaactgggagttttacataatttatagatttgtagaaatatgtttaagtatacagaaatttcattgagtcattgaattttagggttaaagggacatctgatctagcctttttattttaacagatcaagacactgcagctcaggggttcagctatttacatgaggtcatacagtaagcattaatatttgtagtctcttaatgtagtatcatcttattgtagattgaaacatgacatttaatctgctatcaagatactgggtttgtagggggggatgaggagttgtcagaataacaaaataagtggctttaattttattgaaaacagtggggtttttttgttgtttgagatggagtttgactcttgttgcccaggctggagtacaatggcatgatcttggctcaccgcaacctctgcctcccgggttcaagtgattctcccgcctcagcttcctggatagctgggattacaggcatgcgccaccacgcccagctaattctgtatttttagtagagatgggatttctccatgttggtcaggctggtctcgaactcctgacctcaggtcatcctcctgcctcggcctcccaaagtgctgggattaccggcatgagtcactgcacccggccgatttttgtttcagactataattagggtgctgtacttactgagaatcacttttgagggctcttatgcctcagttacttgctacctcaaccttttaacttctggtgtgtgtatgctttgtatgaaagcaggcatgtctgtgtcctaatgtctctctcttcatttgttgttttggaagagagccatgacagtacaatctaaaacagaagaatgggttatggaggcttgatctttctcccactcacatatttggtgaggtcatgtcaaagttagcccagctgtattcgcaaatttcaattcataaatgtctcaatagaggttgattgttttgctttgatattctggggggatttgctatttgctaatgacactcgatgtctaattatctttgtgcgaattaaatttaatattaggaccagttggtgaaatactgttttaagacaagatgagaactttctctccaccccacatatttttctttacaaatgtatcattgtttttgtaccatttctgtgttaaatacaaaagtagtatcagccacataaggaaatttgaaaaaaaaaaagcatataaagggtatgaaaaagggtatctttcagaaataaagacaattaaaagggacttctttaaaatgtattaacttttcattttgaaataatttcagatttagaaagaggttggaaaaatatgaagagtttttcatatattttgccagattgtccacatgttaataactacagtataattattaaaatcaggaaaatgattaaagtaaatgataaactattatgtaacctataatcttaattaaatttagcaaattgttttactgtaatttcctgtttctgctccagaattccatccagaattacactttgcattttgcttacatgtctccttactctcctttaatgtggatcagtcttgttttagtctttgcctctaatgattttggaacttttttcaagagtactggctggttattttgtagaatgtctctcagtttcgatttgtctggtgatcctttttgtttgtttgtttgttttgagatggagtctcactctgtcccccaggctggacttcagtggcgagctatcctggctcactttgcaacctctgcctcccaggttcaagcgattcacctgcctcagcctccccagtagctggaattacaggcacccgccaccatgcctggctaatttttgtgtttttagtagaggtggggtttcaccatgttggccaggctgatctcaaactcctgacctcaagtgatttggccgccttagcctcccaaggagtgagccaccgtgcccggcctgtctggtgattcttcatgattaaatttaggttgccagtttttggtgagaactcctggaagtgatatggtgtcctcctcactgcattatattaggaggcatgtggtgttgtcctgttacttaaccaattatatttagatagtgcattatgctgttaggacttctgaaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgttctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattattcagtcagggagtttaatatttttgagtgcttaaaatgtgtagaacgtgcctttattagagcctatgagtaggttaagagtatatatgtgtgtgaaaagttaaaggtgcaaaaccataattgtttgttttatttgagatggagtctaactcattggagtgcagtggcacaatgtcggctcactgcaacctctgcctcccgggttcattcaagcaattctcctggctcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggaggtaatctctgttagtcctttgtgtatcctgggaatttatgtgcaaagtaaacaattctgtccttgaagaataaggatcatatacttagtttggtaaattgtacaaaactacacactttgatgtatatcttatgtttcattttgacaggtacctccttactcttttgttttttggagacagtctcgccctatcgcccaggttggagtgcagatggcacaacctctgcctcctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctccttttaaaaaaaaaaaaaaaagatagggtctccctctgtcccccatgctggagtgcagtggtgcactcactgcagccatgacatcctgtgctcaagtgatcctcccatctcagcctttggagtagctgggagtgcaagtgcacactacactaggctaatttttttttttttttttttttttttttttgagacgagtctagctttgttgcccaggctggagtgctttggcacgatctcagctcactgcaacctccgcctccagggttcaagtgagtctcctgcctcaagcctgccaagtagctgggattacaggtgtgcaccaccatgcccacctcattttttgtatttttagtagagatggggtttcaacatgatggccaagctggttttgaactcctgacctcaagtgatccacccacctcggcctcccaaagtgctgggattacaggcgttagccaccgcgcctggccacgctaggctaagtttttaaattatttttagtagagatggggtcttgctatattgcttaggctggtcactaactcctggcctccagcaatcctcccagctcagccttccaaagtgattgtgattaaaggtataagccaccacacctggccgttagtcctttattgacagaaattaggatatttcccttttttctcttcagttaaaaagctctacactacacactatctgtacagacaatgtagatgaagctgaatagctttgaataattagctttagggagaacatagcattagagctaggtatggagaggtatttagcacagattcttttcattttatttttccagctttattgaggtacgattggcaaaaaaaatatatatttaaggtgtacaacatagcagaggttactttaaatcagttgttaaaagtgatatgccgaccactgggagtcctttggggaggtgtctattacatcacaaaaagtcacaactattttcttccttttttttttttgagacggaggctcactctgttacccaggctggagtgcagtggcacaatctcggctcactgcaacatccacctcccaggttcaagtgattcttctgtctcagcctcccgagtagctgggattataggcacacaccaccatgcccagctaatttttgtatttttagtagagacaggctttcaccatcttggccaggctggtcttgagctcctgacctcatgatccacccacctcggcctcccaaagtgctggagttacaggtgtgagccactgcgccgagccaggtcacaactattttcatggcaaatactgttaatactgattcttatcactttgttgacatttagcactggtgcaaacccaagggttgctcaaacttactggttccttatcgctaatcaaggcagtgatactatactgtactagtgattattgtatttctttaccattatgcactcactgtttcttttaaaaagaaaaaagactttttttttaatgtccttgaatctgaaacattattttattaatagcccttaaatagacatctttcagtgaggcaaaatgggaagtccagtggttgtctctaagaaaaacacttgcagttatttgaattgtgagataaactagctgcttttctttttttatggaacacttttttcttcaaagaactgcaggcagataagctgtgggtattcagacctaggtattcgacaaatatcttaaatgaattgagcctctcactttaagggaaaatgatatttttgacagataaaattgaagctttggagcaaaaatgagaactttggaaaataattactaccaccatgatcttagttttctacttttttatgactgtaaaagtgtcttgagacaaacttttaagccataaatttgaagtattgttaccgtttagggttttttcctagaaaatgtacctatttatagaggtagtatatatgtaccatggttgggagaaataaggtaatattacttaaatattaggaaattatttcacataagagggagttcagagctaaggtggtttttgggtgggtgagtgggtgggttaagatcagttactgcagtacaaacagtacttgaagtctaatgtggttgacactagactttcaccttccaaaaggatggcagcacttctttgttgcttactatttgccagactctgctaaatgcttattatatgttaattcatttaatccttacaacaaccttgtgcattatgtctactactaatatttgccttttacagatgagaatctgagacccaggaagatttcagagttttgtcaaggtgacagagtttgaatttaggcagtaagcagtctgtctccatagtttgtgttcctaacaagtctgttgtttaaaaagagaaaataaatactaaaggaaatgttctttttttcttttgttcttttttcttttgttctttgatatgtcttaatcctgtgtttttgaatgaaaacttttttgcatcctacttcaccatttttcctagttatacaaattttagattaccaaagccaaaatgatgtacttaagagtacaagagcactaaagcagatttttgaatgtcagaatctccatactttattttcacataactgagcaaccagtgagtagaatgcctactctcggttgggagctgtgaatggtgccctcctgtttatatgttcatttagacctcataacagccttttgatgtggattttcatatagatgagaaaataaagattagctattgtgtaaattctcaaaattaatgggttagggtggaatttcaagtctgcctggttttagagtttatacgatttgcattacatcaagcttttcttctaacaagtgttgaatgcccgaaaggttaaagtcttgccaccagctcaggcagcagttttggtggtttaggggtaatcatactgaaagaccagtgagaaaggcatatcactagagatagattctcagttcattaacttttcattaggaatatttgactacaggcaggagtgagtgtttataaaattcatattagtgggatcaggttgagtctatgccaagaagggatcagaaacagatgacctgtcaatttatgtggttccttaattttaatagacttaattttaaagacaaaacatcattgtaaatatagactatctttggattaaggcatcttttggaaactggcttgggaggaaaaatgttatttgaaccccatctcttggaagtgttttcacaatctaagaggttaattatactacggtgcagtagagagaaaaatctcttttatctctaaaatctcaaatttcatgtaatttacctgttggttaggttaaggattagtgtcctctcttcagagcccatatcacatatttaactctggattaggagctgtttaccaaagagtattagataccggcttcttgtggcattttgctgctgagtaaatgatttcttatcccacttaatattattagggtgaatgctgtataaatgcattaactctaattcagcaaattaatcttgggtattttctaaaatgttggccatgatatctttaaaagacagtggctgtcatgaaaaaacatatttaaaagttaatgggagcagggcaagctatgatggggccactgcattccagcctgtgtgacagagcaagacctcatctctaaataaaaattaaaaaaattaatgggagggaaaaaagtaaaacttacatccacattttgaagtaaactgaggaaatactgtggatttctaaatgagattatatttcaggaagattcaacagattaacatttagccttgatttagcttgagtgtaggatgtgcttgaattttgtttgacctcaaaaccatttagatttggtttaaaaacttaaggtactgtgataattgaaaaattttacaagttgaaccttcagtcaacctagcccttgttttacagttggagttggctgggcgcggtggctcacacctgtaatcccagcactttgggaggctgaggcaggtggatcatgaggtcaggagttcaagactagcctggccaatgcagtgaaaccctgtctctactaaaaatacaaaaattagctgggtgtgatggcatgtgcctgcagtcccggctactcgggagactgaggcagaagaatcacttgaaccggggaggctgaggttgcagtgagccaagatcacaccactgaactccagcctgggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctgaagttattgcatattttgaaagtagctatcagccctttcctcccttccattctctacttggtgcacctccatgtttttttctgctttgttgtaactgctgcttcctttttcttttgttcttttattcatttttttctattcttcctacattgggttttatcttctggcttccaaatctggaaaacttggatttgttattcttcggtcagtttgacaaagcaacatacttaattgcctcttttatgttaccattaaattaattctgtgaactctgacttcccttagaattgaaaaagaccacgtgtacaaaaatccggttagatagtagaaataagttctagtattcaatagtacagtagggaaattatagttaacatttatttattctaccaaagtagctagaagaattgcagtgctcctaacacaaatagaagatcaatgtttgaggccaggtgcagtggctttacgcctgtattcccagcactttgggaggctgaggcaggtggatcacctgaagtcagaagttcaagaccagcctggccaacatggcgaaaccccattggtactaaagatacaaaagttagctgggtatggtggcacatgcctgtaatcccagctactcaggaggccaaggcaggagaaacgcttgaactcaggaggaggaggttgcagtgagccgacattgcgccactgcaccccagcctgggtgccagagcaagactgtctcaaaaaaaaaaaaaaaaaatcaatgtttgaggtgatggatatcccagttactctgatttgatcattatatattgtatgcatgtatcaatatcacatgcacccccaaaatatttacaactattttgtcaattaaaatttttttaaaagaaacagatgacatcttctttatgaatctcctctacaaaatacctaagttaccctctttagtttcctgttttacctttatgtgaaaagagggaattcactgagcaggttccagtactggaccactcataagttttctcatactgaacagaaatcttccctcttgctaaatttaattggtcttgtctcttggagccattcatgtcctgttctttccattatcctgacagtttctagtatactcgccataactttgattcctgattgtggaataacgtcctttctagtaggtatatcaccccattgaggctgagaatatgttcctttttttttttttctttttaagacggagtttcactcttgttgcccaggctggagtgcaatggcgcaatctcagctcactgcaacctctgcctcccgggttcaagtgattctcctgcctcagcctcctgagtacctgggattccaggcgtgtgccaccacgcctggctaattttttgtatttttggtagagacgaggttttaccgtgttggccaggctggtctcgaactcctgacctcaggtgatccacccgcctcagcctcccaaagtgctgggattataggcatgaaccaccacacctggcagaaaatgttcttttatagttagctttttttgagctacagtgttagcccctttaaatttaatctttaatccagtcttgcttggttttgggtttttaaatcttaattagcttatgtcattggacgatttattagaagtaggccatttatgcctttctcaactctttttttttgagacggagtctcactctgttgcccaggctggagtgcagtggcactatctcagctcactgcaagctccgcctcccgggttcacactgttctcctgcctcagtctcccgagtagctgggactacaggcgcccgccaccacacctggctaattttttctttttgtagtagagaccggggtttcaccttgttagccaggatggcctcgatctcctgacctcgtgatccgcccacctcagcctcccaaagtgttgggattacaggcgtgagccaccatgcccagccacctttctcaactcttatggtcagcatctcaccagaaacacttgccacttgtttggttcttttggtctatcattaggccagtaagcagcctgactgctgtttacccagccctcctgttacttgtgggttctaacaaatagctttaaagttgttttatggttaattcagtgttcagctttggggaaagaagtgcttaactgccattttaattcccagggaactgcttagttcagcatattacccaggtagaaagttactacctacaaaagatagattactacttttagtagcatttatcaacacctttcctaaaaaaatttaagtttttagtacagctttaaaattttacatcttaagtgactggttcactcttaagtaactgcatgtgtttatggccttcatctctgcatacatagagggggttaaagttaccgaaaagtgaaagacgtgattaggcagtgttactctttttgagacagcctcactgtcaccctgtcctagagtacagtggtataattcaattacagatcactgcagcctcaaactcctggactcagatgatcctcctgtctcagccttccaagtagctgggactataggggtgtgccaccacacctggttaacttttaaatttttttgtagaggcaggatctcatgttcaccggggtggtctcaaactcctggactcaagaagtgatcctcccacctcagcctcccaaagtgttgggattacaggagtgagccaccgtgccctgcaattcttgtaaagtgtattgtaatggaaggaatgatagccttgtctctacagctagattatgaattaccagaatattgtgcttccagcttctagcatggtgtctggtgttattgtgataatagaaataaaattttaagtgcttactcctaagtgcttacctgtattttttctcaataatcttagaggtctctgccttacaggtgagataactgaatcattgagattaagtagttcacacggtgtatagtgctgtaattcaaaaccagactcaccccaaagccacttatgtttataccatctcccatagttgaatgaataatacaatttgtgtaacaatgaaacttttgaaaatcctggtcatttgtttcttaaaaccattgtttttaagtggaaagactcacttgactattttaaatgcaagtgtcttccactgtttgaggcagatctccacagagcaaccataggtggtaaaaagcattgtattcaaaggacaaaacacttttgcagctaagagaactttgaatatgaaagtatgaatgtggtgtaagacagaggttgctatcctaaccaaaacgttcttctgatttccggccagtaattttattttatttttatttattttgagatggagtcttgctctgtcatccaggctgcagtgcagtggtgcaacctcggctcactgcagcctctatctctcgggctcaagcagttctcctgcctcagctgggattacaggcgcccgtcaccacgcctggctaatttttgtatttttagtagagacagggtttcaccatgttgacgaggctcacctcaagtgatcctgccaccctagcctcccagagtgctgggattactggcatgagccactgtgcccggcctcaggccagtatttttaaatatcggttaataattgcaggaaacatcatttcaggttgacttttctcacctttaacctctttatatagcacagtgcaatctggccctactgccacttcatctgggttatctgtagcttgagttgtaaaaaaaaaaaaaaaaaaaattgggggaagaagttgggttaaaactgttcacctacccagcattggaacataatgggtaaacaaaaagttggagttaccatttaaaagcatttttcaaatttatattttatatataagtaggtgctatataaactaatactttttttttgtaagaatggatttggaatttagctcagctgaaaattgacttcaccttgattctcagagtgtacttgaactttaaaggaagtggggtagtgagaatgggtggttggggtttttttgctttaatgtttacctaattctactactagaattatttttctcccccttaactggaaagaaaaaaattacacatttattgagacttcttcccatccccaacacaatgatctaatctttttgctttaaaatcagttaaagagtgtaatttttaaaatcctaatcaaatgactcagattgtaatagtagttttagacagaattttataggatgatgttttaattttatctgttgtctgggatgatctgtaatcgtgtatcttactagccgaaaatgacttcaatgagattaaaggtctgctctttaaaatctgtaagtctcctaccactgtctttaggaaaaataaaacttttgaacggtttttttatctgttgtgaggtttgcttgaattgtgttgttataaatgaagtttattttgttcctccttctctggcatggactccttaagtgtcttacattattggtttctgctttagtcatttctccagagtcccaaaaggttcatcccgtatgttctttctattttcatgtcatgaccacatgaaacttcagatggaaagcttgccagctcattagaaaatgttcctaaatgtgaacggtcatgccccacattcatgaagtcagcatgtaaatagataacattgtcagggaccaatgttcaattttattgtcctcaaataataaactgaacactaacttcaaacttaaaatattgctgcccaaagcattctgctttaaaccacaaattcatgtgccagctgcattcacaattgtattgacagtgactgggtgtttaagttttataacttaggctatagtttgttctttaagaaatgcaagttctttcagttttgtaaatgttttattctcactatgtctgtttcttttcttcttaagtctcttttggaaaagttcttgatccccaatgcttcacaagcagagagcaaagtcttctatttgaaaatgaaaggagattactaccgttacttggctgaggttgccgctggtgatgacaagaaaggtatgctgtttttaaacctgttggttgaacttgtataagataacatagtgaggaagagtctctgaagcgtacataatgtcttgttttgaattgcttagagtgccgaataaggagtagcagtgctctttgtgttctgagaatacacatctactgcctcatactgctattctaaaataaatgctttctgaaaagccaatattgtgtacagggatgttttttcaagattttaagaaaagtgaccagcctgagcaacatctctctctacaaaaaatattttgaaaattagctgggcatggtggtgcaagcctttggtcccagctaatctggaggctgaggtgggaggattgcttgggtctgggatgtcaaaactcgtcaattttttaaaaacataacaataatgagattataaagttgttttatcttgacattgatcaatggctagtgtgtaccaggagaaagctccctttaaaaaaaaaaaaggaccttgttcaattaacaaatattaagctgttacaggttagtatttcaaaggatatgtgagatattaaaggtttggtttgaggggtgaagatataatgcacactttatctcagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagtatgtattttacctgttacgtagaaatttagcagtctttattatttgagcactgaaatgtaatgtactatttttaaatcgtaggcttttgatgaagccattgctgaacttgatacattaagtgaagagtcatacaaagacagcacgctaataatgcaattactgagagacaacttgacagtaagtacataacagcatcattagtgatgaatgtggttgaagaggttatgttttactctagggaatttttttttttattaaatacatcttttaaaattttttctcaacacatttcataggctctcataaatatatctcagctactattaaagtcctatgaaggaaaattacagaaactgaaatattagactgagaactaaaaaatacacacattgatgagttacctgtcttgttaaaatttgttagtatcaaaagtgtgctgagactctacatgttttagttcctttaagaatgattttcttgcccatcaagttgcctccatattggtaaagataatggtagggaattaataacttgagttacaaaatctcaggtatctacagaatccaagtggaagtctattttgcctagcttcttattttaaatgacttaatatgaaaggtcgtgattgtccttgggatactgcagatgtataaaaagaaacagtgtcactatcacaccaggaacatcaacataattccctaataatgtttgaatatctaaataatacttgaattccaattatctctctttttttaagttatttgaattgggattcaaattcagtccacaatgcagttgatttgtatgtctcgtttgtttcttaggtcttctcattcttctccttcagataaatactagatttgaaattttgaggcttaggtgaaaaaattatcaagcatttgctgtgtgtcaggtaaagaggtaggaattgcagatcataatctaggtattactgtttttttgttagacttctagggccatttctcttggggactatgtaatctcattttatacatttctcttccaactttattctagtccactgccattttctataaaccagttctatatgctagtgctgaaaatcttgaagagttttttgaatagtattgtatacttgtttattaaacctaaaattactttattagcacaatttggagctatctataaacttttctgatacttgagtcaagataacaagccacagtaaagaatgaaagaatcttatatatcaaacataagaagcactttgttaactaactttagtattaaggatttttcttttctagtttgaagtgatgacatttttaaagtgatgacctgagacctagatactgtgttttgttcacatcactttttgagaggccctgatctactgtctgcttccaactgaattttgctatcagtatagcatgaagagcgcatattgcaataagaaaaccagggttggccgggcgtggtggctcacgcctgtaatcccagcactttgggaggccgaggcgggcggatcaccaggtcaggagttcaggaacagcttggccaagatggtgaaaccccatctctactaaaaatacaaaaattagctgggcatagtggtgggcacctgtaatcccagctactcgggaggctgaggaagagaattgcttgaacccgggaggcagaggttgcagtgagctgagatcacaccgctacactccagcctgggcaaaagagcgagactctgtctcaaaaaaaaaaaaaaagaaaagaaaaaaccagggttttgattctaattctgtcactacttgtatgtcttctctgagccttattagtgtcagctgtcaccattataggttgattggaacatttatctgtcaagaaaagaaattatcccaaaacttaatatttcattctgaatttggttgaccaagactgtcaacacattactctagaaaaagaaatattttgtatcaaatttgcatgtttatacagaaaattcaagaatccttgaaagttagaacaggaaagagacattagaaacaatttcatcttgcaattacaaaaccccttgtttgacaggaggagcacacagtttccaagaggtcatttggctatctgtatgaccttggaagtagtctcctttccaggccagagatatatttgcttagtagataaatgaagctaatggatgatttggggaatataaaaataataattagtgtattttccccttcccctccgttttcatgtgtaagtcatatataaaatttaagattgtcttgaatccttttgtaattacctctgaaaatcactagagagtggttaagacttcaacatttttaacattggagcaggtggaatagagttcataaccctgccacctatgggacaactttcatttttacctgttaaaagatttggttctggtttttgtccagcatttattttgaatcatatgatagggtagtgcaaaagtaattgagggttttgccatttaaagtaatggcaagagctgcgattacttttgcaccaacctgataaataaaggtttgtttttctaagcttaaagtgttagaaaagctagatttgtagtttagctcagagttgaggctggttcttgaatttcatggagtataggattctgtttggagtgtgagtcactttaagatctaccagtggagagtagtcaaccctagctccttcagcatgggccaaattagatgcttctggtatagttgcactcaccttggacgtccatctttcatattggggctctttaggttctgacacctattgatgcttagtttttaaaaaataatttagggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaagtattatttcttgtaatttctcttcaccttctgtggataaccaaaactttcctgtatctgaaggttatttgaaggcaactctgtggtgtacttaacctgcttatatagtggttacaaaaaaagtaaatttgtatattgagatgtttttgtatcttgaagctaagtgatgctgctatctttttaagaatgctttccaactaaaacattcaggtatcttggcacttatatgaaaacgcccccccccccccatcccactgaaacttgctgaaaaatctttccttcttttaccagttgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 35622 - DNA, 34656 bp, Homo sapiens; identical to SEQ ID NO: 35621

SEQ ID NO: 35623 - DNA, 2394 bp, Homo sapiens
ggcattctggcgcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggtgggtacgcttggcccggccggccccagcccctcctctcgcacctcgccccttctagggcccggggccggggccggggccgcgcgctttgtccggcccgggacacgcggcgccccctcccccgcccggtccctttgttctcggcgccgcagcccccgcgggcgaagcgaggggaggggcggggagggggcgccggccgggccctgccgccttctttgttcgcggccccggtccccggcgctgccccccggccgccccgagtgccgcgcggggaacaaaggcgctgctgggccacgccaagggggcgcccaggggccgcggagctggggcccggcggggagcgcactccacccgccgacccgacctcggtggcccacggtctttttttttttaagggggagccgagatgcgggagagcctggggtgggtgggggccacttacacaaagcgggaggctgggaaaataggccgtccaggtgcagagagacagcgccccggggcggcttcccgcccaatgtcgcctagagcggctcgcccgcctgcccgggatccgcacagcagatccggagcggttccgcgcggaatagagagcgcgccccgggggacgggggtgggggccacgggaccccagcgcctcctgccggtcgcgccctctgcgcgctcgctccccgcgcgcccgtgaggggcgagagggaggtgtttgacgggatcctgggtgtgggtgaggctgaagccagactttcgggttgcagtagaatcgaatcgaggaccccttcctctagaagggatcagaagcgggctgggggagggggagcccctgccctcattgctattccctctgccctgcaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtcccttt

SEQ ID NO: 35624 - DNA, 11888 bp, Homo sapiens
gctctcttcctgtctttgtggctccggaaaggcgtttgggatgccaacggtaagtccggaggcttagggcgtccgaacgggagaggcgagagcctcgtgtccgcgcatcaccccgtggctgggggttagctaggggagggcgggaagggcagaggacgcggtggctggaggacgtgtaaccttgcaagaggcgggaggcggggggcagaggtgattgacccccgcccccccgcccgtgggaccaagaaagggatgtgacaggcgaggacgaatgggatctcaggggctggactggagagtggggtacagggatgtgaggaggaccccgcgagtccgcggtgggatcccaatagagctgtggccaaggaggaggggagcagcgggaaggctgtgggcactcctgtgtgagggaaagctacaggctcctgcaggtccgagatcggccgaaatcaggcaccccaaggaagccctgctctggccacatggtgtcccctcagaagactccaccagccggtgggcatcccggggcttctgacaggaagagggcagtagatatattggtgcttgtaccggtttttcgagggctgcagggtgaagatggtaggagagtctggagaacgggtctgctctggtggcttatggactactctgtggaaggggctgctgttctggtagcatcgaaggagctttctacgggagcgctgtcaagaggattttggtgaatttgacgtacttggtttgataactcactttgcttttttctctaaagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaaggtaactcgaggccctagagttacagattaagcctatttctggattcttagttttcagatgggaatagggagcatattggtgggtagtggtttctctttgggacacttccagcatcagatatattgagtgaatgaatacacttcgggatctacttttggaaaggaggacattcttacctaagctacaagaaaccatctttcacgtttcgggttggaagaattttagagtagggaagtggcaagaattgtggaaaaactaggagggaaagataaagacacagaaaatacacaatcccttgttacctcaggggtttaaagtgtcatcttccagcctggcatggtagctcacgcctgtaatctcagcactttgggaggctgaggcgggcggattgctggaggtcaggagatcgagaccagcctggccaacatggcaaaaccctgtcactactaaaaatacaaaaattagccaggcgtggtggcggacgcctgtagtcccagctactcgggaggctgaggcaaaagaatcgcttgaacccgggaggcggaagttgcagtgagccggagattgcgccactgcactccagcctgagccacaagaccgagtctccatctcaaaaaaaaaaaagtgtaattttccttctttcattagcctagagcatttttgttgcctttctttcattttattcccttataactttctcctctgtattcactgtgttcctcttctccctccctccacacacataggcatgtacatgaagaaaaattgaggcaaggatgaacttggacctattgcctcctggatacttgattattttggtgcttctgagcaatagaatccagtccttgacctggattcttcagtgcaacagaaccaagttgctatattactcatatcttttgcaattctgatttttttggagaagcaggcaggtttgattgtttattgctttaatttaatttttttattattattttttagatggagtatcactctgtcacccaggcaggagtgcagtggtgcagtctctgctcactgcaacctctgcttcccagctgcaagtgatcctcctgcctcagcctcccgagtagctgggattacaggcgcataccaccatgcctggctaatttttgtatttttagagacaggattttttgtattttagagacggagtttcaccatgttggccaggctggtcttgaactcctgacctcaagagatcagccagcctcagcctcccaaagtgctaggattataggtgtgaaccactgcgcccggactattgctttaatttttttgtttgtttgagacagagtctcgctctgtcccaggctggagtatagtggtgcgatcttggctcactgcaacctccgcctcccagggttcaagcagttctcctgcctcagcctcccgagtagctgggattacaggcgctcaccaccgcgcccagctaatttttgtatttttagtagagacagggtttcaccatgttggccaggctggtctcgaactcctgacctcaggtgatctgcccacctcggcctcccaaaagtgctgggattacaggcgtgagccacggcgcccggcctgctttaattttatatccattacttactaaccctttttgtttcatccattttctagtgctgcattagacgtggaactatctgatgattccttccctccagaagactttggcattgtgtctggaatgctcaatgtcaaatgggaccggattgccccgtatcctcttggcacttggtgatgaagggtcggggggcagggagagccttgcctgcaaagcagcaggggtacttcaaataggctggatatgtgtggctgtcctcctgtcatctctctggataagatggagcaagagaggttggtgtaaattgtgtgagcatgatttagagtagacatgaagaaggaggatactgaagttcagattataagaccctgaaacaagctgggcacggtggctcatgcctgtaatcccagcatttttgggaggccgaggtgggtggatcataaggtcaagagattgagaccatcctggccaacatggtgaaaccctgtctctattaaaaatacaaaaattagctgggcatgatggcgcgcacctatagtctagctacttgggaggctgaggcaggagaatcacttgaacccaggaggcggaggttgcagtgagccgagatcctgccactgcactgtagcctaggcaacagagtgagactctgtgtcaaaaaaaaaaaaaaaaaaaaaaaaaaaaacctgaaacatactatactgggaggatatagacacttaataaagatgtttgtggctggacaaaggtatttaaggtgcttttaaaagaaattcaggccaggcacagtggctcatgcctgtaatcccagcactttgggaggccaaggtgggtggatcacgaggtcaggagttcgagaccagcctggccaagatagtgaaaccccgtctctactaaaaatacaaaaattagccaggcgcagtggcgggagcctgtaatcccagctactcgggaggctgaggtaggagaatcgcttgaacccgggaggtgcaggttgcagtgagctgagatcgcgccactgcactctagcctgggcgacagcaagactctgtctcaaaaataaaaaaaagaaattcactgggatgctagcatgaaggatctgggtgaccttttaaagtctcttattcagtgagtctcttattctaatctaccaattatctcctgagtattgaattagatggtatttttcttcctgtgaattaaagtatatttaagccaggtgcggtggcacatgcctatagtcccagctacttgggagatggaggtgagaggattgctagggcttgggagttcaagcctgcagtgagctatgatagtgctgctgtactccagccttggtgacaaagtgagacctagtctcttaaataataattaattgtattttattaatctgttctcaagttgctatgaagaataagctgagactgggtaatttttaaaaaaagaggtttaatttgttcacggttctgcaggctgtacagcaagcatggctggggatgcctcagggaacttataatggtagaaggcaaagggaaaataggcacgtcttacatgtctggagcaggaggaagagagtaagaggggaggtgctacacacttttaaaccagatcttgtgagaactcatatcattagaatggcaagggagaaatctgcccccatgatccaattccctcccaccaggcccctcctccaacattggggattacaattccacatgagatttgggcagggacacagatccaaatcatatcaataataattatgtatacgtttaggtttattggtgagggtaaatgtggtctttgtatttgtttttgttttgtcttttttttttgtattttcaataatttccttcaattatagttaacaaaagattttctatgagcttggccaggcgcggtggcttacgcctgtaatcccagcactttgggaggccgaggcgggtggatcacgaggtcaggagatcgagaccatcctggctaacacacagtgaaaccctgtctctactaaaaatacaaaaaaattagccaggcgtggtggcgggcgcctgtagttccagctactctggaggctgaggcaggagaatggtgtgaacccaggaggcggagcttgcagtgagctgagatcatgccactgcacttcagcctgggcgacggagcgagactgtcaaaaaaaaacaaaaaaaaaagattttctgtgagcttaagtgactataatttcttttaatcatccaagaagaagcactgattgaatgactgtaattttttttttgagatggagtttcgctcttgtcgctcttgtcttgagtgcaatggtgcaatctcggctcactgcaacctctggctcccgagttcaagcgattctccagcctcagcctccagagtagctgggattacaggcactcgccaccatgcctagctaatttttgtatttttagtagagacggggtttcgccatgttggccaggctggtctcgaacttctgacctcaggtgatccaaccacttcggcctcccaaagtgctgggattacaggcatgagctcccatgcctggccaagtgactataatttttttatccataacatatattgctttggaagtttacttcaaaaaccatgacactgagtataacatgggacccttaaaatttagctggaaaaaaataccatacactttagatttaaaaaagatgcctaggccccatatggtggctcatgcctgtaatcccaggactttgggaggccaaggtgggaggatcacttgaacccaagattttgagaccagcctgggcaacaaagtgagaccccatctctctctcttttttttttaatatttaaaaaaatcagtaaattttaaaaagaagcctatatatatatatatatatatatttttttttttttttttttttttttttttttgaggcggagtctcactctgttacccaggctggagtacagtggcacaatctcggctcactcaacctccgcctcccgggttcaagcagttctcctgcctcagcctcccgagtagctgggactgcaggcgcatgctgccatgcccagctaattttttcgtattttattagagacggggtttcaccgtgttgcccaggctgttctcgaactcctgaactcagccaatccacccgcctcggcctcccaaagtgctaggattacaggcgtgagccaccatgcccggcaaagaagcctatattttttcattcctgcagaatattgccggcatgagatcagcatgtattggcaaatgttttgtaagtggtgcatttagtccacaggttgaaaggctgctacaactttagcttcatctctttccgttccttaactcttgagccagtgctagcaatgtctcccacactgtggtcctgcgccctctcaaggctggttatttcaacttcacctcggcaacaattacttacctggcccaggaggatgggcccgttgtggtgagttgcccaaacccttagctggatggaatttggatctgccttcccttaaaatctcttgtggtgggggtaagagggggatgaagagaggttgattaatagataccaaaatacagttaggactgggcgcagtggctcacacctgtaatctagcatttttggaggccgaggtgggcagatcacctaaggtcaggagttcaagaccagcctggccaacatgcagaagccccatctctactacaaatacaaaaattagctgggcgtggtggcaggcgcctgtaatcccagctacttgggaggctggagcaagagaatcacttgaacccaggaggcagaggttgcagtgagccgagatcacactactgcacttcagcctgggcgacagagtgagactccgtctcaaaaaatatatatatatagttagaaagaataagacctagtgttcgatagtttagtagggtgactatagttaacagtaatctaatgtatatttcaaaatagccagatgagaagcatttgaacatttccatcataaagaaaagataaatgcggccagacgtggtggctcacgcctgtaatcccagtactttgggaggccaaggcaggtggattgcttgagcccaggagttggagaccagcctgggcaacatggtgagacccccatttcaaataattagccaggcatggtgcacgtgcctgtgatcccaggtactcaggaggctgaggtgggaggattgcttgagccccagaggttgaggctgcagtgagccattttattgccactgcattccagcctgggcaacagagtgagaccctgtctcaaaaaaaagataaatgtttaaggtgatggatatccatctaaaaagtatagattgtaaaaacaaaaacctcttacagaaaatttacacagtagctactaaattctgagggagataacattaaccagacacttggtattgtcctaaggaagtatgtttcaaattaaagttctggactagagtgattgaaatggatgggagaggtgtaccatggccttccccttctcttcattccttctgccttccttttcatctggagtgtgtcatttgctgcctactgatgtccttgtctttctgatctgtcttctctgccactgtcagattcttcccagtctccactgttactctctccttcccttgcttagattgctcctgcttacggcatcagggctgagcttttctgcctctcactgcacccccctccagtagtctagctattttctgcctccagccttctctcccactctgcccatacagaccctacatcctaattaggccaagctacttcccataccttctcccccaactcagtccttattctttcctttgtgcctttgttctgtttgaagtacccttttccctccactccattatatctgaagccttctcaagacccagctttgagctatgtctccttgttttctgccttcagttcatattgctctttgctattcattcttttcttttttcttttctttttttcttttttttctttttgagacagagtctcactctgtcacccaggctgcagtgcagtagcgcaatcttggctcactgcaacctccacttcccgggttcaagcgattctctgcctcagcctcccgagtaactaggacaacaggtgtgtgctaccgtgcccggctacttttttatatttttagtagaaatggggtttcaccatattggccaagctggtctcaaactcctgacctgtgatccgcccgcctcggcctcccaaagtactgggattacaggcgtgagccaccgtgcccggccactattcattctttcataaacatatattgactgcatctaaacttctgtagcacttatagtctatggcacttgaacatttaatcactgtcttcagtagtttgtttcttatttatagatcttccctctccccacccccacctcccaatttaattataaactccctgaggccagtaactgtcttagatttctttttcccatatatgatagaaactcagtagtaaacagtcttttgattgatgtaaaggtcaatagacatttatgaagcccctgcaatgtgccagactctggggaataccaagaggattaatatactgtccaagtcctcaaaaagcttaagtcataaatgtataaagccaaataaatgtataaatttatgaagccaaaatgtgtgatcctccataccagtagggctgtaggctaattagtacacagtagggaagggacttaacacagtcaaccatagaatgaaaagaactaacattcattgcaccttctgcattttcgtttttcataaactacatggaaccatattcttctaaacctagcggtgttttcacatccggtatcatttctgctttcagaaccaacctcaggactctttggttctacctggtagttgatgggttaatagacataaaatcaaaggctttgctgccactttggaataaagttgtttgcagtgtgctccaaactcttggcttcctctccaagacaaaggaatgtggaccagactcaacccctcctctaataatgtacatttgggtagggctttatacttcattatatatttttgctatttcatttgagcctcacattaaccctgtgaagtagtggatttttgctggaggattaagtaaatgattaccaagggtaagtcattccacgcacaccttgccctgtagagggaccagtggtggtgagcaacttcactctttgcagagtctgaggctcagacagaagaatttggctttaatttcagttgcatgcctggcctaccttgtttaatatatgttctccatggggtatttctcaggtcttctggctcctaggtactcctctttataacacactaagagagaatcatccaactctctctagccaaaagctttccctcatcttcttgaagttcttctgagcctttgggaactaagactctaatgcatagagttgggttggttgggactgccctttctcagagtagatgaggtggaacttcatgaggtggacttcccttaatgtcgttcttttcttcttttcagattggctctaccagtgcacctggacagggaggaatcctggctcagcgggagtttgacaggcgattctcccctcattttgtaagctttctagtgttctctctcatcagttccttggtatgagaatgcccttttggttctggaccctcttggcttccacagatttgttttgttggttggttcttgccctgtgtgttttttggtgtctgatatagatactcatcaaatagattgatttagccatgtccagagatttttggcaatgagatcacaattgccaaaaccataaaactgacttaagtagagtcccatctttgagtagatacccatcttaaactcctgggtctattttgaggtttaaaaaaaaaaaatctgattagattcagagggtcatagatcattgggtaggttaagtgggaactttactgtggtctagtctaggaaagaattttttgaagatgagcctgaagtactgaatgctggaattcattcagtgaataagtatgatgttccagattatgtgctcattctgtgctctgctttggggacacagtgatgaataagacacagtcccttccattaaagatcttacaggctggcgaggcaccatggctcatgcctgtaatgccagtgctttgggaggcagaggcgagaggaccacttgcggccaagagtttgaggctgcagtgagccatgatcacaccactgcactctagcctgggtgacacagcaaaaccctgcctctgaaaataacaagatcttacgagctcatagaggactcaaaatagtaaatggggaggctgaggcaggggaattgcttgagcccgggatgcggaggttgcagtgagccaagatcgagccactgcactctagctgcctggacaacaagagcgaaacgctgtcaaaaaaaaaaaaggtaaatggggaaaatgctgtgatagaggttatatgccaggtgctggaggagcctgcagcaggaacatctaatgagaggggactttctggaggaggtaaggaagggcaggcacttgaggagagagagcagccgagattgagaaaagcatggtgtgattcaggaatggcaagtagtttatcaaggctgaagggcagaatgtgaggtggaggaatggaaaagagggggcctgaagtgtaaacaagggttagatcataggtggcttgactgtcaggggcaagaccagggcatctccattctcaaaaattgtctggaacagaagcttctcttccagtctggtttgggtcgggtgagtcctttggtttcacagcttgaaagattggtctttagagagccattctatatcaggattggtcagagaggaaccttcttgcctaaagttctgcttaaaatttgtgctgagttaggcctggtggtgtgtacctataatctctgctggaggatcgcttgagcccaggagtttgaggctgcagtggctatgattgtgccactgcactccaacctgagcaacagagtgagactctatctctaaaaaaataaaataaaaattaagaaaatttaggctgggtgttgtggctcacacctgtaattccagcactttgggaggtcaaggcaggagaatcacttgagcccaggaattggagaccggcttgggcaacatagtgatattttgcctctacaaaaaataaaaaaaaaattagccaggtgtggtggtacgcccctgtgatcctagctactcaggaggctgaagtgggaggattacttaagcccaggagatcaaggctgcggtgagccgtgaccatgccactccactccagcctgggcaacagagcaagaccttgtatcggccgggcgcggtggctcatgcctgtaatcccagcactttgggaggccgaggtgggcagatcataaggtcaggagttcaagaccagcctgaccaacatggtgaaacccagtctctactaaagatacaaaaattagccaggtgtggtggcatgcgcctgtaatcccagctactggggaggctgaggcaggaaaatcatttgaaccctggaggcggaggttgcagtgagctgagaatgtgccactgcataccagcctaggtgacagggcgagactccgtctcaaaaaaaaaaactaagactttgtatcaaaaataaataaatttgggctagactgctccctttctcattggactcatattttccctggcttctcctgtgccctaatccagacttctaagcaaggtctttgttttcctttacagctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 35625 - DNA, 17448 bp, Homo sapiens
  misc_feature (374)..(374): n is a, c, g, or t
  misc_feature (440)..(440): n is a, c, g, or t
  misc_feature (492)..(492): n is a, c, g, or t
  misc_feature (496)..(496): n is a, c, g, or t
  misc_feature (659)..(659): n is a, c, g, or t
  misc_feature (808)..(808): n is a, c, g, or t
  misc_feature (924)..(924): n is a, c, g, or t
  misc_feature (944)..(944): n is a, c, g, or t
  misc_feature (1623)..(1623): n is a, c, g, or t
  misc_feature (1671)..(1671): n is a, c, g, or t
  misc_feature (1984)..(1984): n is a, c, g, or t
  misc_feature (2002)..(2002): n is a, c, g, or t
  misc_feature (2032)..(2032): n is a, c, g, or t
  misc_feature (2072)..(2072): n is a, c, g, or t
  misc_feature (2823)..(2823): n is a, c, g, or t
  misc_feature (3184)..(3184): n is a, c, g, or t
  misc_feature (3467)..(3467): n is a, c, g, or t
  misc_feature (3583)..(3583): n is a, c, g, or t
  misc_feature (3585)..(3585): n is a, c, g, or t
  misc_feature (3741)..(3741): n is a, c, g, or t
  misc_feature (4114)..(4114): n is a, c, g, or t
  misc_feature (4724)..(4724): n is a, c, g, or t
  misc_feature (4728)..(4728): n is a, c, g, or t
  misc_feature (4734)..(4734): n is a, c, g, or t
  misc_feature (4762)..(4762): n is a, c, g, or t
  misc_feature (5058)..(5058): n is a, c, g, or t
  misc_feature (5250)..(5250): n is a, c, g, or t
  misc_feature (5669)..(5669): n is a, c, g, or t
  misc_feature (6281)..(6281): n is a, c, g, or t
  misc_feature (6453)..(6453): n is a, c, g, or t
  misc_feature (6457)..(6457): n is a, c, g, or t
  misc_feature (6473)..(6474): n is a, c, g, or t
  misc_feature (6487)..(6487): n is a, c, g, or t
  misc_feature (6504)..(6504): n is a, c, g, or t
  misc_feature (6507)..(6507): n is a, c, g, or t
  misc_feature (6536)..(6536): n is a, c, g, or t
  misc_feature (6538)..(6538): n is a, c, g, or t
  misc_feature (6541)..(6543): n is a, c, g, or t
  misc_feature (6547)..(6548): n is a, c, g, or t
  misc_feature (6551)..(6551): n is a, c, g, or t
  misc_feature (6788)..(6788): n is a, c, g, or t
  misc_feature (6814)..(6814): n is a, c, g, or t
  misc_feature (6827)..(6827): n is a, c, g, or t
  misc_feature (7400)..(7400): n is a, c, g, or t
  misc_feature (7416)..(7416): n is a, c, g, or t
  misc_feature (7630)..(7630): n is a, c, g, or t
  misc_feature (7685)..(7685): n is a, c, g, or t
  misc_feature (7760)..(7760): n is a, c, g, or t
  misc_feature (7795)..(7795): n is a, c, g, or t
  misc_feature (8000)..(8000): n is a, c, g, or t
  misc_feature (8111)..(8111): n is a, c, g, or t
  misc_feature (8557)..(8557): n is a, c, g, or t
  misc_feature (8567)..(8567): n is a, c, g, or t
  misc_feature (8652)..(8652): n is a, c, g, or t
  misc_feature (8688)..(8688): n is a, c, g, or t
  misc_feature (8832)..(8832): n is a, c, g, or t
  misc_feature (9274)..(9274): n is a, c, g, or t
  misc_feature (9470)..(9470): n is a, c, g, or t
  misc_feature (9540)..(9540): n is a, c, g, or t
  misc_feature (10114)..(10114): n is a, c, g, or t
  misc_feature (10224)..(10224): n is a, c, g, or t
  misc_feature (10230)..(10230): n is a, c, g, or t
  misc_feature (10715)..(10715): n is a, c, g, or t
  misc_feature (10963)..(10963): n is a, c, g, or t
  misc_feature (11484)..(11484): n is a, c, g, or t
  misc_feature (11529)..(11529): n is a, c, g, or t
  misc_feature (11871)..(11871): n is a, c, g, or t
  misc_feature (11978)..(11978): n is a, c, g, or t
  misc_feature (11984)..(11984): n is a, c, g, or t
  misc_feature (11986)..(11986): n is a, c, g, or t
  misc_feature (12862)..(12862): n is a, c, g, or t
  misc_feature (12865)..(12865): n is a, c, g, or t
  misc_feature (12868)..(12868): n is a, c, g, or t
  misc_feature (13369)..(13369): n is a, c, g, or t
  misc_feature (13381)..(13382): n is a, c, g, or t
  misc_feature (13780)..(13780): n is a, c, g, or t
  misc_feature (13921)..(13921): n is a, c, g, or t
  misc_feature (14013)..(14013): n is a, c, g, or t
  misc_feature (14050)..(14050): n is a, c, g, or t
  misc_feature (14056)..(14056): n is a, c, g, or t
  misc_feature (14059)..(14059): n is a, c, g, or t
  misc_feature (14073)..(14073): n is a, c, g, or t
  misc_feature (14134)..(14134): n is a, c, g, or t
  misc_feature (14179)..(14179): n is a, c, g, or t
  misc_feature (14258)..(14258): n is a, c, g, or t
  misc_feature (14533)..(14533): n is a, c, g, or t
  misc_feature (14860)..(14860): n is a, c, g, or t
  misc_feature (14884)..(14884): n is a, c, g, or t
  misc_feature (14964)..(14964): n is a, c, g, or t
  misc_feature (15134)..(15134): n is a, c, g, or t
  misc_feature (15231)..(15231): n is a, c, g, or t
  misc_feature (15233)..(15233): n is a, c, g, or t
  misc_feature (15261)..(15261): n is a, c, g, or t
  misc_feature (15337)..(15337): n is a, c, g, or t
  misc_feature (15414)..(15414): n is a, c, g, or t
  misc_feature (15590)..(15590): n is a, c, g, or t
  misc_feature (15598)..(15598): n is a, c, g, or t
  misc_feature (15718)..(15718): n is a, c, g, or t
  misc_feature (15868)..(15868): n is a, c, g, or t
  misc_feature (15900)..(15900): n is a, c, g, or t
  misc_feature (16338)..(16338): n is a, c, g, or t
  misc_feature (16446)..(16446): n is a, c, g, or t
  misc_feature (16605)..(16605): n is a, c, g, or t
  misc_feature (16704)..(16704): n is a, c, g, or t
  misc_feature (16739)..(16739): n is a, c, g, or t
  misc_feature (16889)..(16889): n is a, c, g, or t
  misc_feature (16929)..(16929): n is a, c, g, or t
  misc_feature (17174)..(17174): n is a, c, g, or t
cccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctgtgagcgccgggcctggcgggcgggcggggctcggggccgctgagccaggctcttgggacgcaggcacggcccggcagcccccggggtcgggacccccggcgcgcccggaactgaagggctcccttgctgcccgccttgggggccatgtcaggggctccctgggggtgagagccgggctgggagnccggggggccgtcccgatgcccgccctgcgcacggcaggatcttcctgttagtgcgagaagaacanggatcgacctgtgtgagcaaacagagcaagccagtgtccagccttgccgagntccntccccgggggccgacccggaaggcgccccgctcctgcccaccccaccttcagcttgccacagcagtccttccgatggtgtctcagaggagaatcccaagccttcctcacgtccataaggatttgagctctgtccctggggtgggaaccttgtgcctgacacangctgctaactctattgacagatcgtcttattctcaccctaagcaactcagggtctgtgtgcacggatgtgcatctcatactcacagctagtgctggtacaggccgccacggtcacttcttcacttttgtctgtagtcttaaagggaaangtctaggggagatccttgccttagttgcctgtggggaataagaagtcagcaaccattgaaaggtttgtctggctgtgctgatggtgacatagcagagtgggggctggtgttggttnggtggtagtttgtcgttcancggcctctgtcctgatattgcccaagaacaccaggctatcagctcagccttgtgcgttaggaggggttatcttggtgagtagataaggtttttatgaagggaaatgccagaggaaaaagggaagcactgctgagggatcaaggctgctttagggatcaaggctgctttctagcatctcatttccgcttccagatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggtgtggctgtggcactgcccttgaactgtctttagagagggactggcctgccgacttggaagggcaggggcagctgtctgagcggtggggaggccgggttccagaggcttggagggatcccgttcctcaggccgggttctctgtccacttgtgccctgagggtcttgtgaggagttttcatcctggaagaaccttcgaatggagaacctgtcttgtctggtgccatcctgggggcggctggctgaggtctgtttggagactgaccagcgaggagagggangactggtgcctttctggccacatgggctgtttgtgctgccccctgttncctaggagcagcagcatggctgtagctctcggggtgacacctgctagctgtcgtgtgtagcgtgccagctgccgcgtcacgtgcttgcgtgatttctcctcgcatcctctctgtgaggcgggcttttcccagacaaagggctgaggcttagagcagctgagtaacagcatcgagcctgtcggtagcagacctcgaatccaagcccgccctgctccgtctgtagcacgggccctcagctgctcgtctgccgcctctgaagctgccgtagtggaggccgagcccctgtgtagccagatcagtgacggtggcaaangaaaactcgtctataaanccggttctgtggcatgtcagatgctcatgntgggtagcccgaaagcagctcattccagtgttagcagggnttctccccttaagcaggtgtgccctgtcctgttctagtggcagcaactccgtggttgcctctcacttggctgttttgatgtttccttttgtccccttaagcaggtgtgccctgtcctgttctagtggcagcagctctgtggttgcctctcacttggctgttttgatgtttcctttttttttttttttttttttttttgagacagtctcgctctgtcgtgcagtggtgcgatctctgctcactgcaacctctgcctcccgggtacaagtgattctcctgcctcagcctcttgagtagctggggctacaggtgtgcaccaccacgcctggctaatttttgtatttttagtagagacggggtttcaccatgttggccaggatggtctcgatcgtgacctcgtgatccacccgtctcggcctcctagagtgctaggattacaggcgtgattgatgttctcattttttactcatgttcacttttggaacgggaagtgctctgtccaaagtcaccgtggttctgtcactaacactcaggtttgcagatgagatgagcactcctaaatccacttgtcactggtgaccgtcttgttagcactggtggaatccttctacatctgaatggggttttcccgattcggaccagggagtcaagttctaggagggaaaaaggagaggcatcattccttagcctcagtctcccaggaggaggaagtttctttcctgtcagttgaccgcctttggtggcataaaagntgtgtcatcttcttcctggtctgggaggcatggagggtgggccattggcgagaactcccgaaacgcctgggataagttaggaggcgcgggagtcaggtgggcggggcgtcagcctgttcccagaggtagaaaactggcactgagttttgagttactgtccacctctctaaaatgaggcctgctgtcagactcctgggtgagaacatgtgtttgatggatgtacatgtcaaagaaaatttagataacgcagaggacaggctgggtgcggtggctcatgcctgtaatcccagcactttgggaggctgagacgggtggatcacctgaggtcaggagttcgaggccagcatggccaatatggtgnaaacccccgtctctactaaaaatacaaaaattagccgggcgtggtggtgcacgtctgtaatcccagctacttgggaggctgacacaggagaatcccttgaacctgggaggtaaggttgcagtgagctgagatcgtgccaccgcactccagcctgggtgacagagtgagacttcgtttcaaaaaataaaatttttaaaatgcagagggccatcctgggcaacatggtgaaaccctgtctacaaaaaatacaaaaattagctagggctgggcacagtggttcatncccggtaatcccagcactttggaaggccgaggtgggcggactgcttaatcccaggagtttgagaccatcctaggcaacgtggcaaaaccccatctctacaaaaaatagaaaaattngngccgggcatggtggctcacgcatgtaatcccagcactttgggaggccgaggcgggcggatcacgaggtcaggagttcaagaccagcctggccaacacagtgaaaccccgtctctactaaaaatacaaaaattagctgggcatggtggcgggcgccntgtaataccagctatttgggaggccgaggcaggagaatcacttgaacctgggagatggaggttgcagtgagccaggatggcgccactgcattctccagcctggacgacagaggtagattccgtctcaaaaaaaaaaaaaaaaaagaagaaacattgctgggcgcagtggctcacctctgtaatcctagcactttgggagaccgctgaggcaggtgtatcacctgaggtcaggagtgagaccagcctggccaacatggggaaccctgtctctgctaaacatacaaaaattagccgggtgtggtggcgggcacctataatcctagctacgcgggagggtcaggcaggagaattgcttgaacccgggaggtggagngttgcagtgagccgagatcacactattgcactccagcctgagcaacaagagcaaaactccgcctcaaaaaaaaaaaaaaaaaaaagttagttgggtgtggtggcacatgcctgtggtcccagctacttgggagcctgaggtaggaggattgcttgagcccagaagttcgaggttgcagtgagccatgatcatgccactgcactctaacctgggtgacagagcaagaccctgtcttccaagaaaaaaaaaagggctgggattggtggctcatgcctgtaatcccagcactttgggaagtcgtggtgggcaaactgcttgagcacaggagttaaagaccagcctgggcaacgtggcaaaaccccgtctctacaataaatacaaaaatgagctgggtgtggtagcgtgcatctgtaccccagatactcaggaggctgaggttgggaagattgcttgagcccagtgggtggaggctgcagtgagccaagattctgccactaccctccagctgggtaacagagtgagcccctgtgtcaaaagaaaaaagaaaatgcagagagatcagagaaaaaaaatgggtttgtgatcctgttattcagagacagaatcaccnctcnttcccntctccactccccataaacacaaccacangtctcacgtacactggggtttaggaggcgggcggacggcaccgggcctcttccatggtgggagaacatcttacttaggttgattcaggtgtcctcagcctggctggcagagagcagagacgggagcaggcgcggcagggcaggcggcactccctgtttgagagtagaacctacatttgtttggggttagctggcagagaggctgatgacatcgtgaactggctgaagaagcgcacgggcccggctgccaccaccctgcctgacggcgcagctgcagagtccttggtggagtccagncgaggtggctgtcatcggcttcttcaaggtagagaccagagcattccagtcttccttccttccgtcatccattgaggaggggtccacagcctgcagctggcagttctgcacgtgtcccccctggcctgggctctacagggtctgccctactgcttggtgctgcgggatcatgacgacctctgcttctccctncctcattcaggacgtggagtcggactctgccaagcagtttttgcaggcagcagaggccatcgatgacataccatttgggatcacttccaacagtgacgtgttctccaaataccagctcgacaaagatggggttgtcctctttaagaaggtgagtggccccaggcagctctgcccaggttagttctggggttggtctgcagagggtggcgttgctctccttatcgttaagggaaccttgctcctggcacctttggcccaataggtatgttctgcagctttgccaagttggggtgttgcgctgatgcctgtggcctggtcttcgcattcagctgtgggctttctggccactctcctgccacagccgcctcagaactgcttttgactgttagcttttttttttttttcaattatgataaaancatgtaacaacatttgccctttttttttttttgggagagtcttgctctgtcacccatgctggagtgcagttgcgtgatctcggctcactgcaccctccgcctcctgggttcaagtgattctcctgcctcggcctcccgagtagctgggactacaggcatgcactaccatgcccagctaatctttgttttagtagagatgagatttcaccattttggccaggatggtatcaatctcttgacctcgtgatccacccacctcagcctcccaaagtgctgggattacagatgtgagccaccgcgcctggccccgtttgccttttttttttttgagatagggtttctcactctgccgcccaggctggagtgcggtggtgcattcttagctcactgcaacttctgcttcccaggctcaagtgatcctctaacctcagcctcccgagcagctggaactacaggcgcgtgccaccacgctgggctgagtttttgtattttttggtagacatggggttttgctgtgttgtccaggctggtcttgaactcctgagctccgagtggtctgcctgcctcagcctcccaaaatggtgggatcacaggcgtgagccaccgcgcccnggccacgttttaactattctaaagtattaactacattcagagcgtcctgcagcatccctatttccagaacgttttccttacccagaggtctggagtattggcgctctgggcgtgttcccacccaggtggcacccacacttcgtatgcccctcagccccaagggcattatgancccntaaggatccactgtgnnaaaactgccatcntgatcccgctgtccttnctnctggggaagggctcctggacagtgtggcntnttnnncgcnnctncccgttaccaggacacagcagggtccttgtttgcacagtgtcaagatggggcctgtgggtttctattgtctcttttctcggtcaccaggcaggtggggctggggccgcacacttgtgctctagggacagctgaacctggatgtgggtgatggtgggtttgtgccgctcagagccagggtagtgtggataggagagaaagtctcgggagaggagggacctggggagtgaggggcaggnagggcggccgggggcgatcggacctntcagctcctgtcntgtgtcgtttccagaggggagaagaaccttttagacagcagcatcataagccaaacggtcagacgggcagcctctgggattggggctgagtggttttggacacaaggaacccattcactttctttttttttttctttttctttttttgagacagagtctgtctctgtcgcccaggctggagtgcagtggcgcgatctcagctcactgcaagctccgcctcacgggttcacgccattctcctgcctcagcctcccgagtagctgggactacagggcacccgccaccacacccagctaatttttttgtatttttagtagagacggggtttcaccgtgttagccagggtggtctcgaactcctgacttcatgatccgcctgccttggcctcccaaagtgctgggattacaggtgtgagccaccgacccattcactttctgtagtaagcacggagcatccagcactccccgggaccaggtaggagggagggtagagccagcttcctggagcgcggtggtgcgggtgggtcaggatggcttgcttccatgttcttgttcttgtcatttagctgttttngcagccacttcctcanagataactcaagacagtagatgctctttaccaggagacattctcttgatgtcccctgaagggaagagagttgctaaattagtctattgccattgcaaggtgcccaggaaattaaacctctgactagaaaaagccagtgaagtgttggataaagttgaaggaaccaaaggtctttttagagcttttattaaagagaaagttccaagtcttgtccntgaaacttgggttctggggcagactttctccagagcccacgaaactcgcgaaccnctgtgttgtcacacagcccacagctccttcagtgccctggatgtctgcagtggccgctgtgactctatggacagntttggtgatatgtgtccgcgaaggctgggagggtnggtttcgttgctcttgcctgcaaaggctcacacgtggccatccatgtgggctccccacaggttaacgttctgtctccattctctggagtccactagagctgggcacagacaaacccacttgggtttgatgccagttggtgggtggcgctttcctgcccactgaaggtggctcaggtgtctgtgatggcgaacgtggtcgttgcanggcagctccgggcagaagcccggccccctgtccggtgcacgtggtaggggctgccctggaagtcagagctcaccccgcagctgagaggatgagtccaacttgttccttttnccaccaggctgttaacccccatccctcaaagtgagtgaggccttcctgtgtgtgcagtggccacagtgggcagcctggctgagtcgggtgctcttgtgtggcccgctcttgcctgctcttcccttccttccctagcaggcactgcaacccaggaaaacctctgcgggggctgctggtcactggcaccatgggtgtgagagcttctgatatttcactttttcttctcccccagctggcagcactgggcctgttattgttgtttgagaaagggtctcgctctgttaccaggctggagtgcggtggcacaatcacacttcactgcagcttcgacctcctgggctcaagcagtcctcccaccccagcctgctgagtagctgggaccacaggtgtgcaccaccgcacctggctattttttaatacttctgtggaaatggggtttcaccgtngttgcccagngctggtctcgaacttctgagctcaagcaatcctcctgcctcagcctgccaaaacattggggttacaggcgtgagccataccaccncggcctgcattgggcgtttctatgctgtttgtcacncgtggcctggcagggctggcctcctgctgctgtgccctgctaagtggaccagtttcccttaccgcagtagaccgtgattgagtgtggtgtagcatctctgctgaaacgatggcagccctgggacagctgcggcagtgtctcctncctggcttcttggcatgagatggtgtaggcggcgcctgacactctggagggagtcagagacattgttctgcaggggtggggggatttcgtttgcctgcagttgcggcccggcgttactcctgggcacagtgcgagcccacccgtgccactgggagcacggctgtgatcagcagctcatgttccaaaggattccctccaagggcctcctgaacttggcttttctgcctctccttacccgcctttgcccctctggggaagaggtagcaggcttagaagcctctgcccctcgggttcgggcagggtggttggtgcttgtgccctggtttaacatcagctccttggcagtcaggccaggccagggtggcccaggcacagcgtgcacaagagcagggagtggcacctggtctctaagttactctgcagacgcatacatggaaacggnccagtaagaaaggatgcgtgatttatttccccaagtctcatttaagaagtttgaggaggccgggtgcaggggctcatgcctgtaatcccagcactttgggaggctgaggtgggcgggtcacgaggtcaggagatcgagaccatcctggctaacacggtgaaaccccgtctctactaaaaatacaaaaaattagccngggcgtggtggcgggcacctgtagtcccagctactcaggaggctgaggcaggagaatggcgtgaactcanggaggcggagcttgcagtgagccgagaagcaccactgcactccagcgtaggcgacagagcaagactctgtctcaaaaaaaaaaaaggttcaaggggaccaggcttggtggctcacacctgtgatcccagcacttagggaggccaggacaagaggattgcttgaggccaggagtctgagaccagcctgggcaacatagtaagactgtctctacaaaaagtaaaaataaaataaatttttttggctggacacgctggctcacgcctgtaatctcagcactttgggaggccaaggcgggcagatcacctgaagtcaggagcttgagaccagcctgaccaacatggagaaaccccatctctaataaaaatacaaaatttgccaggcgtgttggcacatgcctataatcccagctacttgcgaggctgaggcaggagaattacttgaacccaagaggcggagattgcaatgaggcaagatcgagatcgtgccattgcactctagccagggaaacaagagcaaaactcagtctcaaaatagataaaataaaataaaataaattaaataaataagtatttnaaaaagtagttctgtccaggtgcagtggctcacacctgtaattccagcactttgggaggccgaagcaggccgatcacctgaggtcgggagttcaagaccagcctgaccancatggnagaaagaaactccatctctactaaaaaaacaaaattagccaggcgtggtggcgcgtacctgtaatcccagctacttgggaggcagaggcaggagaattgctttaacccgggaggcagaggttgcagtgagccaagatcctgccactgcactctagcctgggcaacaagagtgaaactccgtctcaaaaaaaaaataaaatagtttgggccgggctcagtggctcacacttataatcccagcactttaggaggccgaggcaagtggatcacctggggtcaggagttcaagaccagcctggccaacatggtaaaaccctgtctctactaaaaatacaaaaattagccaggcgtggtggcgggtgcctgtgatcccagctactcgggaggctgaggaaagagaattgctggaactcgggaggtggaggttgcagtgagccgagatcatgccattgcactccagcctgggtgacaatagcaaaactccngtctcaaaaaataaaaaaataaataaattttaaaaataaataaaaaagtagttcgggggaatgatggaaggctcacccaaaattctcacttgaagagcctcagcacaggggcgcctctctgagcctgagccgaggccgcatcctcagctgcaggctgacccctcgtggttggggcgccacagcctctccatcttgtggccttaggactccctgaagctgccgtgcattattaggggtccccagggccnttacaggcacgtggattgcgcctttcaggatctgttgtattagaaactagaactaagaatgtaaaaaatcgtttttttctctctatttatttttattttttattttttgagatgaagtcttgctctgttgccaggctcgaatgcagtggcacgatctgggctcactgcaacctccgcctcctgggttcaagcgattctcctgcctcagcctcccaagtagttgggattacaggcacccgccaccacgcccagctaatttttgtatttctagtaaagacgacgttttaccatgttggattaggctgctctgaaactcctggcttcaggtgatccgcccgcctcagcctcccaaagtactaggattacaggcgtgagccaccacgcctggcctgtttcactcgtcacccaggctggagtgcagtggtgcgatctcactgcaatgtctacctcccagactcaagcaatcctcctgcctcagcctcccaagtagctgggattacaggcaggtgccaccatacccnaactgatttttgtatttttgtatttttttttttttttgagacagnagtcttgctctgttgcccaggctggagtgcagtggcacgatcttggctcactgcaacctctgcctcccgggttcaagtgtttcttctgcctcagtctcccgagcagctgggattacaggtgtgcaccaccacacccagctaaatttttgtatttttggtagagtcgaggtttcaccatgttggccaggctggtcccaaactcgtgaactcaagtgatccacctgcctcagcctcccaaactgctaggattacaggtgtgagccactgcacctggccttttttttttttttttttttttttttgagacagagtttcgctcttgtcgcccaggctggagtgcantggtgcgatctcggctcaccgcaacctccgcctcccgggtccaagcgattctcctgcctcagcctcccaagtacctgggattacaggtgcccgccaccacgcccagncttatntntttgtatttttagtagagatggggttttaccgtgttggccaggctggtctcgaactcctggtctcaagcgatccacccatcttggcctcccaaagtgctgggcttacaggcctgagccactgtagccaaatttattttaaaagaataataatcccattacatgttatcataaatcacatctttacggaaactagtttgtcccagacaaaaacaatttagtgctgagtgatgttttagattcctccagcaggattctcctctcctgccctcctgctcttgcgacaccatgcgcccagcagcctctgtgggtctgtgccgcagcacgtgagagggagagtgaaaaggcagaggccagagaagtgtgagtgtgaaaatagctttgaccagccgggcgcggtggctcacgcctataatcccagcactttgggaggccgaggcgggcagatcacgaggtaaggagattgagaccatcctggctaacgtggtgaaacccatctctactaaaaataccaaaaattagccggtggtggcgggcgcctatagtcccagctacttgggaggctgaggcaggagaatggcttgaatccgggaggcggagcttgcagtgagtggagatcacgccactgcactccagcctgggagacacagcaagactccatcacaaaaaaaaaaaaaaaaagatcaagaccttcgtggccaacatggtaataccccatctcgactaaaaatacaaaaaaaaattagccaggcatggtggcaggcgcctgtagtcctagctactcgggaggctaaggcaggaaaatcacttgaacctgggaggcagaggttgcagtgagccaagatcatgccactgcactccagcctgggcaacagagncgnagnactgtctcaaaaacaaataaaaaagaaaatagctttgaccacatgggtgccctgaaaaggctaggggccctggggatgggccacacttcaaggttgctggaggaccacgtgcgccaggcttgcattgtggatgtgaagccagctgttgaattcacgggcagccataaggccgtgaccagagccagtcttactgtcgaggaacagccatgtcctgtacccattgctggacctgtggctcgaaaccccacgggagggcagggctgctggctgctgtgacttcccacgtccagggagacccgggcccaggggctgtgctcccagcagcaatgctcagtcagggccctctttctgtccacagtttgatgaaggccggaacaactttgaaggggaggtcaccaaggagaacctgctggactttatcaaacacaaccagctgccccttgtcatcgagttcaccgagcaggtgcggctgccctgcagcccccaggctggggatggggnaggagtgggttnnggggtggcatgaggctcccggtcaccactgctgtccagcgtctgacattggaggccattgggagaatcttctgcattaatagtgtgtgactcagacccagtaacttaagtttataacacagacagccccgaagatttttggaggtgaaatcaagactcacatcctgctgttcttgcccaagagtgtgtctgactatgacggcaaactgagcaacttcaaaacagcagccgagagcttcaagggcaaggtgagctgctcttctgggtggctcgtggggcggtgccagggagcagtacaactcttcccgaggtgacaagtgtggggccttcctgaggctgcctgctggactggatcgggcacctgattcaggacagcctggatgtaggcgaggggccagnccaggccagacctctgctcccagtcacctgctggtctggttgggcaaccccggaatccaggttggaggaaaaaggcaccggagcacggtctgcttccgagcaaagtcagggctggaggcagaggccagccgtctcccgcancctgtgcaacctccttttctcccccagatcctgttcatcttcatcgacagcgaccacaccgacaaccagcgcatcctcgagttctttggccntgaagaaggaagagtgcccggccgtgcgcctcatcanccctgnganggaggagatgaccnaagtacaagcccgaatcggaggagctgacggcagagaggatcacagagttctgccaccgcnttcctggagggcaaaatcaaggtgcaggcgcgtccccgggccagnggctgcctcccgggtagagccgccaccttggggtctctgggctctcagtgtcctgggcttcgtcctcaaagtaagatcnttcagagtaagaggacggagcccaagatggtgtgaagaccaccattcttgtcacacctttggggacctgtaggagccctcttgtccacacggctggcccagatgctcctcagggaaacctcctggccggcgagggtgcggcctgcgtgggctcattgggcccagcccactggcccagccttctctttctggattcttggcactgttggtgtctgcggctgccaccctggtgtgcccagggcagccacgcacctcagtcccgggcagggtgagggnttggggagctctgtggtcccccaggcatcgccgcccctcaccgtgccctgcctgccctccagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgccaccagggcacgcgcaaggtaggcagactcctggggaagcgtctgccagtggctttgtgtccaggacacaccctagaactgctttcttttcagatgccccatggtgtgngtcactgcaaacagttggctcccnatttgggataaactgggagagacgtacaaggaccatgagaacatcgtcatcgccaagatggactcgactgccaacgaggntggaggccgtcaaagtgcacagcttccccacactcaagttctttcctgccagtgccgacaggacggtgcgccttccctccagacggggctggggcgggctctgggaagagcagtggtccccacgccagcctgggtgcctctctggaaggagcctggggctagtcaggtgnggagaagagctgtgggagctccttcagaagcacccacctttgtttttcgagagagatgggatctcactatattgcctaggctgtttttgaactcccnanatgtgctggattccgggtgtgagccacncggaccgggcctgctctgcctttctctagggaggaggagccaatgccaggagattggctctgggccgggaccagcnccctgcactcatccctgtcttccacaggtcattgattacaacggggaacgcacgctggatggttttaagaaattccntggagagcggtggccaggatggggcaggggatgatgacgtgagtggggtcacagccctgggctggtctctgggattcagccccttggccccacgggacatgcccacttgggctcggcttgtgatgggaatggtgccattggaggcacgtctgtgcgtccagggctctggggccccnacaccttncgcccagcagggcaagggatgtgctcccagtgctctgctgaaacagctctccctggccagcacttctttaggggacgacgttgaaggcatctttaaaaaccagattttgcttagaaaacncttttcagacacatggcaccggttcctcacatgctgctaacttggactcagaggtccatccccagcccgctggcggggcccgggcacaagggcgcagacatgggtctgccctcgggagtttagtcctgcccgtcagcgcgtggccagcangcagtggtgactctgccggggaagcaggaagngctggtgttgggaggatgcggcaggggcggggtgcttgaccatggtgaaggagatgagggcatggtcagcccaggctggcagggcctgctgggagtgctggtgcacagtgggaggtgggaatactctgcccaggctggggatggagggccggcccctggtgctgcctgtggcctgtcattggccagagcccaagggttggaagtagaatggtcacaccccagtggtgactgtgcctggacttcatgctggggctgttgtccctgccgagatgtggaccctctgtagactccatggtgccaagctgggagacacacatacgccttccatgcccagtggaagggtccaaggctgagctgggattcccagggttcctgacacagtgggggctctgattcatcctgctataggcagaaatcccccaggcgtcactcttcctngggaagacccctgtgtagctcgtaaagaccagggttggctgctccagtggccggtggccatgtccgccgtggccggctagtccccggtgtgagcagtgtggggtgctngggggccggcagcctcagctgttgcagccaacctgcccgccccgccccttttcctgtatcccaggatctcgaggacctggaagaagcagaggagccagacatggaggaagacgatgatcagaaagctgtgaaagatgaactgtaatacgcaaagccagnacccgggcgctgccgagacccctcgggggctgcacacccagcagcagcgcacgcctccgaagcctgcggcctcgcttgaaggagggcgtcgccggaaancccagggaacctctctgaagtgacacctcaccccntacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctacncgtgttcggagtctcgctgcctccctcccgcgggaggttntctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggangctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 35626 - DNA, 17355 bp, Homo sapiens
cccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctgtgagcgccgggcctggcgggcgggcggggctcggggccgctgagccaggctcttgggacgcaggcacggcccggcagcccccggggtcgggacccccggcgcgcccggaactgaagggctcccttgctgcccgccttgggggccatgtcaggggctccctgggggtgagagccgggctgggagccggggggccgtcccgatgcccgccctgcgcacggcaggatcttcctgttagtgcgagaagaacaggatcgacctgtgtgagcaaacagagcaagccagtgtccagccttgccgagtcctccccgggggccgacccggaaggcgccccgctcctgcccaccccaccttcagcttgccacagcagtccttccgatggtgtctcagaggagaatcccaagccttcctcacgtccataaggatttgagctctgtccctggggtgggaaccttgtgcctgacacagctgctaactctattgacagatcgtcttattctcaccctaagcaactcagggtctgtgtgcacggatgtgcatctcatactcacagctagtgctggtacaggccgccacggtcacttcttcacttttgtctgtagtcttaaagggaaagtctaggggagatccttgccttagttgcctgtggggaataagaagtcagcaaccattgaaaggtttgtctggctgtgctgatggtgacatagcagagtgggggctggtgttggttggtggtagtttgtcgttcacggcctctgtcctgatattgcccaagaacaccaggctatcagctcagccttgtgcgttaggaggggttatcttggtgagtagataaggtttttatgaagggaaatgccagaggaaaaagggaagcactgctgagggatcaaggctgctttagggatcaaggctgctttctagcatctcatttccgcttccagatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggtgtggctgtggcactgcccttgaactgtctttagagagggactggcctgccgacttggaagggcaggggcagctgtctgagcggtggggaggccgggttccagaggcttggagggatcccgttcctcagaccgggttctctgtccacttgtgccctgagggtcttgtgaggagttttcatcctggaagaaccttcgaatggagaacctgtcttgtctggtgccatcctgggggcggctggctgaggtctgtttggagactgaccagcgaggagagggagactggtgcctttctggccacatgggctgtttgtgctgccccctgttcctaggagcagcagcatggctgtagctctcggggtgacacctgctagctgtcgtgtgtagcgtgccagctgccgcgtcacgtgcttgcgtgatttctcctcgcatcctctctgtgaggcgggcttttcccagacaaagggctgaggcttagagcagctgagtaacagcatcgagcctgtcggtagcagacctcgaatccaagcccgccctgctccgtctgtagcacgggccctcagctgctcgtctgccgcctctgaagctgccgtagtggaggccgagcccctgtgtagccagatcagtgacggtggcaaaagaaaactcgtctataaaaccggttctgtggcatgtcagatgctcatggtgggtagcccgaaagcagctcattccagtgttagcagggttctccccttaagcaggtgtgccctgtcctgttctagtggcagcaactccgtggttgcctctcacttggctgttttgatgtttccttttgtccccttaagcaggtgtgccctgtcctgttctagtggcagcagctctgtggttgcctctcacttggctgttttgatgtttcctttttttttttttttttttttttttgagacagtctcgctctgtcgtgcagtggtgcgatctctgctcactgcaacctctgcctcccgggtacaagtgattctcctgcctcagcctcttgagtagctggggctacaggtgtgcaccaccacgcctggctaatttttgtatttttagtagagacggggtttcaccatgttggccaggatggtctcgatcgtgacctcgtgatccacccgtctcggcctcctagagtgctaggattacaggcgtgattgatgttctcattttttactcatgttcacttttggaacgggaagtgctctgtccaaagtcaccgtggttctgtcactaacactcaggtttgcagatgagatgagcactcctaaatccacttgtcactggtgaccgtcttgttagcactggtggaatccttctacatctgaatggggttttcccgattcggaccagggagtcaagttctaggagggaaaaaggagaggcatcattccttagcctcagtctcccaggaggaggaagtttctttcctgtcagttgaccgcctttggtggcataaaagtgtgtcatcttcttcctggtctgggaggcatggagggtgggccattggcgagaactcccgaaacgcctgggataagttaggaggcgcgggagtcaggtgggcggggcgtcagcctgttcccagaggtagaaaactggcactgagttttgagttactgtccacctctctaaaatgaggcctgctgtcagactcctgggtgagaacatgtgtttgatggatgtacatgtcaaagaaaatttagataacgcagaggacaggctgggtgcggtggctcatgcctgtaatcccagcactttgggaggctgagacgggtggatcacctgaggtcaggagttcgaggccagcatggccaatatggtgaaacccccgtctctactaaaaatacaaaaattagccgggcgtggtggtgcacgtctgtaatcccagctacttgggaggctgacacaggagaatcccttgaacctgggaggtaaggttgcagtgagctgagatcgtgccaccgcactccagcctgggtgacagagtgagacttcgtttcaaaaaataaaatttttaaaatgcagagggccatcctgggcaacatggtgaaaccctgtctacaaaaaatacaaaaattagctagggctgggcacagtggttcatcccggtaatcccagcactttggaaggccgaggtgggcggactgcttaatcccaggagtttgagaccatcctaggcaacgtggcaaaaccccatctctacaaaaaatagaaaaattggccgggcatggtggctcacgcatgtaatcccagcactttgggaggccgaggcgggcggatcacgaggtcaggagttcaagaccagcctggccaacacagtgaaaccccgtctctactaaaaatacaaaaattagctgggcatggtggcgggcgcctgtaataccagctatttgggaggccgaggcaggagaatcacttgaacctgggagatggaggttgcagtgagccaggatggcgccactgcattctccagcctggacgacagaggtagattccgtctcaaaaaaaaaaaaaaaaaagaagaaacattgctgggcgcagtggctcacctctgtaatcctagcactttgggagaccgctgaggcaggtgtatcacctgaggtcaggagtgagaccagcctggccaacatggggaaccctgtctctgctaaacatacaaaaattagccgggtgtggtggcgggcacctataatcctagctacgcgggagggtcaggcaggagaattgcttgaacccgggaggtggaggttgcagtgagccgagatcacactattgcactccagcctgagcaacaagagcaaaactccgcctcaaaaaaaaaaaaaaaaaaaagttagttgggtgtggtggcacatgcctgtggtcccagctacttgggagcctgaggtaggaggattgcttgagcccagaagttcgaggttgcagtgagccatgatcatgccactgcactctaacctgggtgacagagcaagaccctgtcttccaagaaaaaaaaaagggctgggattggtggctcatgcctgtaatcccagcactttgggaagtcgtggtgggcaaactgcttgagcacaggagttaaagaccagcctgggcaacgtggcaaaaccccgtctctacaataaatacaaaaatgagctgggtgtggtagcgtgcatctgtaccccagatactcaggaggctgaggttgggaagattgcttgagcccagtgggtggaggctgcagtgagccaagattctgccactaccctccagctgggtaacagagtgagcccctgtgtcaaaagaaaaaagaaaatgcagagagatcagagaaaaaaaatgggtttgtgatcctgttattcagagacagaatcaccctcttccctctccactccccataaacacaaccacagtctcacgtacactggggtttaggaggcgggcggacggcaccgggcctcttccatggtgggagaacatcttacttaggttgattcaggtgtcctcagcctggctggcagagagcagagacgggagcaggcgcggcagggcaggcggcactccctgtttgagagtagaacctacatttgtttggggttagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggtagagaccagagcattccagtcttccttccttccgtcatccattgaggaggggtccacagcctgcagctggcagttctgcacgtgtcccccctggcctgggctctacagggtctgccctactgcttggtgctgcgggatcatgacgacctctgcttctccctcctcattcaggacgtggagtcggactctgccaagcagtttttgcaggcagcagaggccatcgatgacataccatttgggatcacttccaacagtgacgtgttctccaaataccagctcgacaaagatggggttgtcctctttaagaaggtgagtggccccaggcagctctgcccaggttagttctggggttggtctgcagagggtggcgttgctctccttatcgttaagggaaccttgctcctggcacctttggcccaataggtatgttctgcagctttgccaagttggggtgttgcgctgatgcctgtggcctggtcttcgcattcagctgtgggccttctggccactctcctgccacagccgcctcagaactgcttttgactgttagcttttttttttttttcaattatgataaaacatgtaacaacatttgccctttttttttttttgggagagtcttgctctgtcacccatgctggagtgcagttgcgtgatctcggctcactgcaccctccgcctcctgggttcaagtgattctcctgcctcggcctcccgagtagctgggactacaggcatgcactaccatgcccagctaatctttgttttagtagagatgagatttcaccattttggccaggatggtatcaatctcttgacctcgtgatccacccacctcagcctcccaaagtgctgggattacagatgtgagccaccgcgcctggccccgtttgccttttttttttttgagatagggtttctcactctgccgcccaggctggagtgcggtggtgcattcttagctcactgcaacttctgcttcccaggctcaagtgatcctctaacctcagcctcccgagcagctggaactacaggcgcgtgccaccacgctgggctgagtttttgtattttttggtagacatggggttttgctgtgttgtccaggctggtcttgaactcctgagctccgagtggtctgcctgcctcagcctcccaaaatggtgggatcacaggcgtgagccaccgcgcccggccacgttttaactattctaaagtattaactacattcagagcgtcctgcagcatccctatttccagaacgttttccttacccagaggtctggagtattggcgctctgggcgtgttcccacccaggtggcacccacacttcgtatgcccctcagccccaagggcattatgacccctaaggatccactgtgaaaactgccatcctgatcccgctgtccttctcctggggaagggctcctggacagtgtggcctcttagccgcctctccccgttaccaggacacagcagggtccttgtttgcacagtgtcaagatggggcctgtgggtttctattgtctcttttctcggtcaccaggcaggtggggctggggccgcacacttgtgctctagggacagctgaacctggatgtgggtgatggtgggtttgtgccgctcagagccagggtagtgtggataggagagaaagtctcgggagaggagggacctggggagtgaggggcaggagggcggccgggggcgatcggaccttcagctcctgtcctgtgtcgtttccagaggggagaagaaccttttagacagcagcatcataagccaaacggtcagacgggcagcctctgggattggggctgagtggttttggacacaaggaacccattcactttctttttttttttctttttctttttttgagacagagtctgtctctgtcgcccaggctggagtgcagtggcgcgatctcagctcactgcaagctccgcctcacgggttcacgccattctcctgcctcagcctcccgagtagctgggactacagggcacccgccaccacacccagctaatttttttgtatttttagtagagacggggtttcaccgtgttagccagggtggtctcgaactcctgacttcatgatccgcctgccttggcctcccaaagtgctgggattacaggtgtgagccaccgacccattcactttctgtagtaagcacggagcatccagcactccccgggaccaggtaggagggagggtagagccagcttcctggagcgcggtggtgcgggtgggtcaggatggcttgcttccatgttcttgttcttgtcatttagctgtttttgcagccacttcctcaagataactcaagacagtagatgctctttaccaggagacattctcttgatgtcccctgaagggaagagagttgctaaattagtctattgccattgcaaggtgcccaggaaattaaacctctgactagaaaaagccagtgaagtgttggataaagttgaaggaaccaaaggtctttttagagcttttattaaagagaaagttccaagtcttgtcctgaaacttgggttctggggcagactttctccagagcccacgaaactcgcgaaccctgtgttgtcacacagcccacagctccttcagtgccctggatgtctgcagtggccgctgtgactctatggacagtttggtgatatgtgtccgcgaaggctgggagggtggtttcgttgctcttgcctgcaaaggctcacacgtggccatccatgtgggctccccacaggttaacgttctgtctccattctctggagtccactagagctgggcacagacaaacccacttgggtttgatgccagttggtgggtggcgctttcctgcccactgaaggtggctcaggtgtctgtgatggcgaacgtggtcgttgcaggcagctccgggcagaagcccggccccctgtccggtgcacgtggtaggggctgccctggaagtcagagctcaccccgcagctgagaggatgagtccaacttgttccttttccaccaggctgttaacccccatccctcaaagtgagtgaggccttcctgtgtgtgcagtggccacagtgggcagcctggctgagtcgggtgctcttgtgtggcccgctcttgcctgctcttcccttccttccctagcaggcactgcaacccaggaaaacctctgcgggggctgctggtcactggcaccatgggtgtgagagcttctgatatttcactttttcttctcccccagctggcagcactgggcctgttattgttgtttgagaaagggtctcgctctgttaccaggctggagtgcggtggcacaatcacacttcactgcagcttcgacctcctgggctcaagcagtcctcccaccccagcctgctgagtagctgggaccacaggtgtgcaccaccgcacctggctattttttaatacttctgtggaaatggggtttcaccgtgttgcccaggctggtctcgaacttctgagctcaagcaatcctcctgcctcagcctgccaaaacattggggttacaggcgtgagccataccacccggcctgcattgggcgtttctatgctgtttgtcaccgtggcctggcagggctggcctcctgctgctgtgccctgctaagtggaccagtttcccttaccgcagtagaccgtgattgagtgtggtgtagcatctctgctgaaacgatggcagccctgggacagctgcggcagtgtctcctcctggcttcttggcatgagatggtgtaggcggcgcctgacactctggagggagtcagagacattgttctgcaggggtggggggatttcgtttgcctgcagttgcggcccggcgttactcctgggcacagtgcgagcccacccgtgccactgggagcacggctgtgatcagcagctcatgttccaaaggattccctccaagggcctcctgaacttggcttttctgcctctccttacccgcctttgcccctctggggaagaggtagcaggcttagaagcctctgcccctcgggttcgggcagggtggttggtgcttgtgccctggtttaacatcagctccttggcagtcaggccaggccagggtggcccaggcacagcgtgcacaagagcagggagtggcacctggtctctaagttactctgcagacgcatacatggaaacggccagtaagaaaggatgcgtgatttatttccccaagtctcatttaagaagtttgaggaggccgggtgcaggggctcatgcctgtaatcccagcactttgggaggctgaggtgggcgggtcacgaggtcaggagatcgagaccatcctggctaacacggtgaaaccccgtctctactaaaaatacaaaaaattagccgggcgtggtggcgggcacctgtagtcccagctactcaggaggctgaggcaggagaatggcgtgaactcaggaggcggagcttgcagtgagccgagaagcaccactgcactccagcgtaggcgacagagcaagactctgtctcaaaaaaaaaaaaggttcaaggggaccaggcttggtggctcacacctgtgatcccagcacttagggaggccaggacaagaggattgcttgaggccaggagtctgagaccagcctgggcaacatagtaagactgtctctacaaaaagtaaaaataaaataaatttttttggctggacacgctggctcacgcctgtaatctcagcactttgggaggccaaggcgggcagatcacctgaagtcaggagcttgagaccagcctgaccaacatggagaaaccccatctctaataaaaatacaaaatttgccaggcgtgttggcacatgcctataatcccagctacttgcgaggctgaggcaggagaattacttgaacccaagaggcggagattgcaatgaggcaagatcgagatcgtgccattgcactctagccagggaaacaagagcaaaactcagtctcaaaatagataaaataaaataaaataaattaaataaataagtattttaaaaagtagttctgtccaggtgcagtggctcacacctgtaattccagcactttgggaggccgaagcaggccgatcacctgaggtcgggagttcaagaccagcctgaccaacatggagaaagaaactccatctctactaaaaaaacaaaattagccaggcgtggtggcgcgtacctgtaatcccagctacttgggaggcagaggcaggagaattgctttaacccgggaggcagaggttgcagtgagccaagatcctgccactgcactctagcctgggcaacaagagtgaaactccgtctcaaaaaaaaaataaaatagtttgggccgggctcagtggctcacacttataatcccagcactttaggaggccgaggcaagtggatcacctggggtcaggagttcaagaccagcctggccaacatggtaaaaccctgtctctactaaaaatacaaaaattagccaggcgtggtggcgggtgcctgtgatcccagctactcgggaggctgaggaaagagaattgctggaactcgggaggtggaggttgcagtgagccgagatcatgccattgcactccagcctgggtgacaatagcaaaactccgtctcaaaaaataaaaaaataaataaattttaaaaataaataaaaaagtagttcgggggaatgatggaaggctcacccaaaattctcacttgaagagcctcagcacaggggcgcctctctgagcctgagccgaggccgcatcctcagctgcaggctgacccctcgtggttggggcgccacagcctctccatcttgtggccttaggactccctgaagctgccgtgcattattaggggtccccagggccttacaggcacgtggattgcgcctttcaggatctgttgtattagaaactagaactaagaatgtaaaaaatcgtttttttctctctatttatttttattttttattttttgagatgaagtcttgctctgttgccaggctcgaatgcagtggcacgatctgggctcactgcaacctccgcctcctgggttcaagcgattctcctgcctcagcctcccaagtagttgggattacaggcacccgccaccacgcccagctaatttttgtatttctagtaaagacgacgttttaccatgttggattaggctgctctgaaactcctggcttcaggtgatccgcccgcctcagcctcccaaagtactaggattacaggcgtgagccaccacgcctggcctgtttcactcgtcacccaggctggagtgcagtggtgcgatctcactgcaatgtctacctcccagactcaagcaatcctcctgcctcagcctcccaagtagctgggattacaggcaggtgccaccatacccaactgatttttgtatttttgtatttttttttttttttgagacagagtcttgctctgttgcccaggctggagtgcagtggcacgatcttggctcactgcaacctctgcctcccgggttcaagtgtttcttctgcctcagtctcccgagcagctgggattacaggtgtgcaccaccacacccagctaaatttttgtatttttggtagagtcgaggtttcaccatgttggccaggctggtcccaaactcgtgaactcaagtgatccacctgcctcagcctcccaaactgctaggattacaggtgtgagccactgcacctggccttttttttttttttttttttttttttgagacagagtttcgctcttgtcgcccaggctggagtgcagtggtgcgatctcggctcaccgcaacctccgcctcccgggtccaagcgattctcctgcctcagcctcccaagtacctgggattacaggtgcccgccaccacgcccagcttatttttgtatttttagtagagatggggttttaccgtgttggccaggctggtctcgaactcctggtctcaagcgatccacccatcttggcctcccaaagtgctgggcttacaggcctgagccactgtagccaaatttattttaaaagaataataatcccattacatgttatcataaatcacatctttacggaaactagtttgtcccagacaaaaacaatttagtgctgagtgatgttttagattcctccagcaggattctcctctcctgccctcctgctcttgcgacaccatgcgcccagcagcctctgtgggtctgtgccgcagcacgtgagagggagagtgaaaaggcagaggccagagaagtgtgagtgtgaaaatagctttgaccagccgggcgcggtggctcacgcctataatcccagcactttgggaggccgaggcgggcagatcacgaggtaaggagattgagaccatcctggctaacgtggtgaaacccatctctactaaaaataccaaaaattagccggtggtggcgggcgcctatagtcccagctacttgggaggctgaggcaggagaatggcttgaatccgggaggcggagcttgcagtgagtggagatcacgccactgcactccagcctgggagacacagcaagactccatcacaaaaaaaaaaaaaaaaagatcaagaccttcgtggccaacatggtaataccccatctcgactaaaaatacaaaaaaaaattagccaggcatggtggcaggcgcctgtagtcctagctactcgggaggctaaggcaggaaaatcacttgaacctgggaggcagaggttgcagtgagccaagatcatgccactgcactccagcctgggcaacagagcgagactgtctcaaaaacaaataaaaaagaaaatagctttgaccacatgggtgccctgaaaaggctaggggccctggggatgggccacacttcaaggttgctggaggaccacgtgcgccaggcttgcattgtggatgtgaagccagctgttgaattcacgggcagccataaggccgtgaccagagccagtcttactgtcgaggaacagccatgtcctgtacccattgctggacctgtggctcgaaaccccacgggagggcagggctgctggctgctgtgacttcccacgtccagggagacccgggcccaggggctgtgctcccagcagcaatgctcagtcagggccctctttctgtccacagtttgatgaaggccggaacaactttgaaggggaggtcaccaaggagaacctgctggactttatcaaacacaaccagctgccccttgtcatcgagttcaccgagcaggtgcggctgccctgcagcccccaggctggggatggggaggagtgggttgggggtggcatgaggctcccggtcaccactgctgtccagcgtctgacattggaggccattgggagaatcttctgcattaatagtgtgtgactcagacccagtaacttaagtttataacacagacagccccgaagatttttggaggtgaaatcaagactcacatcctgctgttcttgcccaagagtgtgtctgactatgacggcaaactgagcaacttcaaaacagcagccgagagcttcaagggcaaggtgagctgctcttctgggtggctcgtggggcggtgccagggagcagtacaactcttcccgaggtgacaagtgtggggccttcctgaggctgcctgctggactggatcgggcacctgattcaggacagcctggatgtaggcgaggggccagccaggccagacctctgctcccagtcacctgctggtctggttgggcaaccccggaatccaggttggaggaaaaaggcaccggagcacggtctgcttccgagcaaagtcagggctggaggcagaggccagccgtctcccgcacctgtgcaacctccttttctcccccagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaaggtgcaggcgcgtccccgggccagggctgcctcccgggtagagccgccaccttggggtctctgggctctcagtgtcctgggcttcgtcctcaaagtaagatcttcagagtaagaggacggagcccaagatggtgtgaagaccaccattcttgtcacacctttggggacctgtaggagccctcttgtccacacggctggcccagatgctcctcagggaaacctcctggccggcgagggtgcggcctgcgtgggctcattgggcccagcccactggcccagccttctctttctggattcttggcactgttggtgtctgcggctgccaccctggtgtgcccagggcagccacgcacctcagtcccgggcagggtgagggttggggagctctgtggtcccccaggcatcgccgcccctcaccgtgccctgcctgccctccagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgccaccagggcacgcgcaaggtaggcagactcctggggaagcgtctgccagtggctttgtgtccaggacacaccctagaactgctttcttttcagatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtgcgccttccctccagacggggctggggcgggctctgggaagagcagtggtccccacgccagcctgggtgcctctctggaaggagcctggggctagtcaggtgggagaagagctgtgggagctccttcagaagcacccacctttgtttttcgagagagatgggatctcactatattgcctaggctgtttttgaactcccaatgtgctggattccgggtgtgagccaccggaccgggcctgctctgcctttctctagggaggaggagccaatgccaggagattggctctgggccgggaccagcccctgcactcatccctgtcttccacaggtcattgattacaacggggaacgcacgctggatggttttaagaaattcctggagagcggtggccaggatggggcaggggatgatgacgtgagtggggtcacagccctgggctggtctctgggattcagccccttggccccacgggacatgcccacttgggctcggcttgtgatgggaatggtgccattggaggcacgtctgtgcgtccagggctctggggctccacaccttcgcccagcagggcaagggatgtgctcccagtgctctgctgaaacagctctccctggccagcacttctttaggggacgacgttgaaggcatctttaaaaaccagattttgcttagaaaaccttttcagacacatggcaccggttcctcacatgctgctaacttggactcagaggtccatccccagcccgctggcggggcccgggcacaagggcgcagacatgggtctgccctcgggagtttagtcctgcccgtcagcgcgtggccagcagcagtggtgactctgccggggaagcaggaaggctggtgttgggaggatgcggcaggggcggggtgcttgaccatggtgaaggagatgagggcatggtcagcccaggctggcagggcctgctgggagtgctggtgcacagtgggaggtgggaatactctgcccaggctggggatggagggccggcccctggtgctgcctgtggcctgtcattggccagagcccaagggttggaagtagaatggtcacaccccagtggtgactgtgcctggacttcatgctggggctgttgtccctgccgagatgtggaccctctgtagactccatggtgccaagctgggagacacacatacgccttccatgcccagtggaagggtccaaggctgagctgggattcccagggttcctgacacagtgggggctctgattcatcctgctataggcagaaatcccccaggcgtcactcttcctgggaagacccctgtgtagctcgtaaagaccagggttggctgctccagtggccggtggccatgtccgccgtggccggctagtccccggtgtgagcagtgtggggtgctgggggccggcagcctcagctgttgcagccaacctgcccgccccgccccttttcctgtatcccaggatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 35627 - DNA, 17448 bp, Homo sapiens; identical to SEQ ID NO: 35625
  misc_feature (374)..(374): n is a, c, g, or t
  misc_feature (440)..(440): n is a, c, g, or t
  misc_feature (492)..(492): n is a, c, g, or t
  misc_feature (496)..(496): n is a, c, g, or t
  misc_feature (659)..(659): n is a, c, g, or t
  misc_feature (808)..(808): n is a, c, g, or t
  misc_feature (924)..(924): n is a, c, g, or t
  misc_feature (944)..(944): n is a, c, g, or t
  misc_feature (1623)..(1623): n is a, c, g, or t
  misc_feature (1671)..(1671): n is a, c, g, or t
  misc_feature (1984)..(1984): n is a, c, g, or t
  misc_feature (2002)..(2002): n is a, c, g, or t
  misc_feature (2032)..(2032): n is a, c, g, or t
  misc_feature (2072)..(2072): n is a, c, g, or t
  misc_feature (2823)..(2823): n is a, c, g, or t
  misc_feature (3184)..(3184): n is a, c, g, or t
  misc_feature (3467)..(3467): n is a, c, g, or t
  misc_feature (3583)..(3583): n is a, c, g, or t
  misc_feature (3585)..(3585): n is a, c, g, or t
  misc_feature (3741)..(3741): n is a, c, g, or t
  misc_feature (4114)..(4114): n is a, c, g, or t
  misc_feature (4724)..(4724): n is a, c, g, or t
  misc_feature (4728)..(4728): n is a, c, g, or t
  misc_feature (4734)..(4734): n is a, c, g, or t
  misc_feature (4762)..(4762): n is a, c, g, or t
  misc_feature (5058)..(5058): n is a, c, g, or t
  misc_feature (5250)..(5250): n is a, c, g, or t
  misc_feature (5669)..(5669): n is a, c, g, or t
  misc_feature (6281)..(6281): n is a, c, g, or t
  misc_feature (6453)..(6453): n is a, c, g, or t
  misc_feature (6457)..(6457): n is a, c, g, or t
  misc_feature (6473)..(6474): n is a, c, g, or t
  misc_feature (6487)..(6487): n is a, c, g, or t
  misc_feature (6504)..(6504): n is a, c, g, or t
  misc_feature (6507)..(6507): n is a, c, g, or t
  misc_feature (6536)..(6536): n is a, c, g, or t
  misc_feature (6538)..(6538): n is a, c, g, or t
  misc_feature (6541)..(6543): n is a, c, g, or t
  misc_feature (6547)..(6548): n is a, c, g, or t
  misc_feature (6551)..(6551): n is a, c, g, or t
  misc_feature (6788)..(6788): n is a, c, g, or t
  misc_feature (6814)..(6814): n is a, c, g, or t
  misc_feature (6827)..(6827): n is a, c, g, or t
  misc_feature (7400)..(7400): n is a, c, g, or t
  misc_feature (7416)..(7416): n is a, c, g, or t
  misc_feature (7630)..(7630): n is a, c, g, or t
  misc_feature (7685)..(7685): n is a, c, g, or t
  misc_feature (7760)..(7760): n is a, c, g, or t
  misc_feature (7795)..(7795): n is a, c, g, or t
  misc_feature (8000)..(8000): n is a, c, g, or t
  misc_feature (8111)..(8111): n is a, c, g, or t
  misc_feature (8557)..(8557): n is a, c, g, or t
  misc_feature (8567)..(8567): n is a, c, g, or t
  misc_feature (8652)..(8652): n is a, c, g, or t
  misc_feature (8688)..(8688): n is a, c, g, or t
  misc_feature (8832)..(8832): n is a, c, g, or t
  misc_feature (9274)..(9274): n is a, c, g, or t
  misc_feature (9470)..(9470): n is a, c, g, or t
  misc_feature (9540)..(9540): n is a, c, g, or t
  misc_feature (10114)..(10114): n is a, c, g, or t
  misc_feature (10224)..(10224): n is a, c, g, or t
  misc_feature (10230)..(10230): n is a, c, g, or t
  misc_feature (10715)..(10715): n is a, c, g, or t
  misc_feature (10963)..(10963): n is a, c, g, or t
  misc_feature (11484)..(11484): n is a, c, g, or t
  misc_feature (11529)..(11529): n is a, c, g, or t
  misc_feature (11871)..(11871): n is a, c, g, or t
  misc_feature (11978)..(11978): n is a, c, g, or t
  misc_feature (11984)..(11984): n is a, c, g, or t
  misc_feature (11986)..(11986): n is a, c, g, or t
  misc_feature (12862)..(12862): n is a, c, g, or t
  misc_feature (12865)..(12865): n is a, c, g, or t
  misc_feature (12868)..(12868): n is a, c, g, or t
  misc_feature (13369)..(13369): n is a, c, g, or t
  misc_feature (13381)..(13382): n is a, c, g, or t
  misc_feature (13780)..(13780): n is a, c, g, or t
  misc_feature (13921)..(13921): n is a, c, g, or t
  misc_feature (14013)..(14013): n is a, c, g, or t
  misc_feature (14050)..(14050): n is a, c, g, or t
  misc_feature (14056)..(14056): n is a, c, g, or t
  misc_feature (14059)..(14059): n is a, c, g, or t
  misc_feature (14073)..(14073): n is a, c, g, or t
  misc_feature (14134)..(14134): n is a, c, g, or t
  misc_feature (14179)..(14179): n is a, c, g, or t
  misc_feature (14258)..(14258): n is a, c, g, or t
  misc_feature (14533)..(14533): n is a, c, g, or t
  misc_feature (14860)..(14860): n is a, c, g, or t
  misc_feature (14884)..(14884): n is a, c, g, or t
  misc_feature (14964)..(14964): n is a, c, g, or t
  misc_feature (15134)..(15134): n is a, c, g, or t
  misc_feature (15231)..(15231): n is a, c, g, or t
  misc_feature (15233)..(15233): n is a, c, g, or t
  misc_feature (15261)..(15261): n is a, c, g, or t
  misc_feature (15337)..(15337): n is a, c, g, or t
  misc_feature (15414)..(15414): n is a, c, g, or t
  misc_feature (15590)..(15590): n is a, c, g, or t
  misc_feature (15598)..(15598): n is a, c, g, or t
  misc_feature (15718)..(15718): n is a, c, g, or t
  misc_feature (15868)..(15868): n is a, c, g, or t
  misc_feature (15900)..(15900): n is a, c, g, or t
  misc_feature (16338)..(16338): n is a, c, g, or t
  misc_feature (16446)..(16446): n is a, c, g, or t
  misc_feature (16605)..(16605): n is a, c, g, or t
  misc_feature (16704)..(16704): n is a, c, g, or t
  misc_feature (16739)..(16739): n is a, c, g, or t
  misc_feature (16889)..(16889): n is a, c, g, or t
  misc_feature (16929)..(16929): n is a, c, g, or t
  misc_feature (17174)..(17174): n is a, c, g, or t

SEQ ID NO: 35628 - DNA, 17355 bp, Homo sapiens; identical to SEQ ID NO: 35626

SEQ ID NO: 35629 - DNA, 2871 bp, Homo sapiens
ccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtacgtcctgggatccaggagcccaaccaggaagtggggggaagggtcgcacagaaggcgggcgcccgaggggtggcggggagcgaactctaaagacatggccagggaagcggcttaggagaggccagagcggggcgcagaggcagaacagaagtcaaactggtgggaggcgcctttagtgacctgaagtagtgagtctaggaaggggccgggggcagagggcaggaccaggctctcggcatctccgaggcggcggactcggatggagcagtttctgagtgacggcctccccgggcctgggcgtcaagggcgaaggccgaaagccggcgttagaaagaggaacgccagttcttaccgaagacctcaaggtcgcggcaaggagataactgcccgggggaggccatgcgcccgggtccagcggcctcccagcccgcggacgcgctcaaacctcgccgggccggaagccggcgccgggaagcgcgtgtgccttttacgtccgcccccgcgcagccgcggccgctgccgccgcgtctccgcctgcctccctgcgccgcgcgctctccagtgccggctctagagggcgctcctgggctagcgtgtagggctggcggcggcggcgctcgggtcacctctgggagcggagtgggggcggagcgagacggaagcagctcaggagacttgaggcgtaggctgcggtccccaaggtgaccgcgccctatgtgggactcgccctaatgcctctgaacctgggtttgaggtaatgacctttctcctaggtctgaaggtcacgggtccgctggaggatgccccctctccactcagaggggtggaggcttaatgctactggtgcagatcacctcttcccctgtgacagcctcagagggttgggagggtccagccagtatgatatacgaagactagatttgagagaggggagcctaccttaaagggcattgatcgagatggcataagctcttctctttcccttccccatggttataactgtccctgttggcttccttcctgtctgttaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtgggctttaacgttgtgttcttaggagacagtttaaaagagcattgtaccaacctaacagtccaagagctaaagagttgtttttttaattgctaaaggaagccaagatcatccaatgcaacccttgtgtacagatgacgtgtttaggggatgtggggaaaggaagtcagtaaaactctgctttttggtaaaagcatctctttcctattcccaggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaagtaagttccacttgagcagaagataaagttgtagtcgtggggcaatctgctgccacaaactggtgatacatacctttaaaatggctgtctgtccaagtcaagggatggggttgatagcatctgtgtctgttccacaactgcctttgagctggcccttcagatgcctatgaatgagggtgcttaaatggtgttagaggttaagaccaatgggtagtctgtattcctgtggtcatagcattaatatttcagtgttgcccatgctaatgtgtgaatgttggatttaaagctgacgttcttagaggtggggctctgctttatttagcctagtgaatcttaggatttttcatcggccttcagtcactaactccatgtctttattctttgcagctgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaat

SEQ ID NO: 35630 - DNA, 25507 bp, Homo sapiens
gttgcctgtctctaaacccctccacattcccgcggtccttcagactgcccggagagcgcgctctgcctgccgcctgcctgcctgccactgaggtatgtgtgacccccgcccagcctttcccttctatagttgcaccaaccccgacacccccgttcacgccgtcagctcgtgtgcaagggagggaagctctgctgaggatgcgcctctcctcccggctccatcacggctccccttaagagcatggccctcggtcctgtctgcctgttgcttttcagaaggtggactcactgtgtaactttgtcttcccttacaggtttacagaaaataatctcactatgtcttcgggggagcattttctcactctctgtttttctctgtgtctgtctctggtttcagaggctgcctgcctgtcctctttgctccctttgcaaatgtggcagcctcctcctttcctgggaatctgatcccatcacagctgccacagggacctggccagcaaccggagtctgtcctccagatctcggtcaggggttctgttttccaaaagggactttgcacgaacaatcagttgatctctgaaaggcaaagggggaggcttcaccattaatccacacctctgggaagccttctgttttcctctaattctcctcactcccaaacaccaccttccgtccccccaatacacaaatttcagcaccattctgcctgaaatggcaccatcacaacctcagtcttgggttaggtgttgttcctgtcctgagttccttgggatggtaaacacaggcagtagcccttagtttatctagatctgaaaacccagacatcagatatcgtcaaccaagacatgggtgtaatgggaggtggagtgtgctgggggagatattctcagaagggggaaagggggaagggaagagggagagaattccagggtccccttccgtaatccacccaagactagtgtccagcctgtcagggtgtcagttcttcttcagacaaatccactacctttcttcgccgccactggctccgtgaactggctgtcaagtggacttccttagggaaagggactccaaggactccaagggaaggggggcactgggatgagttatgtcttccaggattcccagtctgcccaaaagggaacagagaggcatgcattttcctcaggaaaggacagcatttttttcattagagaaaatgttttctctagtaatgctttagagttaaatttctatacgccccaagtgctggtggtttagtgagaagcaaagcagaagtaggacacaggcttcgggcatgcattttatgtgtgatcttaggtaagtgtctcccctggatttagtgccccatctgtaatgaaagaaggctgaaactgaaggctctttggggtgctttgtgtcctctaaaatattcaaaggaagatttcttaaccagggtctatggagtggtctttgaatgggcctcaagccatctctaagcccctaaaaattgtatgcactgtgtgtgtgtgtgtgtgtgtgtgtgtgtgtgtgtgagagagagagggagagagagagagagagaggatgaatatgggtggtcacagctttcagctttaagatattctcaaatggattagagggcatgacgtggggatggagtgaggactggtaacaaatgtgtgtatttgctggaggatgaagccttctgaaaagggagtggttgaggaaagagagagttaactctcagctatcagctgccacatcgacatagcctagagcaaagagggggagggaggagaagaagggggttgcctggagaaggaatcaacttttgaaactttctccaagtcccacccaccagaaggctcttctctgcctgactcactctccgaggaatgcgagttgccacggtaacctttttttcagggtctctgcctgctggctggaggggacccttgaaaccctctaagaacatcagtctgaacgtaccccacccccaaattcaaggcctgcagcaaattctaggccctgcccttgtgatctctcaggattccggggaagccttgggccatgataatctccttgcaagggtgtttgaagacctgggttttagctctggctgtgccctgaaggtaccatttgaccttgaactaatacttctttctgggccccattccctctacagttaaagaacagtaacagcagccacctctagggggtagatagtgtgtagaagaaatgggataatgcacagggaagcactttgcgaattgtggcattccctcataatgcaaagggttttagaactgatggattaaaggcatccaaagacctagtgaaatcattctcagctttttttttttttttttttcctggcagctccatcatcttggggtttgtatagaactttcctttactagaagtactgacaggaaaaattttaaaatcataatattgtttatcttcattttgatttggggaacttcttgtgtatttcccaagactgttgtgccctctatgtaggaaaagcattggccaagggtgaaaaaaaaaaaaaaaagtgtgttctaactcccagtgcctgacattgggaaagacacttcctctcttgaggctgcagtttcccaaactgttaaatagagtttctaagctagatgatttcccaggcacccttctaactctgaagtcctataaacctaaatcccagataccgcttttattcaaaggaatagcttgcctgcatttttaacaccgccttactgcacccccagttgaaaagaaaacaagaaaagatgggctaggggatcttgagttgcataaccatcatgctgtaatccttatccatctgtagagatttgtcaatcaacagtgtggctggggtttgctattcatgagagcagctttccttgctgaaaacaagctataaataagaaagaatggtgaaggaaaggaaagagctgaggatgtgaggtaaacagtagaatatttggcttttgaagttgtttatgtaggtagataaatatgcagagataaacagggacaggtacaaacccatagggatgaagagtataaacatcgatttcatcaacaggcacccactggctcagctaaaaataagtgcctcattacaggagcagacacagaaagtcattcactcacacacctcttcctggatgacaatgatttacagacaagttccaggaatatatctcaatgaatgtgaaaattctgaccctcgcctattacaggctgaaacagacagatgctaagtcaggctgtatgtaacttacacagacatgccatcaggtatacaaacacacaccgccacttgcagccacacatggatggatgtgcacagtcaaacatatgcacagtcaaacataatatggatcatgacaatgagacagacgtgtaacctacatttatcaccaaccacctctatgtctcagagagagagaaactgaggctcaggaagagaaaataactcactggaggtcacatagcaagctggcgtctgagccaaacttccacgtgtttggagccattttgatattcaccttgccttcccccccaatccccatttgttcagtttggaaacacacttatgcacacaagccccatggatactaagtggtgagcagcactttgtctctcccgttggctggcctgcaatgcctattccagcccacgtggctttgtcattaggcccaaaggccctgcatgatgtgcctgtaggcggctgctcccttgcttctagctggctccctcccaaacgtcagtttcaaaggagagaagggaaaaccagccttgagctttcagcaaccctgaggaccttgtttctacagcacagaccctgatgcctccctccctccctccctccctcccaacctcaatcctgaacccagggacagctgggctgtgcagggccagggccagcaagtagtgacttgacggaattatttagagaaacagcctctcctcaactggcagcttagacaggaaatcatctctgctctcacccatcaagctatagaactttatgtctgcaaggaaaacatgaacatagacaacaattgttgtcagagctggtttctttcagaaacttggtattaacttctctcatctggggatcactctgggtcatcttgatgttagtcatggcattaggatttcagacctatcagataaaaaaagcaaagcaaacatctggatgtttttgaacatctggaaatttggcttagacaccagcttgccgtgtgacctccagtgaggtattttccttctctaagcctcaatttctctacctctacaataagaggcagcacacagaggtttcatgtggcctgacaacatcactaattcatcggtagtggctgtcagaagaactgtgttcaggattctgatgactctctaagctttaggagaagaggtcaagcgattgattagtaatgtctgccacatgtgcaggaggggtaggtggaggccacgtgtttgtcacatatgccacatatttgctatctttgggatctcggaggcttttccagatgcaatagcctggacactttgatgttatttctcatcctttcatttgtggtcaccacaatgcagcagcggtgccctagagggagccaaggatgaagcctgaagctccaccccagcctctgctagccacagtgaaatgtggcatctcagatgtctttatggaatctcgggctgattccagccccaaactctggagccacctctgagttgccccagaagctctccagtcctaagttttagctaccacaccttaaaagtttcctttagcgtctttccttccagcaggaaatagaagtggaagcagggagtcaaggggcaagtggagagaggtaaggctctaaaaagcttctgcccaagttgatccggaaaatcagagctgaaaagaacctaaaggaccaccttgcctaagggttccatattgtgttcctaggagaaagtacagatgttccaaggtatcttagggaatgtccctgtgtgtaggactcccactcctcagctccactccacttttatctgcttttcttttttgtggatttttttgagagggagtttcactcttgttgcccaggcgagagtgcaatggcacaatcttggctcactgcaacctctgcctcccaggttcaagtgactctcctgcctcagcctcccgagttgctgggattttaggcgcccgccaccatgcccggctaattttttgtatttttagtagagacggggtttcatcatgttggccaggctggtctcgaactgctgacctcaggtgatctaccctccttggcctcccaaagtgctgggattacaggcgtgagccattgcgcccagcctgctcttgttttttaatttcacacttattgattaactagataatactcattcacatggttcagtacatgctaaaagatttcagctgtttgaaatatcggactctgcagaagacttcattgaaataaaggattttctggcttacataattttgagcactgaccttatacagacaagctgggggtgttagttctggagagcagaggagactcccctgaattcgcacagtgagctgggagacatgctgacttgctctcagctctcctgacttccacgtcatgaggccacctctgagctgctgtgtctgctcccaggggtgtgagcaggagtgccattgtagctgcatgtggccacctctctggcctgcctggctcggtccccatgtcagcagaccccaggctccttccgagtcccaactccctggagggcctggctcttggcttcctttattagcctctaggcttgttttcctctctttgggcttgtttaccagcaacatgtgtttttggagcccttgtttccaagccaaatagtgagagtgagatgcttggctggtatcagctgcccaagtaagaggccagccctgggcctggtcttcgtcactgtatcctctggaggctggacttacccagaccaacaggggcaatatgtcctttgttccacccaaacacccctttctccctgggcttataaagcactggaattttgcactgaattctttcgggggatggagattctgggaacctcggactttataagatgctcttcccaacgacaacattgcttacctctttatttggattctcttgtgtaaatcacccatgagcctttaaagattggtatgttattgtttccattttacacattggggaacaaattgaggccccaagaggtaaagttgatttctaaaggtcatacaattactaagtggtgagccaggatttgaacctgtatattctggctccagagcctatgagcttacctttatgctatactgcctcatagtttattatcactctgtctaccatggtagccactagccacatgtggctatttagatttaagttgattaaaatagatgggcatggtggctcacgcctataatcccacctctttgggaggctgaggcgggcggatggcttgaggtcaggagttcgagaccagcctgggcaacataatgaagccccatctctacaaaaaagaaaagaaaagaaaaattcgctgggtgtagtcacaagtgcctgtgatctcagctactcgggaggctgagatgggagaatcacttgagcccaggaggcagaggttgcagtgagctgagattgcgccaaccacactccagtctgggtgacagagggagaccgtgtctcaaaaaaaaaaaaaaaaaaaaaaaaaaaagatgttttccactattctctattgcagtatttcaacaaggtatgggttaagtaagatattttggattggcctcagtccttttgcataaaatttttaaataaaaaaattggttaaaatgaaatacaatttaaaactcagttcttcatttgcactggcaacatttcaagcattcagtaaccacttgtaaccagtagctatcatagtggaccacgtagatatagaatgtgttcatcatcttgggaagtcctgttgggttgcattactccataagttctttccacccaaataagatttaatgatggcaactcagtttctttgcttcacatcctaagtctatcattctgagacccacagtccatgattctatgattctgaggtatcccccctgttctaacgttcagtggctttttaacgtccaaggagagcccaaaggaggccctttatgttttgagggacaaacctgggggctggctgtacttttccatcctcagagtctttccagagagagaagtgacctcagcttcaggtcctgctggcagccaaggacgggttttcagcagtctccagagcaaataaaggcaaaaggaagggactcgatgtacggaacaggaggcagtggcggctgggagggggctaaaactgtctgcatttgatggccaccatgccaagggaaatatgccttctcttcctcccctggccctgggcattttccttcccaggaactcaggccagttcaaggcccaactgagccccattcaggtgaccacctgggagcgggtagctgccaagggaaatagtgtgcagaggtagagacataccagtggtggggtagggttgcacgggttctcaccctagccctgccacccagtcactcactcactgctgttagccgttggcagttttctcctttcctctaggccttggtcttctcatctgtactattgggcagaaatatgtgacttgagcccccagtggggtgctggattatgaaaacaccctgaaaatgataaatgtatgcatcatcacagactaaagaaatacaaaggagggagtttttgtttaatattggtcatttatatgaagggaatttaaattttcgccaggcacgctacacctaggtttgattggcaaaggatcacagctgtgagttctgaatgctggggtttgatactgtgttctgaccttgctggggtgactgttatactccattagctttgcaggatggacacagggctctttggtcagtggtagtttagagagcctcagagaggtatctcgtggggaggcagggagatggctgtgcatctggaatagttcagccgcttcccttccctcccatctcatcatctgggggaaaagtgctcttggactggtggtgtagcaccgggtgctgggcaggacccagattttgtgtttgtgtttacagttttcttccaaaacttttaaggtgtattccaagattttgcgttctgttcttaacagtctctctgcatttctcccccactcccacttgtctgagcgtaattcctattaggctcaccccaactccatgagtgagaacgcttgcctatttggagagggcctgaattgttgcatgactttggacaagtgcttcctccctctcaacctcagattccccattaggacagtgggactaagaacccttccatgcctgtctgcctacttcccagcattgtcagaaggctctaggagacagtgttatgtgacagtgctttagaaactatgaagcagcactataagacttagagttatttttctcttctggctgcaacagcagggatgggggtggcagggagggtgagtgtgcagctggaaaaggaattcaggaagatgaggaggcaggacagacagaagagccgcccagcgaaaccttcccctggtcacagaggggagcgcggttactctgctcatatgaaggacgcagactcagggaaatgtctgtcttcctgtctttctaatctgaagcttactacatttccagtcctagctgggctatttcttcaataacatgacttccctgtcattatagctcagacagggtaactttttgttttgttttgttttagctgctatttcactttgatccttcaacctcaaactatctcagacaagtccttccttgatgttttcttttctgttccatttgtcccaagccacatgcaggagttatttatcttgcgtcttccaaaaggggaagcaagaagggagatttttccacttaagcctggggaacaagtgaacaactgtgtgaggggaggaacattccacaagctgcctcaaaagggaagactagactcctctggaagttggggttattgtgaagcaataccaaacccccaggtcctttacatttctgttagttttacttcattcactctgtgcaatagggggtgaggttttgtgtctctttaagcccaagaaaggaccattatgaagtgggctcttcctctgcctgtttctgcttcccaaatgctatagtacaagtgaagacatatgatcccagaggagaccatatgtgtcaagaccagaatgtgcttggggtgtcttaagagcattttaaggaccgaggctgccacttcaaagttcacctagtctacccatttcaattgatagatgggggaaccaaggtctagagagaccaaaagacttgatactactgtggtagaacaagaccccctggcatttaatttcaagctgagtatttttctccatgatgccgggttacctcccaccaccatttggtcagttgagaagtcttggaagaaataagggatgatgagcctgacagggaggttttgggagaagaaagagggaagacatggccactgttgctcctgatggaaggttatttgtgggtagagagagcaggtttgttctttgtggctgcaggggagatggggtagacagatcagaaagtttgagggaggcacatttagatcagtaaaagaaagaactttctaaagtcacttgagaatgaaaagccatttagttagtgcaagaaatgaaatgtctccaccacagagcctctgttaggaatagcattttagttttgaatcctcagaggagatactgctccaaaatcccttatagtcatgagagtattagagtctagagcttggcatttagagaatgaggccttaacagttaccagaacagaggtattttctagatctcagctaacatcccctctgcaacacatggaagcatctggatggtttccgtacaggacctaaagaagtgctgtctcttctgggtagaatggagaaaaatgtggccaccctcaagtttccatgggttacattccaagactattgttctttgttttagaatgtggatctcattgtcccaaactggcaagaagttcctgcctattaacttctcccattgcagagggagtaggaaggagggggaggaggcgacagaggaggaagaggagagattgggtttagggaaaaaaataattttagaatatcagggattgaagggaccttgaagatgatctggtttggcattgcccaaacttaactagttagcccatcaccttagttgaatcactttgcaaaaactttaataaatgtattacaaaagcagattttatatcactaccataaatggaaaaaactctgtgtacctttgtcataaatagaaggaaactgtaaaaacaaacacataaaaaaaacaaaacaacttgattcagttccagctggatataacttcctgtggaagctctgagctggaggcttattctctttttgttaaaaaaggagatagatgagtataaaggaggtgtttaagacatcttggcaccaaactgagactttcttctcatataagcagaattgaaagaatattaaatggaaccaacctcctcatgtttttcactatcatttaacttgtaccatctaacattatcttgcacatatcaggaattcagaaggaaatctccataaggaagtctcaccctcactgaactctcaatctctcctccccatagggttcccagcaccatgagggcctggatcttctttctcctttgcctggccgggagggccttggcagcccctgtaagtacctaaatatcatgtcttcttgttttcattcctaccgctagcaccaggggttctgagcctgccagccctggatgctgaaagggaacagggacttccccatttcaagttagtggtcttttttttttcttaagttaggaagctcgggataaaaactgggatgaggaccattgggtggaggtatcagagaagagagagttccatgtaatgttagataaacttcttagtagtcagagcctcccagcaatgaactaggattgctttagaaggaaatgacctctttgtcatatgaggaattcaagcaggcaggagacaggatgtgggggatttctggtaggggtggtattagaagagattcaagctatagagagaggaatgtgttggcttctgaaacagtgagggttgtttggttgtaagcaacagttcaatctgactaaattggggaaggaggggaagatacagaggtagattataatattaaaggccttggggaggactggaaaagggcagctctaggctttgggagttaagaactaatggacagtctctgagatattgctgtctgaatgaatcaactccagcaattttcacatcttgagagaatgtgccaagaaggtttttataaattcaaaaaatgagagccaatctggctgagcttgggtcctgagccagcttcttggccaggtgagagtggggccccttgattgacagacagttcctcgaagcattgcatgcagggacaggagtagttatccacagctcatctggaagccttcacaaggagaggaggaagaaacagggcaggcaaaaagtgcaatttctttcaacctgtgatcccctcatcctctgtttactaagaagtgggagtgatggcagaccctggcaatcttgatcaggctggtagatggaggcaaaagtttctcaaagttggcattaagttttgaagcagctccagccagctaagggcctcaaagttgtgtgttttcttgcttcctcctactccaagttgaaatggcaagaaaaattgcctaataatactactaataatatcacactgtgaggaagatgatgacatctgttaaaattcacagtgtcatcccctctggatgtcaattttcctatctgtaaagtgaaagaattggtctggatcagtgattttcagactttataagaattcaaagcagcagaaatacttttccaagctaaatcttaggtagacacctaggatataaaatatataaaatgggagctgcttgagtgttccacggtgctcacatgactggcttcttctttgttctgtccctcaccatggcagtccatgaggcacaactttggggatctccagtaagctgctctccaagctcccctagcctgtatccgaggccacaggcactttggaggtgaagctggccttattcctgacccctctgaacgctactttctctttccaacagcagcaagaagccctgcctgatgagacagaggtggtggaagaaactgtggcagaggtgactgaggtatgtgggcagtgaccgcagccccttagcccctctctacctgtatctgtgccctgagaaattagggcggatgctgtgggtctcaatgctagagtggggcattcgtctccctgtacacacatagcatagatgcaaaccctgagtatatcccacatcctgacacactcctgaatgcttcccaaaccttcaacggaaccctacgtttggggaccaggaccttaaaatttttgttttttaagctatgcaacagttgttcttccatgattacccacagtttttgcaaacgtaaaacagaggaggccgggtgcggtggctcatgcctgtaatccctgtaatcctttgggaggccgaggcaggcaattcacgaggtcaggagttcaagaccagtgtggccaacatggtgaaaccctgtctctactaaaaatacaaaaaattagctgggcgtggtggcgggtgcctgtaatcccagctactcgggaggctgaggtaggagaatcgcttgaacccgggaggtggaggttgcagttagccaagatctcgccactgtactctaccctgggcgacagcatgagactccatctcaaaaacaaacaaacaaacaagcacacacacacacacacacacacacacacacacacacacacagaggaaaggggagatgcttgggtgtggctggcaggggtggaggcttgacaccctcttgtgaacatagatctcagtcaatttagaaagtttactttgccaaggttaagaatgtgcctgtgacacagcctcaggaagttctgagacatgtgtccaaggtggtcgggagtacagtttgctttcatacattttagggagacacgagacttcaatcaacatgtctaaattgtgcattggttgagttcgctaaggcaagacaacttgagaagtgagggcttccaggttagaagtagataagagacaaatggttgcattcctttgagtccttgatcagccttcccctgaatacacaatttaatctggctcagtgaatctgcatttttacataaacaataggggagaggaagcaatcagataagcgtttgtctcaggtgagcctcagagggatgactgcatagaataggaggcaggtttgtcctatgcagttctcagcttgacttttccccttagcttagtgattttggggtccaaggtatattttcctttcacactctctttccctaacacccctggtgacctctaaggcagctcaacagaatcccaggcatactgcaaaacacagcaggcctatagattaaatctggattcccaaccctgcgtttgtgctttctgtgacctggaacccttcagctacccttatgggtctgggatgggagtggggccatttcacccattcttctccctcaattccaggtatctgtgggagctaatcctgtccaggtggaagtaggagaatttgatgatggtgcagaggaaaccgaagaggaggtggtggcggaaagtatgtcccttccctgtaacttggcacatccaagctgcccttggctgcctgggcctggggcacgaggacagcctacatgaggctccttccagcagaaatgcagggtggggtcctcagtgggctatgaaggaaacacggctttgacttaacaagtgggaaactgtggcactcagtcccctgggatctgggcaagatcggtttccaggccatccatgtgtgtggtaggaaggagagttctccagctggaaatgggcttctcccctcatagctctttgccctgagtccaaagctgagtttcccagtcccacggaggtcgctgatcacatctggtcaccgaaatctcccattgcttctgtatcagcccgtgccccacagagaagtagaactgagagaagagatcaggaacttgcacactcataagctcattctatttcacacagtccaaggaaacgaggtcctgaggaaatgcaacctgacataatccgtaccatgctatccatgcgttagtgccctgggagagaaatgacctaggggctctggctccagccctaggtgcaaagcatttgtactcaaggggttaagagcaaggactttggaagcggtccaaccaagctttgaacctaggcttctccacgccagcttgcttagcatctcggagcctcagtttctcatctctcatatggggctgatgaagatggcagacccttgtcccagggctgccgggaagttttcagacaagctgagtaggcatccgctaaaggattattaaaacacccaaaataaagcattgcgaggaaaaggccacattaagctctcatcctgaggggatagctaatggtatttgatctagctgggcacagggtttctgttgaacagagggacatctactgagtcatgttccttcccgcctccacgcccacctcatccggtgtttaccaggctctattgtccagcatggactttgaggctcttctcccttttcctttactgccacttaagtctgttttgttgggcctcagctccctggctcagtgtcaacagctgactttctaagccattctagaaagcttattctggaatccagaaatgccccactgtgattgttcaatggagacccaggaacacaatggttgcttcaatcttcaggaaagccatatggtatctagtgtttctgggtcccagactgagcctccagccccccagaagtgcctgacctctatctcaagctaaacctctaatccccaggctgaaccagctgctgccctaaatgttgactgtgaggctcagtgcaagagcaggcaggactcagggctgtccaaagcccagagtgggggccacagtcaaggactgtcagccctgagatctgtccaggtaggatgggggtggatgtgctagtccaggtgatgctaactcccttgtctttctgccctacagatccctgccagaaccaccactgcaaacacggcaaggtgtgcgagctggatgagaacaacacccccatgtgcgtgtgccaggaccccaccagctgcccagcccccattggcgagtttgagaaggtgagggctgagagacaggggcagggggaagggattgggcacttcggaatacaggatgtctgctcaggaaactgttggcttggtggttctatggggcagtgccagtctcagaagtccccttgctagacctagtcccagcaggaaagaggggatgagtcagagtgctctgcctggcactggatcttttcagcaaccagcaagactttaaacagcaccatcaggttccaagccctgtgccagactcttagagctaagagtataacagcatcagcaaagaatcaggtccaaaaatacgggttctggggccaaactgaaggttgacttcaaacctcatctccatcacttattaggtgtgagatttaagctaagttgccgaaccttttcaggtctcagttttctcacatccaaagagaggataaaaatagtccttaactcatagatctgttgtggagatgtgtcagaaatgtttggtacataacaagtatccaataaatgctacttaattttaaattatctctcaaatatgtcccttctctccaataggatccatccatccgtccaagtaaatattttttgagtgcctgctcctgcctaccatcatgctagtggcagtctagctcatggcagcaaatctagggccagcactattcctacagcctcccatctggcttctccatcttcagtttctccagagactacatagcctctgggctccacattttaatatcattgttaacattttcctcctcctcacccctccccactcccagtgcccagtcaccagtgcccatcagttctccctctgcagtgacatataagctatactaaataagtacggacaggatgttcaacacaggctcccctcctcctaacacagctacttacggccactgcatgtccagccctcaacatctctgcttggccacccctatgttcagagatcgactaggactccattggctcagcatacagttgtactcacacctaaggtttagtacagcgacatattcaggatatacagctggatcgtaagggaaaaagacactagcagagtctggaggaatctgggtggagactgactgactcccaagaggggtcatcagagtgcattcttaccccagctacaaagaggcagccacatgtgagtgatgtttctttccagggaagttcattagagactcagcacccaaagttttaattggaggctggtcacataggtaccctttgcctagcatgcaccagaatttcacacttccagaaggaaagcagatgttcagcataaaccagattgtttgtacaaacagtccaggcatagcgagccactcttatcagttagggaaagatttacaacagtgcagagaactgtttcccagctaagttcccagacaccagccacaggctgaccttacaagcaggccttttctaaggataacaattccaggcctgctatgttaactcttctttgaacactcttgtttctctcccattcctgtctttaactttctcttcaaatatcttccaggatttttttccctatatctcagaactgactcagtcatgcctctgctcagagaccatcgatggctctcagcctgggctgagcattgacctgggaacccaaaaagtggatttgtggcccagccctatcactaactcactatatgacctcaggctaatgacattccttgcttaaccctcagtgtccccatctctgaaatggacaaggatattggtatcagcgaagggctttgggaatgaaggagggggtactctgtgctttgccaacaggtgtgcagcaatgacaacaagaccttcgactcttcctgccacttctttgccacaaagtgcaccctggagggcaccaagaagggccacaagctccacctggactacatcgggccttgcaaatgtgagtgtccttgggcccttccagactcctgtcttggggagagagctctgagctggcactgatgctgtctctgccacccccatgctgggtgatcttgggcaaatctctctccctttctgagtctcggcatccccatttataaaatgaggtaattgtctatgagttggctcctctcaactctgagttcagggcactttctggggaaggactgagcgattatggaaggtcaacatcagggaagatttctggagtctctcactagcatctgagacaactgcatttcatttctctaatgaggaagaatttcttctctcaggctaagttgaatctttcttgcttcaacactgtaaagcaaaaatgatgtttgacctgggcctacaaaatattttgaaaatatctgattttgaatgctttaaaataagggcatgcctgtcggtttgctttgggccctgttacttggtactgtcatatcttcacccttttactccattacattcctatctgccctccgaagagagaggataagcaccctcttctggaaacctgggagtcagttgtctggggagggatgccagggtgtggtctgatctttggttagtgaccccagctgcaaactcagtggggccaagtgccttgttcagtatcctccctatcatgggagacccccaagaccacacctgctccccctccaaggcaacatccacactgtgggtcttgtgtattctggcacccgatggcaatgaggagagccactcacctacctcaggtgtacagggtgcagaaaagtatgtagggggtgggaaacaaagttctcctcgtgggaccccaggtatgaaattgagaaggtacagagtagaaaaggagggttgggggaagaagcatgggtaggaagtccctgggcagcaagactagagagcctgtcttaaggagtctttatgaagtggctttgctttccctgaggcatgttgcccactcacttcaactcctaaggtttttatcaccagatattctctcccagaccccagctgatgatgaaggtagcctcacagaggggactttccctggttcaatgatgagggaagaacagacccctaagcccccaggtgaccacactgccctggatgctggatgaggctctgacattgtggccttgagcaagtcccttctctccatgctgacctctaataagtccagtacaaagtgtgaacctgggtcaggcgcggtggctcacgcctgtaatcccagcactttgggaggccgagtagggaggatcacttgagctcaggagttcgagaccagtctgggcaacgtggcaaaaccttgtctctggaaaatatacaaaaattagctgggtatggtggcatgtgcctgtagtcccagctactcaggaggctgaggagggaggattggttgagtccaggaggctgaggctgcagtgagccgtgattgtgccactgcactccagcctgggcaacagagtgagaccctgtctaaaaaaaaaaaaaagaagaaaaaaagaaaaaagaaaagaaaaggaaaagaaaagtgtggacttggatgaaatcttcaggtccaacatttgggattctaagttccaaagaccaggttggaatcatttctaagaaggttctggtggttacacattcctgagtcctctactccccactccctgccaagctgggcctgtggatagatgtgatccctcagcctcccagcttcaaacacctgccagtggttgacgtgaacaacatgggctcagtctcagctaggatcacacccaaagcccagcacccagtaaggtgcaggagccatccatttccctgagcagagcagattaggctgaggaaagcagcagccatgcctttgcacaatgcatttctagggcattcttcccacacataatctcctctgctcattgtcctgtgaagaaactgtggcctggagaggttgagccactgtgccaaggccaccaatgcaggtggtatgtgggtgggtgggggcctggggtggggagcacggcccaggcagggtctgtgctgaccgcccttgtgtttggaacctagacatccccccttgcctggactctgagctgaccgaattccccctgcgcatgcgggactggctcaagaacgtcctggtcaccctgtatgagagggatgaggacaacaaccttctgactgagaagcagaagctgcgggtaagtggtctctctggccttgctggccccgtgctggtgaagatccagtcccattcctagaactgggcccccagctgcagggcggcatcctgctccggagcgtgcatttacccctgagcaccaggacacgtacttctcttcctgcctttggaggctgtggtgcacattaacatcttagaggctctgagaagtcctgcagcagagacctgctccctttgcttaacctaacgttaaacaaaagagacacaaacagccctattcctttttcctttggagtctgtggatcttaagctttaatgagcatattaactaccccaagaagctgataaaatgcagattccttggccccatctcaggccactgaaacagtgtctctagaaagcaaggcccaggaagctgcattctaaatactccccaggtgatttatgtttattttatttttttgaggcaaagtctcactctgttgccaggctggagtgcagtggtgcgatctcggttcactgcaacctccacctcctgggttcaagtgattcccctgcctcagcctcctgagtagctgggactgcaggcatgctaccacacctggctaatttttgtatttttagtagagatggagtttcactgtgttggccaggctggtctcaaaactcctggcctcaggtgatctgcctgcctcagcctcccaaagcgctgggattacaggtgtgagtgtgtgcccggccttcgccaggtgattttgatgtgggtagctatatggagaattctttgaggtcatcccaggcttctatttttgtgaatgagatgctagtacccatctatgacacctccctcccctcgctgtgagctttggtctggctagtctctgcctgctctggccttctgggaggggtgggagggcccgactggtccagacaatctccatggacctcttgtcacacacagtctctactccctcaggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtaagaccccagaccctagagtgaacagagctcaaggctggcaggtgcactagctatggccagaaagcctctcagcagcctatactgctccaagccctggcatccacagtttgcctggggattggagcagaaggatgaggcatctggagaaaagatgtggacctgggacaaagaaaccgataagacactctcatgctgaggtgaaagtcagtaggagctcaaaatagctccataatcctgcaagtactaggcgtggatatctggataatgaaggagtgtgaattaagaaggagtaccaggctccaaggggtggcaggggacaaggttgggtcagccacacgccccctgtccttcagcagaacatccaggggcagagcagccacctggcactgtctaagccccctcctaaggctcagccccaatagggcccaactgaccctggaagttatccaaaaaagcctgtctattttgcaagcccccagtttgagggctcttgtcccttgtccaaacgagttatgaggccctgtgcaactgcactgccgaacaggcaggcagctggccagttagcaaatgcttatggagtgtgcattttgtgccctgcactattctaggcaggggattgaacagcagtcagagctggcatggtccttgccctcatggacttatactctgttcataacctgtcactaccttctgaacttctcttgtggtgatgaagtgagagcccctgctcagcctcagatggagcaagctacacctgcaccttcccagagtggttttttcttcgtccttgggttgtggaagcagagcatcacacagaggggaaaggaagggctgccctactcacatactcagggaacttcctctctaggatgttcacccctcgctctttgtccagcctgtgtgcctggagtctgccaaccctgccagtgatcctgagggctggggtctcctgggctctgggaatctcccggccacttctctcccaggcttttgccatggctgggatccaactgagtcactcattatggcagggaggggaaaagtcaaaggggaacatctggagctcaggcaaagcaatttgatcccactgcaacagagggcctggagggaggctttcagatggggtgcaagaacagcacatctgggaaaggggtccagcttgggcaaggggacccgcttcctcctcctcccatcccagggctgtaggtgaccttgcctgcatccctgcccctccctgggcctcagttttccaccagtacaatgaaggggaggagaatgttcctatcagttcaaacattgtgtgatttctttggtgagctgggtggggctgcgaggtctagaggttaagaagacaactggagtcacattgttccctggagatcctttgtggatctttagggacaagtagttgggggctctgggaaacaaagaaaaaaattatacacatgctctggagtctaaggccagcagggagaatagggagggaggacagtgggagagacatccaaagggcctccctctcagacattacaggatacacaagcaaagctctatgaagatggttagagctcccgttgaccctcactgccaatcccagtccctttccacattcctccccagaaggcagcactgtcaccagattggtgtgtcatttttagaccctttactaggcatttatagatgtataaatgtgtgtccatagacaatatacagtgctgtgtcatgctagattttgatctacccatagcagaagtgctgaattttgattttaagtttctgtgtccccagttctcagccaattaggaaacaatcaaatacaccaaacagacctttgtttttgagaccctgaaaccttagagctggaagggccgttagtaattatggccatctcctcctctttgctggaaggagaaactgaggttccgaatggtgcactgctgttctctgagtctcagagcagtcagtggcagagctaggggtagacctgggattctggctttttgtcctgctttaaatatcctttcctccatgctctggggcaggctaactccccggttgcctcccaaggctgggtgtggagcttttccatgcctcaggccctcccctgcctccttccctgcaggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagagtgagtgtctgaacaaagaagcaaggggcatgggcagaaacactgctcccagggtgctgggttgtcatccccccactctccgctctcttggtctgtctgttgtctgtcctctctgcctgtctctgctctctctgcctatttgactcctgtctcttgggcgtcttcctgatccttctctgtccatccaactgtccctctctctttcccttcctcaagcgttagcactcacccgtgctaaacactattttgggaactggcaggcacacagagaggaaacaggaagtgtaacttggcagcgtgtgtaagagacagggacaggccagagacagagagagcgagattcctccgtcactgacttcctgggtgaccttgcatggccacctagacccctgcccctggggatgggtgggagtccactgactccttgggaagtgcgttatcatcgacacagccttatttttaaccgtgctcttttcttgctttgcagaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatc

SEQ ID NO: 35631 - DNA, 73256 bp, Homo sapiens
gggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagtgagtctcttgctgtctctacttcgtcccctctcgccccgcctcttcccctacagtttggttgctgtggccctagggttgcatactcgcccatgagtatcctccccctacccagaccccagtgcctaattttactccttcacccaaaggccaggcttaaaaaaataaaaattaaaatattttaactaaaccaggaactgtttacatctctgccccttggcaacttaactgcagccctagctccaaaaacctctggtttttgccactcagagaagattcgtagtagtccttccttagatattttcagttccttttccttcgggaaagtggtaaaagaatccaaagctggccgggcgcggtggctcacgtctgtaatcccagcacttagggaggccgaggcgggtggatcacgaggtcaggagttcgaggccagccaggtcaagatggtgaaaccccgtctctactaaaaatagaaaaattagccgggcgcggtggcaggtgcctgtcccagctactcgggagactgaggcaggagaatcgcttgaaccagggaggcggaggttgcagtgagccgagaatgtgccactgcactctagcctgggagacagagcaagactccgtcacaaaaaaaaaaaaaaaaaaaaagaatctaaagccttatgtatggttttctttatgttacaaggcttctgctgaagtctagcgcagggggtccttatggcttccctaggccacactggaagaagaattgtcttgggccacacataaatacactaacactaatggtagctaatgagctaaaaaaaaattttttttcataaagttttaagaaagtttacagatttgcattgagtggcattcaaagccatcctgttgggcaagcttgatcttgaaggttttaattttgttgttgttgttgttgttacaaggtttcgctctatcgcccaggctgtagtgcagtggtcagatcatagctcaccgcagactctaactccggcttaagggatccttctgcctcagccttccaagtagctgggtttacaggcgtgtgctgccacacccaacgaattttaaaaatttttgtgtgtatgtagatggagtcccattatatcgcccaggctggatagttgtttttattaatatctctaaaagatttgaagggtaagaggagaaaatttcactcccttgaaataactttcttgctatgactttgtttcatattttggctgaagtcaaaatgtccgaagttgtgcacttgctgattggataatgtgtgtgatatcttaataatatgcctcattatttacagttctacacttaacaacatataataacgaactgctaatggtccagtatttcattgtgtatgacagtgtaacagccagttataataaatactttccatttttccccttggtatttttattttacagtgagaaaaggaaggaattttttaaagcaatctttcattctctggactgtataaatttagtgtttgtgattgtccttcactaaaaaagaatatcagtaatagagttgaccaaaatctagattaaataattttctatcattataattgttcaaaattgttaaagtaaaacttacaatggaaattctacaaacacgtttagatacaggttcatgtttttgagctagggcagtacagaagatggtgtatacaaagtgatgtttaaaaggttgatgggatttcctttagagagagtttggaggtaaaccctggagcttttttatcctgaagatgatggaacttgaatatccttgtcctctggactattctgttaactgttatctttaatctctgtggatctaatgtagaagcacccttgggtacaactagataccctagttgaggtaggggtaggttggaagtggggtacattaggaaaagaaaatctggaaaaggccattacctattcgtttcttctcttagaggatctgtcatcttgacaagggcaagacgtgctgtgttgagtttaatttttccccttggtattttaaagtgagaaaaggaaagaatttttttaaagcaactttacattctctggactgtataaatttaatgtttgtgattgttgtgcattaagaataagacctccaagcagtttttctttaaagaattaaaaaatacatacctcaatttaaagatatagtaaaatgctcaaatgccaaatgtacagttccaggtaaccaccacccacatcaatatacagaatgttcaatagaggcgtttttaaaaagcgacccttccaaccacatccaccaccattactactattctgtattgctgtgcatgtttttgaccctcacatataagtaattttacagtatgtaattttttatggttggcttacttcctcttagcagtttatgtgaatagctggtttgctattttcaagtagaaaaaatgtagtgaatgcaagtctatatggataaaacttttttgggaggccttgaaattcagagaaaaggtgtggatcatatattaggtattctgatgcattacatgagctatgcgaatgtgtaataggagataattcctaactccaccaatttaaaaatccttattatccacttaaaaggaatattttcttaaattccctttacttaaaatttaaatcctgttttcatttatatttgtatttcatttccacaaccctgccttcttggctgcacatgaaacatggtctaaagataatattgctctaaatagatgtaataggcttatctgaccaccttatgcgatagtgtttttagactccatctttaaaagacataaagaaactgtggtcagaaaactcaagataaatatgtaaatacagttaaaggagtcattatttactttcaagcacttgagcttggatcactcatcttctgcctgtcctagctaggcccaagacttttatttctttcatgtttttttcccattaggtcatccagtgccccaaattcaaatatgatcgttaagatatagcccaaatctctatttccagcccagatttctttaggctaatcttaattctaggagtctaattccaaatgcctactagtctgctcttgacatctttgcccactgtgctattggtttgttcatcagtttcactggtacatgttttctggaaaatattaccttgttggttacattggttgcttatcttttcctgttgcttatcttctcctagtgtatgtcttttttttttttttttttttggttgagacagagtctctgttgcccaggctggagtgcaatggcgcgatctcagctcactataacctctgcctcccaggttcaagtgattctcctgcctcagccttccatgtagctgggactacaggcgcccgccaccactcccggctaatttttgtatttttagtagagacgaggtttcaccatatttgccaggctggtcttgaactcctgacctcatgatccacctgcctctgcctcccaaagtgctgggattacaggcgtgagccaccgtgcctgaccgtgtatgtctgtttttatactgaaatttggtttgggtgtagtcaaatttattcatctttttctttacaatttgtgttctgggagtcttgtttaagaaatctttttctacccctaaatcacaaaggtattcacctgtgtttttgctaaaagttttaaacttatattcttcatattagggctttactcaacccagtacttactttttgtgcatgagaaagggatctactctcatttgttattattttacatacaaacaactatgttctagcaccatttattgaagagttaaacttgtttttgtggtttgtaatgtcacttatctcaaatcaggtttccacacatcctgggttgcttattctcttccattgctgtatttgtataacctctataacaataccatactgtcataattgctacaactatataagtaagtgttaatatctagcaagataagcttccccacctgttttcttcaaattgcattgtgaatgcctggccttgttactactctgtgaatttcagagtcctcttgtcaagttgtatgaaaaacttaactttttactgaaaattaattagggcctcagttttcttctctttgatatggtgataccagtggttatgactagatacaattaattttgtaatatactcaatgaatggttattatcattatcgtctttaccatcaatgaatgaccctttactctggctttcagaccttaaattcagcaattttactggtgaccacaatctcacattctggtacatttttactgccactaaacattctttgatttagttttgaaaccctgtctttttctgctctgtcagcccattcctggatttatttatttttctcattcctgacaaaagttgttcaaatcttcactattttatattaataattatgtcttctattaacattaccaggcttattttgagctcagatgaccttgatttttagttactagagaagcttttctcaccatcatctctacttggtcataatcccttctatatttagcttttgttctgttctccaaatctaactgctccctgtattctagagctgaatccctttaagaccttgctccatcagttacttctcaaattttaattttttttgttctttactggccctataaattgatgatttccaggcttttagatttcatcagccaataaatttttaaattgggaagtcaagataggtttgccaattttttatttggtcaagaaagggcatttaataacaatataacaaaacactactactgtctacttactgcaaggaattacatacagcattatagttaagactgtagactcttggagccacactgtttagactacaattctgattctactaggataaattatataacctgtaaaaatgtaggtaatacctacatcttaaggttgtgttgtgtatattcactgaattaagacatagatagcaattaaaacagtacctggcacatatacatgcatagttagtatgatatttcatcttcatcattttttttacctcattatcaactcatcttttttattattagctgcaccttgtttttttcacagtggttggtctagatctacatgatcaatgtaattatgtaatgtgtcaatactaataacatggctattgagtatgtaagattgttattaatataaaatgcttaaggaaccccatgcagatttctggagctctttctctagatgtggtttgtttgacccctccaagtctcatattgaaatttgatcccagctgggcacggtgacccacgtctgtaatcccagcactttgggaggctgagctgggcagatcacttgagaccaggagttcaagaccagcctggccaacatggtgaaaccccatctctactaaaaatacaaaaattagccaggtgtggtagcacatacctgtaaccccagctactcaggtggctgaggcatgagaatcacttgaacccgggagatggaggttgcagtgagctgagattgtaccactgcaaccagcctgggtcacagagtgagactgtctcaaaaaagaaaaagaaatttgatccccaatgttgttggtagggcctagtgggaggtgtttgggtcataggggtggttccctcctgaatggtttggtatagtccttgtgataattagttcttactctgttcgctcctgtgagaggtagttgttaaaaagagcctggggccgggctcggtggctcacgcctgtaatcccggcactttgggaggccaaggtgggtggctcacctgacgtcaggagttcgagaccagactggccaacatagtgaaaccccatctctactaaaaatacaaaaattagctgggtgtggtggcacacacctgtaatcccagctacttgggaggctgaggcaggagaatcgcttgatcctgggagacggaggttgctatgagccaagattgtgccactgcactccagcatgggccacagagtgagactctgtctcaaaaaaagaaaaaaaaaacaaagaaaaacaaagaagcctgggcatacccatacccctcacttctggcctttctctctcaccatgtgaactgtgtattcatgggttcctcttgccttctgccctcagtgtaagcagtctgaagatttcacaagaagcagatactggcatcatgcttcttgtacagcctgcagaaccatgagccaaataaacctcttatttaaataaatgacccaacctcaggtattcctttacagcaacccaaacagactgagacacatactacaaaagttaaatgtactggacttcttaacagtagctctggtagttaaagggcaattcttaaaatatctgaagaaaaactacctataatttagaattctataccaatccaaaccaagaacccattgtgaaactacaataaactcattttcaaacctaaaaggtttaaaaaatacacaatctacgcattctcttctcagaaagctaatagaggatgtgttccacctaaatgaggaataaactaagaaaaagtaggacatttgatcaaggtataagaaacccaaaataagagaaaggtaaaaggaatcacagattgatggattggaaaagtagatgaaattaatggaacaactaatatgctttaacaaattaaaaggatacttacagtggactataggttggggttaaaataatgattatcatatgagaaactaatcaattttttttaaaaaagaattattattaaatctgtctattcaacattttaaagagataaactttttttattagaacattttgattttggtgtttggtgttcttacttcccctttgtgtatgaggaactacatttggaactgccttgccttaaccccacagttttaagaggaagtccagcaaactagaaataaatggaaaactaaagaaacaaaactgggatctataaatcaataacatggcgaaactattttgaaatcaccttccataacactttgtggtactaaaaactaacagtatatagaattatctatatagccaaggtgggaggatcacctcaggccaggagtttaaggttacagtgaggtatgattatgcctctgcaccccagcctgagcaacagagtgagaccctgtcagtcaatccataataaataaataaacaagcaaacacatgatagaatagagtgagctctgaagaaagcttctcttttctataattctgtaagtgtatactgacataccacttttgcagtcattgactagacaaaagattatggttacaaagcacatatatgatatacataattgtatatgcatatgtgcataattaaaagcttaattccatagatctttgaagtttcttttgctattttggaagccatcttttttgccttagaaattccatggttactgtaatctataaatatagtcattaaataataaaataacaaggcagattcttattacctcagaagtttatggaactagctactccaagcaccgatgaactaggcatgaagaaggaacctgcataatgctttgcgatattgtagttgtgcacagaataaatgtgagatttaataatgttactttatatatttaactgtttatattttgcctctgagctactaaactcagagatagcattctgtgtgaaataatactattcagattaaaggcaccctgactgacatcagcaagttggtggattagtaggttccagccctcaaacccctgcagaaataccaaataccattttgggagcctgggagacctgctaagaggttccagcaccccagtagaatgaaaaactcaagaatagacacattgaagagggtaagaaaaacagtttcactttacctacatccttctcctccaaggcagcagagttcagtgccaagagaggcccttttggcccatgagttctcccaggaaggaaagtaagagtcaagtgagtgcccagcttccctagccttgcgtgttgccgcccaaaaggctcacttctgtttttccctatccagaatactgagggactcttcacagatgaatagtctaggaatatctaggagaagggaaaagaagcagaggcttatagcaaccaacacatgattcttcagagctagatgtggagtctcctaactggcttgcagactccaccataggctcacccatgagccctacaggacacttcacctgcagaacccctcaactgacaagcacacccagcactccatgcacccacccactagccagcagcccaacctcccctgcagatagtgtatgcaggccccagcagatagcacacagatatcagcaactggctcctgctggattggaagaaagcacacaaccttgaacactctgaggcactgcactagagaaaataaaaggaggttctcagcacatagtctagctttgtgagattgaaagaaagcacacaatcctaagacttcccctcccaagacagaacaagaggaatggaatgggcatatcatagaaaaggtctgagagaccttcagaatctctagtcaggctgactggtgaacgtctttcccttctgaagctagtcagtaaagactggaggaagtgactctttcttcagatgcaaagttagaagacaaggcttaaaagaacacacacacacacacacacacacacacaccaggaaaacatgacaaccaaaggaattaaagttctagcagttgaacacacacacacacacaccaagaaaacatgacaaccaaaggaacaaattaaagttctagcagttgaccccaaagaaacagagacctataaattacctgataaagaattcagaacactcaccttgaatctcagtgagctaaacgaaatcaggaaaacaatacatgaacaaatgagaatttcaacaaagaaaccactaaacaatcaaattctggctgggcgcggtggctcacgcctgtaatcccagtgctttgggaggccgaggcgtgtggatcatgaggttaggagatcgagaccatcctggctaacatggtgaaacgccgtctctactaaaattacaaaaaaaattagccaggaatggtggtgggtgcctgtagtcccagctactcaggaggctgaggcaggagaatggtgtgaacccgggaggcagagcttgcagtgagctgagatcgcgccactgcactccagcctgggtgacagagcgagactccatatcaaaaaaaaaaacaaatcaaattctgaaactaaagaacacaataactgaactgaaaaattcaaaagtgagcttcagtggcagattgaatcaagcagaaagaagaatcaatgaacttgaagacagatcatttgatattatccagtcaaaggaacaaagaggaaaaataataaagtaagcctacaggactctaaaccaatatgcgcattatagaagtggtagagcaagcagagaaagagaaaggaggcagattgcttatttaaagaaataatagcagaaaactgcccaaatctggggaggaaaatgaacatccagatccacaattcccaaagaattccatgtaggttgaacataaagatgtcttcattgatctttttgtggttcataagcatgatgattgggttttcataccattgtgtaagatgtgcctttctcagaccttgccaaaacactggcacattacctgtctgatatgaaaattttttcactgagacacattgtgatcaaattttcaaaagttaatgacgaagaatttgaaagcagcagaggaaagcaacttgtcatgtacaagggagctcctataagactttcagcaggtttttcagcaaaccttgcaagccagaagagaatgggatgatatactcaaaatactgaaagaaaagaaaagcctcccaactaagaataatttacccacaaagctgtcattcagaaaaggaaagatgaagacttttccacaaaaacaaaagctgagggagttcatcaccactagacctgcctcacaagaaatgctaaaactgaaactaaagttgaagtacttcaagtggaaactaaaggatgctaattagcaacatgaaaacgtgaaagtatgaaactccctggtaaagggaagtatagagttacattcagaatactgtaatgtaatggtgatacataaaatcatttttaactctgagttaaaagtattaaaaataactatagctacagtaatttgttaattgatgcacaatataaaaatgtaaattttgacatcgataacaatgtgggagaggacagatgagttaaagtgtcgagtttttgtatgagatctaagttgttattatcataaatgattagaatgtatccccaaactaattgtattatatacaatatatacagctttacatgtcaatcatacctaaagtagttatttttttaaattaacatgctctttccagaaccattactttatagtaacttggaagcttttactacattattaatggatatcaatagaatattttttaaagtcgaaaatgactttaaactttaaacgacaccttgtgtcgtttctgaacatcttcatttgatactcctagagatgccaaacctatttcttgtgaaaactgagcaaggaaataccaggatccccaagtagtggaacatgtcccaagagttcatcacacgtgtctctgacaagaaaaacatcacaaagaaccgttatacaagaagccttaaactaccactggtggtagaacaaaacttaaaatcccaaatataaccttgttactataataaaaatacttttaagtctgaatttcagattcatcttatcagcattttgagctgtatgataacacactattttaataaaatagccactactattttcaagtgcttactatatgccaaatcatggtgttttatttgtacattatgtgttttaattctcaagacaaccttaaagaattaaagtaacttattagtgcaagatcctatagagcagaccactgcctgtttttataaataaatttttattggaatatggatacactaacaaaagagattaaaggcatccaataataacttggtaatggctgatcttttaagaaaatacaggccgggcacggtggctcatgcctgtaaccccagcactttgggaggccaaggcaggtggatcacgaggtcaggagttcgagatcagcctggccaacatggtgaaaccctgtctctactaaatacaaaaaaattagccaggcgtggtggtgcatgcctgtaatcctagctactcaggaggctgaggcagaagaattgcttgaacccgggaggcagaggttgtaataagctgagatcgcagcactgcactccagcctaggcgagggagtgatactccatcacacacacacacaaaataaaattgaatttaaaaatatatatacatgttacagaaatctggaaataaacaatttaagaacataaataaaactaaatgcagtagacgcatttcctggttcctctgtgtcatgttaactttaaaaagaaacaacatattcaacatgttatggctattagcatcttttcagccacatttccttttgttctcataatttttatgcatattgttttttcctatttttgattaacactatgtttgacacatgatttctttatattagaaactttaaattccactcaatttctaatgtgaaattttcttaggtattagcaaacctattcaaagtaattttatttgctaccatagtatagtcctttattattttatgtttgggccatagcaacagtctaccagatatgtgacctctagcctccaactttaaaatattctatacaaagctttaagaatagtttttctaaatgaagttttttcaaagactttttaaagaatagctttaaatttacagaagaacagggcagaaaatacagattcccatatgtcaccctctaacccaacacacaccatttctcctattaatatcctgcattagtgtggtacatttgtcacaactgatgaaccagtactgctacattattaactaaaatccatagttaacattaggggtcactctgtgctgtatagttctatcaattttgacaactgcatagtgtcatgtgtccaccataatagtagcatacataatcattttattaccctataagtgccctatgctccacctatttacccctacctaacttatacccctgggtaaccaattatcttttgtctctgtagttttgccttctaaataaaattcttcctgatatttaaaacctcaatctctggagtagggccatatgtgtgaatgaaaaaagcaaattgtagaaagtatgtatagtatcctatttataaattttaaaaattacatgtatttgattatacatagaacatttctagaaggatacctagaaaaatgataacttctgaggaaaggaggagagacagtagatgaggccttttactttctagtatcttattttgtttgaatttctttccatatacgaatattatgattttaaatattttaattatcaacctaaaaatatctctggataaaaaggttttttcaaagcatgaaagcactagaaagcacaaaggaaaagttctagagattttaactgcacaaaaatattaaaattctgtatctcaaaagcatcataagatccaatccacctgctatttatctatgatgttctttattttttaattttttattcattattatttttgagaccgtcttgctctgttgcccagacgggagtgcagtggcgcaatctcagctcactgcagcctctgcctcccagttgcaagaaatttttggtgcctcagccttccgagtagctgggatcacaggcttgtgccaccatgcctggctaatttttgtatttttagtagagacagagttttgccatgttagcgaggctggtcttgaactcctggccttaagtgatttgcctgcctaggcctttcacaatgctgggagtacaggcatgagccaccatgcccagctatgatccttattttagctcatatttttccacacctaataatctcatatggctttatggtttcttgttcactcttcacatattaccagcctcaccgcaaccctgcatctttgtggctcctattttaggatgggtttcattttaaaatggcaaccctttcatcagtcccaatctacctactctgcattgttttggtagtaaatattaccttccaaaattgtttattatttagttaatttgtatctttttgtctctgtcccccttgccatgtcccacatgaacaaaattatttacctatcttgttgactgatgaatccttagtacctgacacttggtaggtgttcagtaaaaaactgctgaatgaactgggcacaatggctcatgcttgtaatcacagcacttcaggaggccaaggcaggatgattgcttgaggccaggtgtttgaagcagcctgggaaacgttgcaagacctcgtctctataaacaatattctaaaaattaggtgggtgtggtggcacacacctgtaatcccagctagcaagaaggctgaggcaggaggattgcttgagcccaagagttcaaggctgcatgaagtgaactatgattgctccagcttgggcaacagagtgagaccctgtatctttacaaattgtgttgaatgaataattgagttattaaaagtattggtatatcctattattctacttctgttggtacatgttgtagaatttgttgtgtttgatagtgatcatactcctcaggtgtctagatattttggttcacaagccatgttctcctagtgttatctactaccccttctaataatggatagaaaggtagagcaaaatggcagaccctcgtttttatcccttcccacaagtttaaggagcagaaagcaagagctgtaggcaaccacagaactgatgctctctctttgctactgtttctctagtaaggatctgtgttgaaatccacaatccagcagcagaaggctgttataatttatcaaaattctggcagcagggaaggagtggaggggtgaatgccccaatattctatagtatctggtcagccccactttttcattggcaactcacttcaacagaccctttatctaatcctacaggaagcctgatctgttgctggtgatttctgtagcaatcagtagtttggcactgattgtcccaaagcaaagtggggcatggcaaaacagtatttcagaacttactcctaacactaactatggtttcctcttaagtttttgatcttattcctcaagcttttgcttccttcttgtttctgttgttactcagggttgatttggagggaggaagacaacagcctttactagtttttcattttttcaggaaccatatgtaagaaactcactttaaatataaagacatagataggtgaaaagtaaataaagaaagatctgccatgctaaaactaataaaaagaaagctggagttgctatattgtcagacaaagcagatttcagaaaaaggaaaactgtcagggatagagagaagcattacataagtatagaggtaaattctccaaaaagataaaacaatctttaacatatatgcacctaacagcattaaaatgtgtaaggcaaaaactgatagaaccacgaagagaaatagacaaatccagtatcacagagacttcaatatctctctttcaataattcatccagcaggcagaaaatcagtaaaaattgaactgtagtatcattaatctactggatctagttgacatttatagaatacttcatgtaagaacagcagaatatacattatccttaaaaaatatacacatttgtcaatataaaaataacatttgtttgcaaaaaaaatctaaacgaaattaatagatacacaacaaatttagaaaaatatttgcaaggaggtttaatcagggaactcagaaattcacatcaagggaacaagcaattcaacagaagaatggatgggcaaataatatgaattcagagaataataaatccaaatatgaaaagaggctcagaatcaggagaaatcaggaaaatgaaaattaaaataataagatgccagttagtctaacagactgacaatttttttttaattcaactaacatttactgagtgcctaatatggacagacactgagctaagcacacctctaatttagtgttcagaaagtactttgaagtggatcttatcccttttattcagttgatgaaagtgaggatcataaaactcacagtaggcgaaattgaattcactctataggagctatttttctttcctttttgaatagatagttcattcagatactgtatgtgtagagagagacagatgttttgcgtttcagtctcccatgatctcctgttcaccaatttctcataacaccaccacctatcccattaatacttttattagttttttgcataccttcccagatattttacagaaaaatacaaatttatattattctccattttaaaaataaagataacaatatatacactgtcctacatatattagtttacaatatatcttagaattatttatgtaactccataatgagattccttatcttttaatggctgcttagtattccactacatgaatgccagaacttattttactagaccttatgatggacatggacattgttttcagtcttcagcttttaaaaacagtatcattgaataataatgtacataattttgtctcatgttcaagatatctgctggataaattcacagaaaagagattgctaagttaaagatgtgtgtgtagtggcgggcgcctgtagtcccagctactcgggaggctgaggcaggagaatggcgtgaacccgggaggcggagcttgcaatgagccgagatcccgccactgcactccagcctgggcgacagagcgagactccgtctcaaaaaaaaaaaaaaaaaaaaaaaaaaaaaaaaagatgtgtgtgtttgtgtgtaattttgacagatattgccaaatttctctccataggtgctgtataaacagatgagagtgcccccacagcattgttattagagtatgttattcaaactgttggatttgggactaataagcagaaatgtttaatctcagtaaaattttactatgcatttctcttgtcacaagtgaggtgaaacatcttttcagactgggaaaaatgttaaatgaccaatagcaactatggctggtgaggggtccaagtaaaagggtattgttatagatagctggcataaatgtgaaatttttcaacttattcgtaaaacagtctgacaacctgtattaaaattttttaagctacagatatcttttgtccttgctgtaccattcttgggaatctgttctatagaaatacataaggttctattcacaaaaatattcatagtggaaaaaagggtaacaaaatgaaagctaatcagtaggaaaacagcagaatgaattacaactcctgcatcctataaaatattatacagctatcaaaaggaatgaattcaagttgtatgagttgtcatttccagatattgctaaatgagaaaaagatggagaaaagtgcaggatctcaatctgtaaaacaaaatacaccaatacctatagagatgtttacatatttgtgtgtgcacatatggatatttatatttgtaaatgtatatatatacatgaacatatatatacgagggaatgtgaaaaacacatattacttgggattataggtttgcttgctctcaggtcaaaatagtaatgacataagatgtaaatttctttttctctcatagtccaaggataatcggttcaggactgatagagcagctctggatattaggtactcaagctacttttagctttttaatctgatctactcaatatgtgaatatgtggcttctatttcatggcctaaggtggtagttccagctcctgccatgatacatttgagaacaggaaatagtaaaagagtatacctcttctttctaagggcgtatcatagaagttggagccaccatttccacttacgacccatgggccaaaacctagttacatggccaaactttcaagagagttaggaaattatagtcactatccatgtagcaatgtacccagctaacatatgggggttctgccgggcacggtggctcacgcctgtaatcccagcactttgggaggctgaggtgggtggatcacctgagggtcaggagttcgagaccagcctgaccaatactgtgaaaccccgtctctactaaaaatacaaaaaaattagccaggtgtggtggcgtgcacctgtagtcccagctacttgggaggctgagacaggagaattgcttgaacccaggcagcagaggttgcagtgagctgagatcacaccattgcactccagcctgggagacagagcaagactccgtctcaaaaaaaaaaacaaaaaacaaaacaaaacaaaaaaaaatgggggttctaatattaaaggaagaagaggagaaaggacattgggaaataattgtattctctgccacaacagagtaaataggtgagctaggtaatggaaaagggactctgtttcctacaaattatctacttctgcattacacatgcattccaaaacagtggcttaaaacaacatgatttattctctctcaccacactgtgatttggccagaaagttctgttagtctcccctgtgttcactcctgtggctgcctttacactgtctttcactcccagatttataacatagtggtctcagtgcagtgttccaaacggtgaaaaaagctgtgaagcttctctagacctagtctaagaagttgtacaaagtcacatctatttgcattctgtggtcaaagcaagtcacaaagatagctagattcaaggggtaaggaaataaagcctttgatgggaaaagtggcaaaagcacattgcaaagatgcatgaacaaagtaggcatgatttattgagggcaaatattgtaacaatctcacaaattacacattttatgtattcttaaatttttatttcaatagtttgtggggaacaggtgggttttggttacatggataagttctttagtgatgatttctgagattctggtgcacctgtcacctgagcaatgtacactgtagccaatgcgtagtcttttatccctcacccccctctcacccgcccccaacaaagttcccaagtccactgtatcattcttaagcctttgcatcttcatagcttagctcccacttataagtgagaacataatgatgtttggttttccattcctgagttacttcacttagaataatggtctccaactccatccaagttgctgtgaatgccattatttcatttctttttatggctgagtagtattccgtggtataaaagctatatatttatatttaatatatgtgtataaattttcatatttgttcacagagaaatataagtaaaattggttaaatttgtggtaggtagatacaagtctgaccgagtcactcttctgctctttattgccacacagattaaagtccaagttccttagcctatactatttccactatattacactacctcccagagaacatggcataaaaaccaggaagaaagagaaattccttctggctgaaatggttgggaaaggcttcatgtaaggtgtgggatctgaactggaagaaatatttgaattgatggagaggggcaaggtggtaaaccctaaatcataatcttttaaggaccacccttttaaaaaattgaaatatagatatatgcaaaaatgagtgatttatcacagagtgtccctgtatccagcacccaggaaatagaaaccttcttatgagagctcccagtaactatcctgtcactgttccccaaatgtaaccactcttctgatttctaaccatacatcatttttgcctagttttgagtcttacatgaatgaaattatgtaatgtatattttcaccattatatttctgaaaatgatctgtggtgtttatcgtttgttcatattcacttctatattctattaaatggataaaatatatttatccattttattgttgatatttcagtgggctgtttccactttaaagctattaaccaattatggtgcattcttctgtatgtctcttcacatgcaagtgaagacatttctgttgagtatatacttaggattaaagttgcttagtcattgatgtattttcaaattttgtaaagaatgacagttttccaagtttatggaaactttacccaatccctgtcccccgtcccctgtcactgctccacaacagtgtgacaaagtttcactttctccacactgtggtcaacacgtggtattgtcaatctttttaatttggtcattctgatgcgaatgtagtggtatctcattttgacattaaccttttacttgatgaccattgaagttgagcaccattttatggtacttaacatttggagatgtttttgtttttgacaaaaatggccttcagagacattttggagatcttttctgtagtgcctgttaaagtcacttgcccatatttctgttgggttgtcattctttttcttactgatttttaggaatcatttatatattctggatatgagttcttggtcaaatatatgtgtggccagtatcttttcttacattgtggttagtctttttgtaatggtgccttgataaacaaaattattaatgtaatacattttaccagtatatttccttttttttttttttttttttttgagacaggggtctcactctgtcacccaagttgcagtgtagtggcacaaccagggctcactgcagcctcaacctcctgggctcaggcgatcctcctaccttagcctcccaagtacctgggactacaggtgtgtgccaccacacccagctagttttttttttgtagaagtggggttttgccatgttgtcccggctagtctcaaactcctgggctcaagccatcctcttgcctcagcttctcaaagtgctgggattacatgcatgagccaccatgccaagccttcttaaattatttttaatctgtcctctatttcttcttaagactctaaagatatggtgatttgcaacagaagttattacaggaaatggacccttaagtaagattttgagattgggttggacacacacacacacacacacacacacacacacacacacaggcacacataaaatcaatcagaggaataacctcgttcctataaggaaagagactacagactacaggtaatccatggcttacaatatttagtttacttttttttgagacaaggtctcactctattgcccagaatggagtgcagtggtgcgaccatagctcactgcagcctcaacctcctaggctcaagcaatcctcctgcctcagcctcctaaatagctgggactataggcgtgcactaccatacccagcctatttatttattttttattcatttatgagatggagtttcgctcttgtcacccaggcttgagtgcaatggtgtgatctcggctcactgcatcctccgcctcccaggttcatgcgattctcctgtctcagcctccccagtaactgggataacaggcacccaccaccacgcccagctaatttttgtatttttagtagagatagagtttcaccacgttggcgaggctggtcttgaactcctgacctcaggtgacccacccacctcggcctcccaaagtgctaggattacaggtgtgagccaccatgcccggcctatttttctttttttgtagagacagagtctcactatattgtccaggctggtcttgaactcctgagctccaatgatcctcctgcctttgcctcccaaagtgctgggattacaggaaggagtcactgtgcccagccagtttgcagttgtattaggattaccagtaacaacatgaaatcaagtgaagcaggtgaggagtgtatcaccatgataaccatggtaattataaagattatagatccatctggcttttcttatggtccgaaacagaaagtacttaacccgtttgtgccagaggttgcaattttttgaatttttgcatgagtgaaaaatcagaccttggcgatgaccttgagcagtaggctataaataattcccacatgcttagcgttccaataatggaacgctaggcatacgtgggttaaggggcatggtggctaatacctgtagtcccctatttgggaggctacggtgggaggatctcttgaagccaggagtttgaggccagcctgggcaacactgcaagaccccatctctaaaaaaatttttttttaattagctgcgcatggtggcacacacctgttatcccagcaactcaggaggctgaggcaggagggttgtctaagcccaggagtttgaggctgccgtaagctatgatcatgccactgcactccagcctgggtgatagagtgggaccctatctctaacgaaaagaaaagaaaagaaaaatacataagaaaaagaaaaacataaaaactacaattaagactgtatgtggtgaccaggtgcggtggctcacacctgtaatcccagcactttgggaggctgaggtgggtagatcacttgaggccaggagttcaagaccagcctgactaacatggtaaaaccccatctctatgaaaaaatacaaaaattagctgggtgtggtggcgcacacctgtagtcctagctacttgggaggctgaggcatgagaatcgcttgaacctgggaggtggaggttgcagtgagccttgattgcacaactgcactccagcctgggcgacggagtgagacactatcataaacaacaacaaaaagaaaatgactgtatgtggagcatgagaactctattacaggtctgaaggagttgattatcttctgtaatcactgggcagatatggtagatttgtagtatcaattacatgcttaattcttcccctttcctattctaatgctggaacattggtggggagaggagtcctaagacatacgatagggacatttgagcagagaaaaatgaagctgaaaactctgaacatcaatcttcccctaaatctctttctgaggaaaccaggctcctatgcatagaggctttcagtgattgcacttgggcaagctccttcacaagctgatacatgctctcctcagaatttaccggctggggctaggcatggtagctcatgcctgtaatcccagccctttgggaggctgaggtgggaggactgcttgagcccaggagttcaagactagcctaggcaacacagcaaggctctgtctctaaaaaaaaaaaaaaatttaattagccatgcatggtggtttgcgcctgtagtcccagctactcagaaggttgaggtgggaggatcacttgagcccaggagttcaaagttgcaatgagccatgatcacaccactgcactccagtctgaacaaagcaagaccctccctgtctccaaaaataataaaataaagaatttaccctactacctattagtgcctccagttatatcccaacatagcctagtcagagaattgaggccttctctggagagagaaaacctatgtaggagaactaaaggccttgccattttaatcagcagaaacttggacagcatatatgagaatacatttaaggttagatcatggcaaatttattggcatgggtgcactcacctaagaatcaagagttaatattttggcattaataatttggtaggatgaggcttaaattcagtaatagcctataaataagatggccaaaatgccagaaattcctgggcatattgtagaggagaaaacacaaaggctccttagccattgttaattttcaccatgtcattaaggaatgcaatgatgatgggagcaccactatttcctaggagctctgaagtggctgtctttgtttgcgagagatgatggtggtaaaccctgtagtggaactgagttagctgatcttagtgggaacattagaatcctaaggcagtagaggccacataatggcatataaatatcagagacaagacagacacagtggctcacgtctgtaatcacagcactttgggaggccaacgcaggcagatcacttgaggccaggagtccgagaccagcctggccaacagggtgaaaccccatctctagtaaaaatacaaaaattagctgggtgtgatggtgcatgcctgtggtctcagctactcaggagactgaggcaagagaatggcttgagcctgggaagtggaggttgcagtgagccgagatcacaccactgcactcagcctgggcaacagagcaagactctgtctcaaaaaacataaaaatataaataaataaatatcagagacaaagtaggcacaattaccaaaataagtcaaaggagagaacgttaaccagagtagtttgacccacagggaaaagtgataatggctaaatgatcatgaggtccctggaaatataataaagtaacctaccaaggtgctgcttgacatatataggtggaaaaattcttgtggttttgtagtaaaatttgaagcatctcatctagctcccagacttggtactccttcactgatggaaagagactggatcctttgacgaaaggggcaatgcaatcacagctgtatacaacgaattgttccctaatccagtggggttctcaaacttgtctgtacattagaacaccttaggattctaaagcccaggccacaacccaaactaattaaatagtaatctcagggaagacccaggcatcagtattttttcaagttccccagatacttccagtgagcagatatgttgggggaatcattgccctaagccttttccatagggaccagtgaccattcactagagaaaggaaaatatccaaaattctttgttttgttttgttttgtttttgagacaaggtcttgctctgttgtcacccaggctggagtgcagtggcataatctcagctcactgcaacctctacctcccaaatagctgggactgcaggcatgcaccatcactcccagctagtttctgtgtttttggtagagatggggtttcgtcatattggccaggctgggtagaattctttttttttttttttttgagatggaatcttgctctgtcgcccaggctggagtgcagtggcgcgatctcggctcactgcaagccccgcctcccaggttcacgccattctcctgcctcagcctcccaagtagctgggactacaggcgcccaccaccatgcctaggtaaatttttttgtatttttagtagagacagggtttcaccatgttatccaggatggtctcgatctgctgacctcgtgatccacccacctcggcctcccaaagtgctgagattacaggtgtgacccaccgcccggcccaggctggctagaattcttaaggcactgtctcttaacttgtactaatactagaaacccaaaactctaccctggacaactggtcagaatagggaacctaaggaagtcaagtgatggaatcttggcctggctgtggctaacagtagatccagaaggacccatactgtggctatttctccagtcccagatgtgtagtggtaatatgtatcttttaacaacaatctttattttggtttcctgatcaatggagggattgctattatggtagaaagtgctacacagcagcttaggtctgctttctaccactcctcattaagatagtaaaggaaaagcagggctatatccctgaggaaattgcagagattggccaggcacagtggctcatgcctgtaaccccagcacttagggggaccaaggcaggaggattgcttgacaccaggagtttgagaccagcctatataacatggcaagactgcatttctacaaaacataaaaaagcaaaatagaaaaaccaaaagaattgcagagattagtgccaccatgctgccatggtgattcataccacattcccatttaaatttcctgtggccaccagatgcatcatagagaatgacaatataaaaaccagatggctagtgaagaatgacagtggactgcaaactttaattaggtagggatgccaattatggttgctgttctaggtgtggtatcttcttcggaagaaattaatacccatgttgacacgatactgatctgatattgatctggaaatgtccccccacccccattctaaggagaatcagaaacagactacgtttaaataggagggataacagtaagtccttactgtcttgtctcaggctacatcaactctcctgttctctatatggtatgaagggaccttgacggtcttttgttattccatagaacatcacactgatttatcagagtaatgaaattatattaaatgaaactgaagagcagaagtaggcagcattctacatgctttggtacgacatatgcatgctagaaggtgcaagatgaaccttgaaaaacttccaggactcttgccacaggtttctaggggtccaatggccagaaatatgttaggatatccataacatccatacttttttctcttccattaactggtcagagggaactcattatgatgacagtttatgtgggttgagggagaagtgctgaaggagtagaggcaggtactataggagtctgagtcacctgctcattcatggttccagtcccatatgtagtgcactgctcctgtgttcatccagttgtacagtttgatgagtcaaataacaacaattcatgatgggcagtttgattcacacagtcacttgatgtcccatggtcaggtgttacatctcttccaggtaccagtagcaagtcaagaggtacttttcaaataaaaaaaaaaaaatgaaacaaaatcatggctaaggaagatatggccttactcctaaaccttaagggtctatgttgtaattcttgcactgaaacttgccagaggcttcatataacatctctcctacattaacttctaatatcattgggtctacaggatcataaagcctaagtctgggccctaccccactcaaaactggtaattttgagacggagtcttattctgttgcccacgctggagtgcagtggcaagatctcggctcactgcaacctctgcctcccaggttcaagcgattctcctgcctcagcctcctgagtagctgggattacaagcatgcaccaccacttccagctaatttttgtatttttagtgacctcaggtgatccacccacctcagcctcccgaagtgctgggattacaggcgtgagccaccacgcctggccaaaactggtagtcttacagttacagttaagcctctaagaacagcttacccaattgtactatgttttgttgtctccaaatctaaagacgcctgccacatattttgcctttttctttgttgtgatagtggaaaatacaacttgtcactaacaagtgcctttaaacaggggtgtttgtttggttttggtctagcttttttaattgttcacagcagaagtatgatcaaaaccactgagttcttaattatcagaagtgaaactcgaggtttttttttttttaagacaggctttctgtcactcaggctagagtgcactggcctcatcatagctcactgcaactttgaactcctggcctcaattgattctcctacctcagcctccttgagtagctgagattacaggcatgcaccaccatgcccagcgtttgtttgttttttgttttggtagaaacaggttcccactatgttgcccaggctggtctcaaactcctggtctcaagtgattctcctgctttggcatcccaaagcaatgggattacaggcatgaggcacctcacccagcaaagaggactcttttttttttttttttagtatcaaaactttactccctcagtcaaaatacacaaggtagttgtgcatatatgtagtctatagataatgcttggtacataaatatctagatctacggtaataactattacttagggacttgaaactcaaagaaggttaaactgctaaaagcaaaggcatactcttagaaaagtaaaagtatgttcaaaagaatatgaggatcacagtttaatagagatatcctgtaaaaagtagagataaagtttttctcctctatacaataggaaaccattgaaaagttctttattgtgctacattataatgaaagctgtgtttaatttaatggtgatgtgcaagatagtctggagaaggaaaagtagaggcagagaagcccactatgaatttatagtaatggaccaaatatgagttgagaggcatcatagtgtaatgaaaagaatgctgatattagaatcataagactggtaataatcactgatcctgtcaccttgggcaagtcatttgacctgcctgattctgcatccttatttatatgtcactcaccttgtagtgaccttgtaggccctcaataaatacttgagtgatgaaatgttaatcacttctgcttaactcagagggattacataatgatgaaaatcttttaaaatgtataaactgttatacaatttaaggtgtaatatgcattgaaggcctaaataagtagaaatggacactcataaggaaagggaagggtgaaagacaaagatgactccattatactgaatcttagtcttgatgactggaaaaatatattcacttaagtagactggttaggagagtaactgagttttagaaatctggacaaggttagggaaaaaatagtgatttatttaaatagtcaagatgttcagcagtaactaaaaactgaacaactaagttaccattaatatatgtaatagcttcctattacatatattagtttcatatattcttaggtatttttcatatgagaatgttctgtctcctacataaaactttatgttcttagagaaagaggttatctcctggggaatttgtattccctcctcatttaaaaataaaccacctgtatcactaaagttccatctgttctgtccaatttattggtaaacaagttacatagggcattgactggtttaaagattatttgttaggtcctttggtccttccagtttaataccaaattgctatacttttttttttttttaaaagagtcttgttctgtcacccagactggagtgcagtggcatgatctcagctcactgcagcaacctctgcctcctgggttcaagcgattctcctgcctcagcctcctgagtagctgggactacaggcgcctgccaccgtgcccagctaatttttgtaacaaactgctatacttttaaaaaaatcgatatataatagtttacatatttatgaggtatatgggctattttgttaccttgactggggtatccatcacctcgaatatttctcatttctaagtgctgggaacatttcaagtcttctctcctagctattttaaaatacaaaaagcattcactgttactagctatagttaccctactctgctattaaacattcctttgttccatatctcactgtatgtttgtacccattcaccaacgtctcttcatcccccctcccacccagacacctttcccagcttctggtaaccatcattctactctctgcctccatgagatcaacatgtttagcttccacatgaatgagagaacatgtgatatttgtcattctgtgcctggcttatttaacttaacacaataatctccagtaccttccatgtttctgcagaggaaatgatttcattcttttttgtggccaatagtattcattgtgcataggtaacacattttctttatccattcatctgttgacggacacgtaagttgattctgttctttgccactgtgaatagtgctgcattgaactgatttcttttcctttgaataaatacccattagtgggattgacagatcatatggcagttcttttagttttttgagaaatactgtgtttccatagaggctgtattaatttacaatcccactgacagtataaaagaatttcttctgcatccttaccagcatctgttattttcgtaataaccactctgtcataggtgataccttactgtggttttcatttgcatctttctgatgattagtgatattacacatttttcatatacttattgggcatttgtgtcttcttctgagaaatgtctattcacatcgcttgaccacttttaatggggttatttttgttttacttttaagttccttgtatactctcaacattagtcccttgttggattaatagtttgtaaatattttcttccatacaacaggttatctcttcactctgctgtttcctttgctgagctttttagtttaatatagtccaatttggctatttttgtctttgctgtttgtgcttttgaggtcttagccataaaatctttgcctagacccaatgtcctgaagtggtttacctgttttcttctagtagttttatagcttcaggtcttacatttgtgtctgaactgttctttatgtacatcactctaaacagtttttactactagtaccttgtaaagcataaagcaaatgccttattcaaaatcatatgaggccgggtgcagtagctcacactgtaatcatggcactttgggaagccgaggcgggcaggttgcttgatcccaggagttcaagacaagcctgggcaatatggtgaaaccctgtttctacaaaagataaaaaaaattagctgggtgtggcggcaagcggctgtagtcctagctctttggtggtggtggctgaggtgggaggatcacttgagcctgtgaggttgaggctgtagtgagccatgatggcgccattgcattccagcctaggtgacagagtgagaccctgtctcaaaaaagtaagaaagaagaagaaagtcatatgatatatttctttcttttacattttaaatgtatatgcctttcatttagaccctaaagtgtaagacagtttctattccatttgaaatccttagtcagtttctcctagttttaaaaaaatttaattgtaacagccattcaaccttagctgtagatttatcttttatacttagaatttcccttccctccctctccctgcaagtttatttggttttctctggactgctatagtattttactgaatctgtctgggaacttaaattcctaacaacatccagaagcttcagtaactctggacaaaaagagcttcatccattaaaaagctgatttgggggtcagaagaaactctcctcttgtatcatcttttgctccctcacatgaatagaattttggttagatagagctatttgcctttccttttcctctttttttttttttttttttttttgcccagcacagttttgtttagcatcctttctagttctacttcaaatgtaatattttacgcttttacttgagaccacagaactactgtattagtatccccccttatccagtagtcagactttacctttctctaccttagagaatttggaagtaaggaaaacattgaacaccaagaaaactaggtgttacaagctttattctgtaacaaaaatatttctttttgagagttaagtgtttcacaaaggtaaactctccatctaactgatgcctcgattattcattactgacagaagtcagtcaacttgaagggtcatgtcatcacaagtgtgctggtaaagtttaacaactagcctgaagtagggagcagcaggcagagatctgatctgtggtgttttcaaatttccctggggaaagtactcctatgtggtactgtgtcatgttccaaagaacatcactgaacacagagctgggaagaggtgcacactatcaaactgtaatacttccaccatgcagatacaatagacataaccacaaaaacacggaacacagtaaaaggtatagcatacctcagagatactgtgggtttagttcgcgtgaatttttccatttcctagtgcatatgaaagttatgtttacactatttaaatgtgcaatagcattatgtctaaaacaagtgtacacagttttttttgagacagagtcttgctctgtcaccaggtaggagtgcagcagcaagaccatggctcacagcagcctcaacctcccaggtttcagcagtcctcccacctcagcctcccaaatagctgagactacagctattttagaaaattttagaaaaatatgtatatattttttgagacagagtctcactctgtcacccaggcttgagtgcagtggcgcaatctcggctcactgcaagctccgcctcccgggttcacaccattcttctgcctcagcctctccggagtagctgggactacaggtgcctgccaccacgcctggctaatttttttgtatttttagtagagatgggttttcaccatgttagccaggatggtctcgatctcctgacctcgtgatccgcccgccttggcctcccaaagtgctgggattacaggcgtgagccactgcgcccagccgaaaaattttttgtagagacaggatcactgtgttgcctaagcttgtctcaaactcctgggcccaagcgatcctcccacctcagcctcccaaaatgctgggattacaggcatgagccattgcacctggcctgtgtacatactttaattaaaaaatactttattgctaaaacatactaacaaagtaggcacatgctgttggaaaaatggcaccacaaacttgcacaatatgggctgccacaaacttacaacttgtaaaatataccatatccatgaagttcaataaaattaggtatgtctatagtaaaataactaggaagtgagttttgagtatttattattgagctttatttaacagattttaatataattgtcagtttctataatttttaataatggctgtgtttaacaatcagcctgcaaaattcctacaatttttaaattgacccttgtaagctgttacaagccagttctatcacactactgcctatactcttaattgtggaagtgacttagggactagtcaatgtgagttgaggtggttctgctagctaataatttaaaaaatagacatagtgtgactgctcttttagaatctgtctagcaggtttcacccaaaaacccacaaaaaaaattgacctagtactcagatttatatagtgaaatcttaaattttgctatctcgcaaagtaaagtttgtcatgctttttcatattcctccaggtatatgttaccttgttatgactttattagttaaaaaacatttaaggccactcccatatgtgtcacctataaataaatactgacaaaaggaatacaatgaacaatggggaaaaatacagacaggcatttcagcaaagaagatatgtggatgacaaagaagcacatgaaaaaatgccaatatcattggtcactaggaaaatgcaaattaaaatgacaatgaaataccactacacacctattacaatggctaaaattgaaaagactaatcctaaccagtcaggagaaattggaacactcatacatagcttgtgggaccataaagtggtaaaaaacacttgggaaagtttggcagtttcttaaaaagttaaacacatatctaccatataatctagctattccactcctaagctacttactcaagagaaatgaaaacatatgtccatataaacactgtaaagaatgttcgtagtagccctatttgtaataagacaaaaattggaagaggctaggcggagtgcctcactcttataatcccagcactttgggaggctgagctgagtggatcacctgaggtcaggagttcgagaccagcctggccaacatggtgaaaccccgtctctactaaaaaataaaaaaattagccggcgtggtggcgagtgcctatagtcccagctactcaggaggctgagacaggagaatcatttgaacccaggaggcagaggttacagtaagccaagattgcgccactgcactccagcctgggtgacagagtgagactcagtctcaaaaaaaaaaaaaaaaaaaaaaatggaaacaaaccaaatgtccactgactggtgaatggataaattgtggcaaatacatacaatggaatattatttagcaataaaagataatgaactactgagagacaacaatataggtaagtctcaaaataattatgctaagtgaaaaaaggcagacaagaagttgtattgtgattcaacttcaatacagctctagaaaatgcaaactaatttaccgtgacagaaaatagatcagaggtgtcctgtgggttaagaagacagaggggtgggggaagaacaagagaaaggatttataaaagagcataaggaaacttgtggtgaagttcattatcttgattttggtgagcttcatgggtatatatatatatgttagcttatcaaactgtttatttaggtatgtataatttattgtatgtcaattatatttcaataaagctgttaaaaacataacaatgtagctgtggtctaactggtagagatgaggaagaggtaactgctttatgctagacaacatagttcctttctttcagggttaaactgaaatagtttctttgggcagccaaaaagcacatatctctggcttacagagatgtcaggcaactgaaattctcatgtttttattacatgtctgctggtaagccactcctctgagtgcctgtctttatatgtttatctctaatatacttcatattatagtcatcctccagtatccatgagggattgtttccagaaccactctcagataccaaaatccaaggatgcttaaatccatgatataaaatgccataatatttgcatataacttatacacatcctccttagattgcttataatacttagtacaatgtaaacactgtaaatatactgtattgtctagggaacagtaacaagaaaaaagtatgtatgttcagaaaatatgcaattaaaaatgtgtattttggatccgtggttggttgaatccatggatgtggaactcacagatctggagggctgattgtatttgcttcacatgttactattactcataatgaggcttcttcattataatttaaaatattttatattcattagactggtggttctgtagactgtgataagtgaacactaaggatacccacagagccatcagggtatcctgagagagtggggattggagatggatggaaaaggggaaagaatctgtgtgggcaagttcaaaaattagctgggcctagtggcatatgcctatagtcccagctactcaggaggctgaggtgggaggactccttgagccctggaggcagaggcttcagtgagccaagatggtgccactgcactccaacttgggtaacagagagaccctgtctcaaaacaaacaaaagacaaaaaaaaaaaaagttgaatcttttttttttttccagacagggtctcactctgtcatccaggctggagggcagtggcctgatcacagctcactgcagccttgacctcctgggcccaagtaatcctcccacctcagcctccctagtatgtgggactactggtgcataccaccacgccatgctgattttttattttctgtacagacagggttttgccatgttgcccaagatggtctctaactcctgggtttaagcaatccaccctgccttgacctcccaaagtgctgggattacagctatgtaccaccacacccggccctcaatcttgtgactttttctattgggtctaatttgttaggcagggattgggggctgaagtggtggtaggagggaaaccaggatcaaatgagagttttttaatcctttacccatggtttccctgctagctgcctgcttataatcatatataaacactaaagtcatacttgcagaaataaaaacccttatgaaaacttaacagagtgtgtatctgttttaggaacaaaagtataagaaaagttgaatcttgtgaaactgctcttctctgtagaaaagggggaaaaagaaagcttactggtttctgttaggaagcaattgataatggcagtggagaggaatgtaaattaatggatctggcactaaaaaagaaaagtatcccagcactaacccaaaacatacagtgacattcaagaagtctgaatgtacagatttcttaaccaccattctccaacttttcaaagctttcaaccaaccactcaacatgatttaccctcagtcaattcttcctattcggcttcagtacttgccctgagccacgggaattctggcgggcagaggggtaggtcggtcctcctgttatcaatttggaattctatggagcattttctcataggtgtaatatatacagggagggtgggttttaaagccttttgtggattgatctgcaggcacaactacttttctataagaaattatgtcctgagatccagaatgagaatgaatcttaaaatgcttctaacatctttaaagcccttttacttccatttcagaatcaggtttattaatttatctgttctacctgcctagcatttcttgactcaaaagtcacaaggtcaaactcaacaaattccactttaggtatgtgacaaaaggattgttataatctctatctacatcaaactaaattctttgaattctctacatgaacttttttccattttgtgattttagtaatctataattactgtaagcacagtcccagtcaccttgatacccacttatactaagtactgccatgtgattttagaacctgtgttttatttaggtttatgatcttgttggcaacacataatagtattttgtctgaggcagatggaacagaaatagataatgaattcttttttctggccacttgaaagccaaatgatatcagtcaaagaatgaacaaaagtctcccaaaggttctagtaaagtggtaagagaactgagacatggatcacagcagttagtacagacatggccaaatttaaaagaaatgaaattgtggcagttagtcctacatttgagtttcaagaggagatttgatttgcaaaaaaaaaaaaacatgtagcacatgtttccaatgttatgtaaactttagtttcgtagttctttaagagctaaaaacataggaagttcatactattgtttcaagttattttattagaatatcatattttgtttttctataaactttttttttttttttttgagagacagggtctcactctgtcacctaggctagagtgcactgctgcaacatggctcactgcaaccttgaccttctgggctcaagggatcctcccacctcagcttccagagcagctgggaccacaggcacatgccactatgcctaatttttttgtagagacacagtttcatcatgttgcacaggctgatctcaaactcttggactcaagcaatcctcctgctttggcctcccaaagtgctggaattacaggcataagccactgtgcctggcttgattttattgtaacattctaataaaggtaactggagggagaattccccccgcccccaaatattttttaggcaagcttgacccagtaaataaactaagtttacttcctgtactctctcttattagtgcaactatttcagatctttctcccatttcttcaggattatttcattaacatcctgtttttcttgcctctagtctccatcccaatacatactttgggcacatgcttcaacattgctatcacagttacctttttgccatcaaatctgatcaggccatttttgttaaaaattcaatttctccattctatcccatccccttcaaaataaaaggccctcaagatctccagtcatgtctttcaaatctatcttgtctcctcatcttttctgtcttctcattctctccttgccgctccccccgccacctcaacctcgcaatactgcagccaaagtttttctagttttaaaaacttatcaagtcatctctgagactttgcatgctgtttcctctgcctaggagcctccctcacaatttttttccaactttgccttgctccctttttttcatttgttttaatacaactctcttcctcagagaaactttccctgaccaccgccagctgagttcagtacattaatagtgctctgtgcacacatttatgtcactgaacccactctatgatgttgtctgatgcttactggtctcctcaagagactttcttatagatgacatctgtgtcttttatgtatcttcagtgtctagcacctaatagtaattcgatgttttttaaataaatagaaaactaggagtgactctatcaacagatctctactacattaacattctttgtcctaaacctgaaagactcccacttgcctattcagacctaagtatcactgattgacaaaccgaatgaaagtctctttatcgtgcctcaccctacaccaaaagcagtattacaaatatatatttttttaacctgtgtttgtaagtaaaccagctttttggaagacagaatgcactattgtggtcatttcacataaacagaatcaaacagtatgtggccttttgtgtctggctctttcacttgacagaatgttttaaggcttcaagatacattttgtaacatgtattagtactttgttccttataataataataatattccattatacacatatatcacatcttctttatccattcatcagctgatggacatttgagttgtttctactaaaaagtagaatagccctactctgaacatttgtgtatatatatgtttttgtgtggaaaaatgctctatttttatctcaaagatttgtgcatgcttcattacatgccaaaagccttattaaggccaaaatgacatcttagcatgaaataaagtacactttcttaaaccatattaatttgacttaatgagattctgaattgttaagtatagaaatcaatttgatttttgtgcaaacaatgtaaaataacatttggttgacctgggctccaaattacttggtccaggcagaatatgtaaatgagcattctgaatataaaatctggaccgtagcatttacaatttaataaaactaataaaatggtatacactgtactagagccagtgtctttggcaagttataatattctgtaacaaaattaaagatacatgaaaacatagatacaatattaagtacatatatataaaatctgttaattatgtttattcatcaatacattctaattaaccccttactctcaagttattataataacgtggcctcactgaaaaattcatgtaataagaccctggcacaccaccattattcagattggtagattaattgcccatttactagtaattttctctgagacagggtcttgctccatcacaggcttgagtatagtggcacaatcacagctcactgcagcctcaacctcccaggctgaggcaatcctcccacctcagcctcccaagtagctgggaccataggcgtgtaccaccatgctcagctaattgttttattatttttgtagagactgggtcaccctatgttatccaggctggtctcaaactcctgggctcaagtgatcgttccaccttggcctcacaaagtgctgggattacaggcgtaagccaccagcccagctttaattttcttgatcctttctattttctcatgttttatgtcaattcatgcaagataatctgatctactatatttacaaagtttttaggacttcaaaatagtatttattaaggaagggattatttttagttaattaaattttcaacatttttgtacctttattaatttctaaatgtaaatttttctttcagtatttacagccataatttttttcttgttagcattatttccgactgcaatataaaaaacatgattattttcctttcttgtttcaaatgaggacatctctaccattgtaattcaagtaagttaaatgaatgaaaatgttttaactttatttgcaactgtaaagtgggctctctgtaacaacaggtacatgaataatgttttaaaatttaacttaatcttagcctgctttatcctaaggcatcaaaatgcttctaggctatgtttcttttgattttaaccatggcaaaatataagcagaaacgtaagtccacttatgcaaatacaaacttgtaaacagaaagcccaatcaaccaatgaatttacttcactgcctaacaataatgagtttgtgattacacaatcacttgcctttataagcttggataatctagaactccatatatattagttttgttttttgttcttgtttttttttgagacagggtctcactctgtcgcagtgatcttggcccaccgcaacctccgccttccaggctcaagcgattctccggcctcagcctcccaagcagctgggattacaggcgcccgccactacgcccagctaattttttgtatttttagtagagatggggtttcactgttttggccaggctggtctcgaactcctgatctcatatgatccacccgtctcagcctcccaaagtgctgggattacaggcgtggccactattactactatacatttgtttcacactatggccagttaatgtctgactggttactttaataactgacatttatacagcactgtagagtctccagtgtcctttcacatatattatgacactttaaccacacaatcaccctgtgagaaaggacagtcattattacttactttagcggtgaagaaacggggttagaagataactaaccaggccaatatcaagcaaatgggaagcaataactaatctgggttcctccctccatcttcatgcctagtcctgtgcttttagtatatctggctagctatgagagagaacacagattattcagggaggagggaggggccagaggtgttactgaggtgagcctcatgagcagttaggccatgaggtaagcacttcagtgctttgctactcacggggtggttcagacgagaaaaatctgtatcacctgggagctagttagaaatgtaggctctcaggctccaccactgccctaccaaatcaaagtcgtattttcaacaaaaccccaggtggttcctatggacactagtttgagaaacactgcttcactagtgacactacatggtcacttgaacagtatacattagactacttatattcatcattgttgacgtgttaagtttttattaggtaaaactttctgcaacagttttcaaattaagtgtatttttaaaacaagtttatttttccaagtaattgaagatctccacttcggtaactggggtcattaaggaatgttaaaaaaccttaagctggtcagtgcttacccacttttaaattcctcataaaaattaaggtctttcttttgcctgaaggatacactagagagcataactgccgtctccatactttaaacccttgactaaaacaggccaatcctactgaggtaaatcccacctcccaacttggatatttcaggaagtattgtattgtttttctgactctaaactctacctaattaactaattagtctcaacactttctggctcaagaactgaaacacagcaacagaagctaaagtttgagaatttaagcttgttcccacatctacaccttggcggacggcagcgactgattacggagaccagtgaaaaccctgcccctaactctctctgtcctagccccatccactcaattgagcttgactcagcctgctccctgctgttctcagtattgctcccttagggtcagacgtgcactagacttcagcacgtgggagcgctgatgagcggccaacctgggtctatttaaaactactattcccatctcgaggggcgcctcctcccacaccataaccagcccaggagggcaggcgagtaaatactgctcacctgctccaccggaaacctcaaaatcccggctcgagctagactaaaggtatctggtaattaatccttggcacctcccaccacacgctcctgattgggcgcgtgagacaaggctgtgtctgcgcgcgctcttaccagtctggggaattccatttcctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcctgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgtacgcgtgggtgtggacggctagggcagggaagggaggccggcccagtggccggccgggtaagaggggcagtgcgggacctgggcggcttgagcggccagcctattgggtgcggtgggttagggtgggaaggttggggaagccgcggcctctcctgctggaggaggagggggaatgggcgcgtcctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttctttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggtaacccgcggggacaagggcatggggtggtaggagaaaaggaaggctcgggccaagaggaaagcgtgggggtgggaaggaagcataattctgaaaatacctcttggatcacttcttccatggggggatggagaacgcagatatacttcttgaagaaatgaagtttaaagctaggaaacggagaacacttgtggcaagtgaggtgttatcctgagtgcttcagtggaatcggtgcaaattaggggtggaggagagtgacttaaggcgcctttattattttatttttttgctgcttaagaaggagtttttttgggggtccgaattgcggagagacgctccagcagatgtcatggcgcttcctattcttggtgcttgaaaacttagtttagttgtgagatcaaggttatctaggccttctaggggtaagaaagaaaactcggaggagagaaaaaaaatctggcgagtcccgaacttgactgagggtcgggtagaagaagtcttgcgtattgaaggtcagtcagtgagtctagtagaaactcttagtcgactctgggcaggttacaccgaataagtgggtttgggaggagatggaatgacacagtgttgccacttcctgtattttgtagttgcagcttttcacccgaagctatttatccgagggacaccgggaactgatgtaaaaggcattctggaagctcccttttccttttggctggagagtgggggtggataaggggtgcgatggcagtaagggaaagctaatgtacctatttttgcctcattctatttaataacacccttgtttcgttacttgaaatgtggtttgatagtatattatcgatttaagttgaaaaaaaactaggatttttcggagctctgggagtgagcggaacctccacctccggtggtttagtctcattttcttgctctaacttctatcccgcattttaagatggcggctgctttaactggttcaggctctttccggcatctcctttcgtaataatgtgaattaatatgatttgttaaatgttaacttttatatcgcgttgtgcactgctctaagatcctctgctcaaaacttacctaaattcaaactcttaaactgtatttcccttttttgtgacttgtatttgtgtgatgtgtttggttgttgcacaatcgaagagggtggagtgtttacagctaacttgaaaaaaatgtcatggaataaattcagccttactagaaaaattgtggagtgtcggtgagtgttagaaactttggttttaatagattacttttttaaaaagagttctgagaggaatggcaagaatttgcctttactaaaatagacctgatactacatttgcctgtatttaattatgactggagtttatttggcaagattggtgtttcatgaaagaggaaggtttaaatcttcactcttagtatgtattgatatgaaatcgtgaattttgttttgggccttcataacatcgtcattttgggttatgcgaaatacaaatttaaatctttgtgaaatgaaagaaaagaggaagaaacgctttttaggagttaaggattaaagtaaaaattattttgaaataattacctctttttgtgaccactttaaaggccaggaacatattggagaagcctagttgtatgttacagtgtggtttacacaaagagcataacattcagtacaaataaaaatcttttctgttggaattagttcaggccactaaaatgtggaatagtaccagatccatagctttttgtgcatgtggaacagaacacgttaaaggaaggcctctgattttttttctcttacaggtcatacccagctgctgtgacaccacttaaatgatttaaaagctttagagagacaatataacagtggctaagagtgtaaacattggagcagaaatgctccagttagaattctagctctgggcaagtttatgtgcctctataagaagggtatctgttgtaatatgaacaataaatgactgtgtgcctaatatgtaccaggcactgttttagacattggggtggcagcagtgaacaaaacaaattttaagttcctagatttgttttgacgattaaatggattaatgtgcaaatttgaacaggctcttggcacatgacactcctagttattactgctattttaatatcacaatttataatttttaaaaaccgtttttgtttaagaactttgatttctagtttagtactcttagttaaccaggttgtctccttttgtaaatattttgaagatttatgtaatatagacacaacataaaaacttggcatattggaaaaaccagtgtttatgtgaacattattgattcaacttacagaaactttgacgtgtgcatgtggtttggtttttcagctgttaatgttagaatcacatgaggcaactttcaaacattccacatccaacaattttagtgagtggacagctctgaactggaatgctcttcggtttaggcacctcttctagaaatatggggtcaagtagccattgatgtcagtatggtatgcttgtgttacgtacctatttcgaatttattcttgtctgaaggtcccacatttcaagtattatgatatatctgtattcctcgttaatattttactgaaatgattattggaatagttttaacctttagtccatttgatcgagcttttgaatgtatactttgcttcagctgtgttcttggagtaagttttttgactgttagaccaatcaacttttttcctgtattctttatttgaacgagctgtaatatggtcttaaatagggctattaaacaacaggagttaaaagtggcactccaagttgattggtattgagagctgtagacaattttaccactcccattaaacagggactacaatatatgtgttttagggacgtttgaagataaatatgtgaaccaagcctaaaagaatagctcatgttttcattgtatacaccctgttaagttttcgtaagggtttttatttctggaagtatgactttagtgtttatatatgattataagcaagcggctagcagggaaaccatgggtaaagggttaaaaaactctcatttgatcttcgtttccctcctaccaccacttccactgagataatttcaagattatctccatctcgaaattgaaaaacttaggcatagaggttaagaagatgacccaggttcatgttgtgacagttgggattagaacctaggcagcctggtccagagtatgtgctcttaacaactacagtttgatatcatcctttagtttttttttgtcattcagaacggtttacttttgcatatagtattatctattacagtagttaagacaatgcagtctcatctaaaccctaactcatttaatcctcaagacaaccatgtgggatagatgtgagaattttatagatgaagtaacaggctcagagaaatagtcgtctagtcacacaactagtaagtgactgggattcaaatcagataggcaccaaaagctcaagctcttttttgaaccatttcaattcctttttttgttgttgttggagacggagtctcactgtgttgcccaggctggagtgcagtggcgcgatctcagctcactgcaagctctgccttctgggttcacgccattctcctgcctcagcctcctgagtagctgggactacaggcgcccaccaccacccccggctaatttttttgtttttttagtagaggctaatttttttgtttttttagtagaggcagggtttcaccgtgttaaccaggatggtcttgatctcctgacctcgtgatccacccgcctcagcctcccaaagtgctgggattacaggcgtgagccaccacgtggcctggcccttcaattcctgttttataatgtatgtgattttagtttgttacctgaaataagctgctttgctctcccacttatacatctaagtaattgggagttagctttactcttaggttatagctaatttgtgagttaagattttggctaataatattttgaaagtagaagtggatttaattcttttggggtagtctcttcaagcactgaaaactaacatgtgccagttaactgcttaggatgtcttagagtgaacaaaatatatttattgtccccaactagtatataggctgggtaaactgtcttgcatgtgtttcatatatggtcctcaaagcttgttgatagccagctcactttctgtgtaggatagttgtgactgaaggatgctgataataataggacctcagtatttgtttaatttgaaaaaggatgcattactgacactgcatacttttctttcatcatgctcatctgcagtgttgattctagtttttgttatttatacaaataaaaagttgaatgctccatcactgggatgaactactgtgtcactagattgctctgtcaaactttgcccctgagtttaggtgaccctttttatccaagacaggcaatctttgaggattctccacagcatgttgctataatctatctattaaaaaagaaactaggttcgtaacactgagataaaaaaatgtttcagattaaaatctcaaacctaggttggtttttgcattctttttttaaatagcagttttcttgtatctgttagcgtatagaagagcttactgaatattatatattgttgggtgtgacatgaattacatttatattccagaacatttggagtttttaaaaaaattttgtgggtacatagttggtgtatatatttatgggttgcatgaaatattttgatacaggtatgcaatgcataatcacatcagggtaaatggggtatatacctcgagcatttatcctttgtgttacaatccagttatacttgtttacttatttttaaatgtcagattgtttagaatttaaaaaaaaatacagctgcatgggggtcttagacttactaaatcattttccctggaaacacataattttgaaaattttctaggtgattctgaagctcctctctgattaagaaccacagatacaggggagtaaaggtcctaatctgcattagacgtagtattctagtcccagggaataaatgaggaagatggtccttatctatggtaatctctgcgttcagtggtgaaaataagcatgtaaacacatgaatagttgtttgtcactttgtaatttacctttcaagaatattagatctagtaggggaggtatttaaaataaattttctatactgtattttttgtactagtattattacaatgtggtttgtcttttattataatgacttaattccccttgccaaaaccagtattttgaaattaatgaaataaaactctccattcttggaaatgttgtggtcttgagcttgctaccatagcagtgttatttcataattaaaaatgaatgcattcaccaaatatcttactgcccagtttctcttattagataagatttattcagaattgtatcctcaaccttgttatgtagggaagggaaaagtttagggaagtatttttatactttgttgaaacatctgatttttatctcctaatgatactttcaacataatctattgtaaaagagaccttcaacttttcatagctgaatttgtcgtatttaaatgtttgtcaattgtgaatcatgatttcttgtacctttttcagtatgaaatacttacattaatcctaaccttgctgtaatttcatggctaatgtgtaatcgaatgttttctactactgggcagctgtttggctgttaatctttgttttttttgtttgtttgtttgttttgtttgttttaatgtccataaaacacccttcttgctttcatggagcagagcttcaaatctaaatttgggtttctttgcccatttttaaataatgcttacaaaagaatggctttgaataatgttaagtgactttaccttcagtggtgatcgaaagaaaattagtaatattcaatccattcttagtaccttgtgtaatgaacacgcatgcttgtttcacctataattacgactaaacaggaagttaataccttgtcagtgatgcagtgagatactgtgcagtgcctactgttaatccttaagataaaaaaggatttctcagaagaaatttcaaattaaaatgtgttttaaagggactatttggagttttgtgaaattgttcatatctttttgccaagcatccttctcttgaaataaccatgtttctgaagtttgttgttccctgccttgatattcgcatctacatattttatacagacatttcataacattaaagttaataaaactttatagtaaaccagatctttatatgaacagttacagtagttactgtctgcctgatggacagctaattgcactgcacttcgacctctattgttggttcgcacctttgtatttttctaggttggttgtaaagtcttcttgaggatgattcttaaaatttcttaaggcacttactccctttgtttcccacctcattttatcatctcttccagtccccaaagcagtgttttgtgttgctcagtataggtttttgaggcaagggctgtttttataatgctgattcacagtcatacaaatcttgtcttttgagtcatgtaaatcttgtctttagttctgaaagaaatagactctcaaatagaatacaagaaattaacctttagtaatggcataagcttttagttttccggaaagtgctgagaggaaatgtatctatactactgcgttctgtcctctgtatgacctttgtgtgatgacgtgcaaaatagatggtagagattgggataacaaatgatttgtggaacatcgtggtgataattttactgtcttaaaggtagaatccatgaacttggccttgccactatataggcttttgaattttgacaagccttggggggatgaaacctagaataagttatttatggcgttacgctttaatagggttgacacttaaaaccttgttttcataaatgctaccttttggttatgttgatctgatgaacagatactggctgtcattgaaagaaagttaaccgaatgttcagatacttattgggctcctggaacatggctgctctgtagcttcatgaatattcataatattcataaatatttgtgaataaatatttttagtatttccaatttataagctctttgaaaggagggaatttttttttttttttttgaggcggagtcttggtcagctgcccaggctagagtgcagtggcgcaactgcggcttactgcaaccaccgtctcctgggttcaagcaattctcctgtctcagcctctcgagtagctgggattacaggcacccgccatcatgcccggctaatttttatattttagtagagatgggatttcacgatgttggccaggctggtcttgaattcctgacctcaggtgatccgcctgccttggcttcccaaagtgctaggattacaagcgtgagccaccacgcccagcaagggaggggacattcttatgtttctcctagcatcctttcaggtctttaatgttttcaataccttggcctactgttctttgtagcctgtggttggtcaccactgctagtaccacttatcattgaatgaggaagatagagaatagagaagcagaaagcatagtttaacatctccaacaatcaactgttaaatcccatatcccatagtgactacagtaaaggtcttcctcaagataaaccatttgcaggctttgtattaaaaatctcatgtaaggaatgtttcagaataaaaaaaaaaatagtgaccaaacccattactgcttaaatcatgtacttccagatgagaacactcaccagtggcttaagctgtacctgttggttgccttttagagagatttttttggtgaaaaaaatcctgccctattttctaccatggtgcccaccaggtcttcaggaaataggcaaacaactcagttgtgtaaagtctgttgctgtctcaaatttctttgtagtgttttaactaatgaggcgaactagaccatgtgagagctttgagagggtctcatttacctagcttagaaagaaggcagaggggtctccttgacttcttttcctataggttttttaaggcttttaaatacaagtattttttccagtgagaaggtctggattctcacactagccaagtgtgcagaaagtttgaggagaagcagctcagaggaagatgacactaaaaggagaaagtttcctaaaagagcactctgtggaaaagaaatgtccaaccttttgttctttttatagctagtacagtttcttagtgttgtaccctgattgtatgtgcttgatcttagtgtcccttcaacgtgagtggaaccttgagcaattcctaaagtaagtcagtgtccccaaccaaacattttcctgtttcagtggccttaatagttgagtaatgctgttccccttaggtgaggggtagtcagcacagtataaaaaaattttacaggtgccgtgtgagagctgttccttctggttcttggcactgttcctcttcctctagactgctaggaaggaataagctgaaaatttcaattgtgtaattttttagtgtttttgtccctgaagcctgtgaaactttaggctctaaaaacattttgttaggtgactatcgtagacaaaattacttttaaaaatgctgagtatgggtgtcgttggaaattgatttccagtccagtaaatggtcttgctgtgggatagaatcattttctcaggccatgtaacttgaaaaatagtactggattcacactacgtacgaataatgagatacagactaacggtggatggttatgcggaaataaatactaaggaaaacattagttttccatatcgtgttcattctggagcattgagtaatagtttggtgcagttgagaatttttttccctcagtttgccaaacattaaattatctttgcaaggacaccctgttgagaaaggaacctttttgaaacttacccctagtccaaatttttaagttgttagtaggtacacttagttcacctatcctaaagctgaacatgttctatgcttgaatgtaatcatttctttcccctctcttaagggactcaactgtaaaacagagaagatgagctctatttccgtaaagtggttataagagtacagttaaacacttgtggtgtacgactgctagtatatttaaaaatcaaaactcatttgtcttctatttcgaaaccatcagtgatttcccattgcctttggaatagtctgactaaattcaagggctcttttaaaagatcaagtcataacctgcctttttagctaaatctgccactctcctagtgtactctgtctggtataccaaactctgcagtatttgttctggcaaatttttatgccctgtgttctttgacactcctgactttgagtttctctacctagaatgcttctcttactccttgttgttggtaaatgcctgcttatttttccatcaagagccagctcaaatggcactcctctaaacccaggaaaagttagtggttggtttttcaggattctcagagcatttgagtccctttattttaagcgtgtaggttgttaaagtataatttttgttttgtcttgcacctgctttctgttagctgagtctgaggaggcatttctatcttaattatcttggtgtttttatacctaacatgcatggcaccaaaaaggcaatgttcctatgaatgaatgaatgttttgatggtgaaattaacattacattttcattttagaaatggatttaaattaacctccagtgtgaaagttaaccttgttactcctaattcaattttaagacttagcttcatttagatttcttacatgtttttcagcaaaactcaaaaactaaattgtgtttgaagtggcataaaatctacataattggtattcagatttggtctctcactactgctgtatatattttttaactccttaatataatccagattaaataagggatttattagaaggaaactgggatagttaacaatgaatggaataggtgtaggaaccagagcaagctacaacctcaggaaccaaaattgcacatctgtatggaaagtcagctctttgttattgctgctgttgaatatggtctctttagcttttgactttaccatgtaagtccatgacacgtgcctgtcaacagctatgggtcacattcttatagctcttgattatagaaggaagaatgtccctttgatttggaaactcttaggttgggatggacaatggactaatagttgggtcccagctgagggaacaaaattctgtggttagtcatgtccaaataattggttaatgatggctgacccaggactacagtcacatgatttggagtaagggaaaaggaattcatgagtaagatggtttattgagtagacaaaatgtctgctagctacaaagagcatctgctatgacttactcttttctcacttttttttcctacgatactgtcttgctcattctgtgggcatataatgttacaaaaattatttggtagctcaaaggtaagtgcttgtgcatggttttgttactattgggtactaagtggtactttaaatagtaatattagatactatttaaatggcaagaaagaaaatggtgaaataagaacagcatttgtatctttaaaaaagacctttgttttgattgttaaaatacttaggtcatttttctatattgaatttaaagtaggtaagtgtattgggctgattttatctctttgattattactaaagagatgtcttggtgatggagaacttcgaaagtaaggcatttagaaatgttaggagagtaacaagaacctgaaattacaggagtgaagagctgaaacccagtgttaactagctgaaattataccttcactctaaaaggatgataatgctagcatttaaaggcttagtgatggataaatatcagtgtgccgaaaactcatttattctataagaaatactttcttactttctttgtaattgaaatgtgtaatgttgaagtagtatggtgtttatattctaggtcaacttcatagttttctgacctttagttttatttataatgaagtattccaacattattgggtattgtgtttagaacaaccatgattacattgatttttattttaaaattaaaatattttatcttaatatttattctggccaggcacggtggctcacgcctgtaatcccagcactttgggaggccaaggtgatcacctgaggtcaggagttcgagaccagtgtggccaacatggtgaaaccccgtctctactaaaaatacaaaaaattagccgggtgtggtggcgcacttctctagttccagttactcggaaggctgaggcaggagaatcacttgaacccaggaggcagaggttgcagtgagccaagattgtgccattgtactccaccatgggcgacaagagtgaaactccatctccaaaaaaaagaaaattacgctaaatatttttgttcagccattttaacatatattaaatgtaaaatctagtatgtttattgagttaattatgagtaaataaatgtaaaacttggattgtgttgtcagctttttaaactcttatttcagtattaggtatattcagatgcttacaaagacatttttagacaactgagcatcaggatttatcacataggtcaaaaatttaaataaacaagtggctatattatgtggcccatgtgtggagcagttttgcttttgttcagtaacagatgaattaagagccttgcccaggaatcttggttcaggatgggtggtctacacatggtctgcttgttaagtaccagtccattatgtgccaggtagtgattcctatttcagagatgagaagagaaccatgagaaaaagtaggcctgtgtaagattaaaagtaagactgcaggcctggtgcagtggttcacacctgtattcctagcactttgggaggccgaggcaggcggatcacttgaggtcaggatttcgagatcagcctggccatggtgaaaccccatctctagtaaaactacaaaaaaaaaaaaaaaaaagaatagccaggtgtggtggcatgtgcctgtaattccagctactcaggaggctgaggcaggagagtcacttgaacctgggaggaggaggttgcagtgaaccaagatcacaccactgcactccagcctggatgacagagggagactccatctcaaaaaaaaagtcattttcttaatagtggataatttaagttgcaaaaaaaaaaaagcttctgaaatactgatttggttcagttaatattttctgttacaattttttgaaggccaaaagccatgtagtttcttttacagattgttgaactgcgatatgaatttctgtaattcccactgatcagaatcaatagtatttggaatgaattttcttccatttctgaatatgtggaagacatgagggtatatctatacagacaagcatataaagggtgtgtgatatacagtcttaaaattgtgaatcttgggatctctggcaaccttgtaagtagttgtgatgagtttccaaagtgaattggcacagcatatcaggacaattctccttgtctactctatttttgttgtttgttttatggcattaatctagactgaccattcccgaacaactggccattttctgaagtgtattttgaatataagaggcaaatatttgcctcttaattttcctgcagtgttgtttattgtgacaaagcctttcttcacattctttatttctttttaacttttcaggttactggccaaggttccctttcttagcgttaaattagtccagtgttaactcctaggaccttctgttccaggagtgctctcaccaagttgaatggctataaacatcatttgtttattaatgatactttgtatttgttcccagcctgttctcaacttgtatatatacttttcgaattgagtctttacttacattatcctattttacttactttatctctacatctgcccacaagcttcacctgtaagttgaccattttacttaatgccaatctcatgctttgctcaggccaaaaatcttagcgtcaccttttcttcccacatggagtcaatcaacaaaattcattgtttaattttacaattaaaaatgtacatttattgttcaacaaattgctgtacatagtgatgcgtacctgcaactccagctgcttaagaggctgacgcaagaggatcccttgagcccaggagttctgggctatagtgccttatgattgtgattccgcctgtgaatagccactgtagtccggcttgggcaacatagtgagattcccatcacttttttaaaaggggagaggattggtggacttttaactaaacaactttaatcaaaacttcattttttaaaaaagatactattagagcagttaaaactttgtgttgatcatcttaacatttttaaaggtagtacaattattcttagtccgatttgtgtactctagtttcctagccctgtttctcagtgctgttttgctaatatctctaatagtcttacttaatcttgttgaaagtagcacttttgaggttaataaggtttaaattaataacccccattgactgtagtctataatactataattttttaaatggcaaaatgccctctgggagctaaggtgtcttaaaagcttagagcaaatcctgttaaatgggacaaagtctcaattcttttttaataagacaaaaacactttatgtagtctcttttctttttcagtgtttctcgaaatttcaattttattccatgctgctacagaatacaaacttacccaataaaaatagcagctccattgaaagagctttcccacaaattgaaatatttaaagcacagttacaggcttgtgtactgttggtgcatacattgtttgatttgttcagttcctcagttttgcagggaaagatgtcaacattatctgatttttcaagctatctattcaatgattctaattttctaaaagacttggaagctgggttgttttttgttctggcccctcagtttgttgagagcctattttaaagatttccggtggatttaacaaaatgaacaaaatttagaggactcatttatttcccccaaccaagtcagtgccatagtgggacccttacataaatttgtcactgtgtttaaatttgatgtagtgaatgaaaataatcatctgaagccagtataaaataggcattaaacattgttgtccaagctagagtgcagtggctctccaccagcatgatcatttaacacacaaaaacctgaaacacctgggcttaatcctgcctcagccttccgagtagctgggactacaggcacatgccactatgccttgttaaattaagatttgtagctcttcttcccattccctgcacccttctgagagagcttatactgaaagttctgcattttgtgtccttgattttgcacaggaaggcaaaagatcacagttgaggaaaaaaagtgcatgtacccactttgaaaatctgtttccatttttaaattcctgtagttatagggaataagttgttctagtagaccaaaagaagattaatgtttttagttatacacggatgcattgatattgtggtagacagttgatactggctttatcgtaatttttttttctttttatggagaatggggtctcactatgttatccaagctggtctcgaactcctgcgctcaagctgtcctctcgcctctgcttctctgttgtatcttttttatttaggcatcctttcttttgctttctagtacttggtcttttgtatatgaatacgttcagcttttctgggggtttttttttgttgtttttgagacagtctcactcttttccccaggctggagtgcagtggcgcgatctgcagcctctccctcccaggttcaagtgattctcctgtatcatcctcccgagtagctgggattacaggcgtgtgccactatgtgtggctaatttttgtgatgttagtagagatggggttttaccatgttagcagcactggtcttgaactcctgaccttaggtgatccacccttctcagcctcccaaagtgctgggattacgggcgtgagccaatgtgcccagtctagcttttttggtcttgtttttttgtttctgagacaggattttgtgttttttttctgtctcagacagctctgttgcccagactggagtgcagtggcatgatcacagctcactgcagccttgacttgttgggctcaagtgatcctcccacctcagtcttctgagtagctaggaccccaggcatgcaccaccatgcctagctaacattttcgaagagacgggggtctccctttgttgttcaggctggtctcagtcaaactcctgggctcaagcgatccctgtctttgcctcccagggtgttaggattacaggcatgagccacgtacctagtggtcttctgctgttcaaatggaatcccaaaccttacccttctgtgttatttccatgtttatatgagaaaggggatatagaagatatagtagtccctagacttaatgggtgtactgacttatgccatagactaaacttaagagaaactgttagtttgaaaatgttgaaggcagtaatgtattaacattggttctatttattgtcttttttttttaacttgtgattattagacattggttatatcattggtaagatggagctgtaccatcttaaaaatattctaataaactatattttcatagtagataattcatattgttatgcacaagtcatggaacagtgaactacatacttgttggaaataaaacgttcatattgaattgtgcagactatatgttaagagcaaacgtctttctacttacagaagtacgctcttcagggtcagaatttcaatcacgaggtcaggagatcgagacccatcctggttaacgcagtgaaatcctgtctctactaaaaaatacaaaaaattagcctggcatggtggcgggcacctgaggcaggagaatggcgtgaacctgggaggtggagcttgcagtgaccccagattgcgccactgcactgcagcctggagactccgtctcaaaaaaaaaaaaatttcaatagttaaaaatggatgctgagtttaaaaaaaaaaaaaaaaaaggttgagttgagagaataaggagattagaaaacaaaaaaggtacttagccccatgagagtttttttggtttgttttcaggtagaaaatagagttagtggattggggaggaaggatggttcaggaagaacaaagaatttaagacagttgagggcctctgaaagtggtcttggaagttcaacaaataacgtgaatgttgagctctctctggtctaagctcttaaactatgagaatatctaattatagctatttcggtttgtaagagattggcttttatgtaaataaaaaattttgtatcaatgtgtttgcatatatatttttacgaactctagctaagatgattgtctcagcatatgttcaggcatgttctctctcctaatggaatatattatttatgtgaattgtgatggagtgtgcctttaaaaatagggtgaaagtaactgaaagcagtggactcgcttgttttcttaaattaagcttatgtgactcacccattttctgtcttggtgtaggaacttagtgatttggcccgtgaccctccagcacaatgttctgcaggtccagttggggatgatagtaagtaacttgcaagttgatttttatgcctaatttttttttaagcttgtgcatttttagataaccagagttttttttctttttctagtgtttcattggcaagccacaattatgggacctgtaagtattaagaatttttaaatttagttttaagtgaaaatccagcattgatttggttgtaatttttaacttggtctgtaggtttattttatcatatagttaattctattttggatattccatagttgtactgcatttgaaagaaaaaacataatgagttagtcatttgttacgtgtactttgtgtctatccctgtgttcacgttctagagtatagccatctctatgacctaccaaacatctctgtatctcagttcagtttttctacatagcactgtgtaaagcattgtcatggaacttcctgttatttatagagacaaagttactggctctgatctgccatgcgttgtgttactcagagatcttattctgttactgcagctgccaataatctagcttaattgtattttgatatttgattctttatagaacttcagtttatgcaaaatttgaatatatttaggcagaaagtgatattttgaatatagcaaaattcctttctatcctgggtagataagcaactatatgctggataattgaatattcagaattatggataccatctaagaatttcagagaattagagcgcactaaaacatcctggggtaagactgtatcttacacaaatatttaacttttttttttttttttaacttgctaaggcgcttaaggatttgttttctaagttacatgtgtatcttcctgaaaactgtcttccctttttggtggttttataagcaacataaagagcaataatgtactaggtgagataatggtcagtaagtaatatttagaattctaaaggaaaaaatgctcttagagttagtagatgagtcgaatcaacaagtatttatttagtaattctgattctaactttagtcatttttctgtctcaaatgtgagtacatactgtgtgccaggtaataaggatacaaattgaacataataaacatccctgtcgatcttatagggaacttacactgtattagaggagacagatacctaaaacaagtgctgaagtgtgacaagatggaaaataagtgattggtgaatgaagtgctgagtaggataaattaatgggaaattgtagcagggaggattaatttagagtaattaaaatgttagtgccctaaaggtagaaaaactaaatcaaagtaagacatggcaggggtgcaaatattaagtttaatactttgaaacgtcctggatcattttaaaacaaagtaacatttaaaacagtaaaaatagtcctgtaataacgaaatgcacaatcctggctttgtagttattaaaagtacttacttttatctaatttggtagcaatattgtttaattttaatacacgcagttaaatgttgagttacccagtttggcccacacgatatttttgaaagttggcagtcttcaaataaaagccttctgagtaggcccacattccataagcagtaatggcttgggatggaatgacagctgcctcccttttttagatgggatatgtgtttaccacagtgcctactaggtcaattccatattatctgcctagtgttttgtaaagcagttgcttttgcaacctctagaattttcccattttggattaccagttttcaaagaatgctataaaatgccttaaaataaagctcatctttgattcagagggtagttgatagtttcattataaaaattgtcaatactaagaaagcacagaagcgttggtaattaaaacttctaattggatggtgtgcagaataaactaactctttaaaactagttggtttttctgcttgacagtttagactttgttattttgaacaacacactagtttttcccaaaaggcaaggaacatacctatagacaatcaaaaggaaacatgaatgatgagtgtatggtagtaatttttttagagaatggtgttgcttattctgacagattttttagcagtttacttaatttgctgttattttgagaaaacatttaccttttttcattttttaaatatatatttcaggtgatggctattccttgctgaactttttcagcaaccttttaatataatgactagcagttttctgcttttacaaacagaagcatgtgattttcagaaccatttaaatattaacctgattaaccacaactgctgggttttgctttggtagcagtactcactgaaatatgttttcagttaaaaaggttagttctcactgttggttgggtaaatttcaagaaggagtcaaagattataaaaatccacccaaagtacgggtattgtcttgtacataagtaagcacataatttagatgccagctttaaatagttaactatatgcttactgtggagtgcaccaatgaaacaactcattttgttcttttggcttctcaatacttctttgtgacaaagcatcactgtataagataaatagtagcttattttgtgagtatggttgctctatgtagcaagcagttgtgacctaaagcaacccataaattacagatttagtgggagaactggacagttaacaacgtcacttttgctttggactactacttaggtcccttaaagtggtgccagtgccacagaactgaagattcctgactgtagggaatataccatctaattttgagtttcaatagagtaactttgattttagtgagttgttgggaaatcctttagatcattagttatgcagcaaaattgcttggctttaataatcatatgtactggcttattctttctgaaggtaagctacttcggaagcacaactattgactaaaaactaaaccttcgaaagaaatgacagcattgctagttttttgtgtgcgtggttttttttggggaggggggcgtggggtactgtattaaggttagtttccaacaagaattgatgtaattagaagaaattgacttccttacctattgcctctgatatttacttgcttaaatttttttttattggaaatccagaaaaagtggatttagagaacaacactaactcccacctaatctatgacagagatgtagaagagagtacctgtgaaaaatgtgaaagtatctgaaaaatgtaacctttggcagcctgagcatagtcaaccagaaaaactatctgaattaaaataattggtccataggtactattttatttggtccataaggattattttttcaacttttttttcaagtgtattattatgtcatttcccacgtaggttactgatacctgaagactttttccacctttaaccttactcgttgaggagctttgtagtctaataaaagagaaatataagtaaatgttagatatatgggtggataatggtaactatgtgcttaaagaggtataaaagaagggtagggagcagataagacaaaggaagggctatattataaggaagaatattccaagtagggaagagaaaaagatatgttatccatataatattttatgtgcagtagagaacatgttctatagaagagacagaagatgaaactagatgggcacccagatcataaagcaccgtatgtacttaggagttggaattatcttaaaaactatcatagatttcaagcaggggagtaacatttttaaaagaccactttatcattaggatggagggataatcattagtaagctattgccataatctaggctgaagataacatcatgaactaagatggtagtgacagtgggcataaaggagaagctaattcaagaaattttaaagatcttacttgataactatcttgattctgagataagagaggaagaagttgatgatgagatcctggtttatggctttcagttatggcttgctattaaaaaacaggaaaaaagggattgagacaagtttcagttttggacgcatgacatgagatatccaagtagagatatccaagtagaaatatcagtaggcatttgaatatatgccctggaatgaataactgaccagagatatattttgcaactcaaatttttatgggtcagcagttaagagtagaaaatcaacctataagaataccagcatttttagctgggtgtagtggcacatgcctgtaattccagctgctttggaggctgaggcccgagaatttacttgaacctgggaggtggaggttgcagtgagccgagatcacaccactgcactccagcctgggcgacagcaccactttaaaaaaaaaaaaaaaagaataccaacgttttattgccacagaagagctgaggcactgtgagggagcaactttgcactgatgagagcaaaagaagtagaaggtttctgaaaaaatctaacataaattctggacttgtacgatttgagtcgatttgctgatcacagtgttccttattctttggggattttgtttctttttggtgtagtttgctgctgattcataatagaatttaaatatcatagggtctcaattttttatattgcctagtttcattatctctgaacctcgtagttcttcctcttttggcatggcagaactttagtgttaaattgtaacattgaaatattttgccttctttataaagttcttttttcgaacaaacgaaacgaaatttggctttgcctaaatcccatcagcagattgcctttattcagaagcagtcatagacagcatttgattttatgaaaattgaaatgaaagcttacaaagaacttctggaattaggttattaaaacttcaatgtttggggccgggcatggtggctcacgactgtaatcccaacactttgggaggccaaggtgggtggatcactggaactcagcagtttgagaccagcctctcaactaaaaagacaacaaaaactccgtctctactaaaaagacaaaaaaaattagccaactgtggtggttcactcctgtagttccagctactcgggagggtgaggtgggagaatcacttgatcccaggaggcagagggttgcagtgagccaagattgtgccactgcactccagtctgggcgacagagcaagaccctgtctcaaaaaaaacaaaaacaactttagtgtttgggattacctttaaattgttaattttacacagaaaaaacatatcttgtatagtattggatcaggtgaaagtatatgctatttgaagcatctattcaaaattaatataactatttaataaagacatgttaatctaataaactcaggtcacattctaagtgacctgagtgtttttctagttccatattttgtagaaaatatgaaaaaggactgggcacggtggctgatacctgtaatcccagcactttgggaggctgaggcaggcggatcacctggggtcaggagttaagagttcagccaacatggtgaagccccatctctactaaaaataaaaaattagctgggcacgttggtgcacacctgtaatccaagctactgaggcagctgaagcaggagaatctcttgaacctggggaggcggcgcttgcagtgagctgaggttgcaccattttactcgagcttgggcaacaaacagcaagatgatattctacgtcttgtttgtcccccttcccgttcccattccccccgccctccacccctacaaaaaaaaagggggaagacttgggagatggagaaggactcactttaaataagctctggctgggtacagtagctcacacctataatcagcacattttgggaggccgagatgggtggatcacaaggtcaggaggccgcaagactagcctggccaacatggtgaaactcagtctctactaaaaatacaaaaattagctgggtgtggtggtgcatatgtgtaatcccagctacttgggaggctgaggcaggagagttgcttgaacccaggaggcagaggtcgcagtgagctgagatcgtgccactgcgcttaagcctgagcgacagagtgagactccgtctcaaataaataaaagctcttccatttactagttgtatatttctttgaacctgattcttcattaataaattgacctttcttctttgaactcgtgtcccttgttcatatttcatgatacctataacatttcattgcagttactttacatgtctatcagtgtaagctcatcaagataaaaaaaattgttctttggatcccttaacacacatacagtatatagcaaggggttagattaattgaattaatgtttatttattttacagaagggtaggaattagatgagctgtgttagtgtcaggcctgttttttatgtgcctgacatccagaatgggcatagtgaaaggctcatatatagctgtatatacaaagcctttctaatagaggggagtcagtgttggtaaaaacccagttcatgtaagttgtaaaacatgtcttcggattggttctttgcatacccagaagcagttaggcattccacattttaactttaaattcctgagtaggtcagtatctttgatcattaagtggtcttcaaaagacttgtgtttgaatcttggttctatcatttaccatttgtacactagactaagttctttaagcctcatttttctcatgcataaaataggggcaatgcatgtattttctggtattgattaaaatgagaagcttaggcttttctctgttctcctcttgaaggtggtgtgtgtgtgttacctggaatagctaacatttggtttgccagtgggcagaatggactgttgtgaagccatttgtacacatctggctattggaagaaataatctacatgtgtaaaattttgtttacagattattctgaaacatgattatgtaggctttattgctgtgttgtacttttgagaattgagatctagaatacttgcgtttctggataactttttaaaaaaacattttggtgacgtgtaaaatgactaggtaaattagggtttattactgtataagttttaagtttttttctattactatagactgaattttcatggaatagattatttattgcagtgtaaataggtgatttgggttcattattagagaaatgcttggaaacaaatgttacggaatatttagcaataatattttaaatttgagttaagcatacttttctttttacagaatgacagcccatatcaaggcggtgtattctttttgacaattcattttcctacagactaccccttcaaaccacctaaggcaagtattttccctcaaaatctgttagtatagatttatgctttatttcaaaggaatagagcattcttggaagatagggttctgtgtaggctgtatatatatgttgaattgcactcatgtatagatgctgactcttaacctttggtttaaagagctagacctcagtttgagctttgtaaataggaataaggtttgccttttctttaatgttgcaagattcagaccatgtggaagcttccgccctcatctgtattattgttacacagattctgatttttgggcttttgttgtcttgtaagcatcaaatgtccaacttcaatttatatttgcacgtattgttacagcatatgcttattatgcttatagttttgtatacgtaagtgtaaatttgtgaaaacttagagttgcttagtgcactggtttataggtattaaaagcatattatccttcacttttcagtcattaacataaattcaacctgtatgaataactagaaaaggtaatatacaaaggtcataaacatgtcactataacaatctctagtaatgttataggtgcaatgtgatggtttccatttttgtgattcaagtttatgttttatgtacggtggaaatgcagactcaggtgtacctgtgtaacttaatgaaactttaaatgagatggtctacaaattttggttacatccaaaagttagggcttttataaatgaatgtgttaaatacctttaaattgccctttgattcatgatatggtagggccacagtaacctttagaactttacatcatatgagtaatgaaatttttatccaaaagtttaggtttctgttgtaaaaagaggaggcagggggttgtggtcagattgtaaaaatcagtttctataatatttagaacttctatgctaatagatgacatttttaacattgtggcttgattattttaagttttgctttaaaagatgtttgtttttatttgaataaaatacttaaaagtttttgttttaggttgcatttacaacaagaatttatcatccaaatattaacagtaatggcagcatttgtctcgatattctaagatcacagtggtcgcctgctttaacaatttctaaaggtaaatatttctagtgaaataagctgttctcattgtctaataaagcttcattcttagatctacttatctgagtatttttattatggcagctttttggtaagagatggggaagcaataaagttatttttataatttttgttcttttagtggtgttgattaaagatactttgtgagaagttgttaaaattcaaattgtggtgagtaggcattatttgcctaatgagttaccttcatctcatcttataatagcaaaatttattttaatagacttctgtatttttcaatcccaaaccacttggacatctcacactaacttgcggcctttttaccaagaatggtatgatatacctaaacttaatagagcttttgaattctgaggtttccactctaggaaaattctgattttgctttcctgggttaatttttagacaaatcttcagtcatgttttatgtaaccatgataggttgtttctacctaatgacagtctaaaattatataatcttcgaaagatctgtagatcaattctggtctcttaataggcatctgttacgttatatgtaacaagttttccggtctccgcatgaatatcccaggtgaagttgtaataattaacactatttcaccattaattgttttttgattttatgagttcagtaagtacaaaaaagctttttcaaaaggcaaggcattgtataaaagtttcatatgtgtatatactgcacttgaatctcatggagagagactgtagcagtagcatttcccaaactttattgagtagaatcacttaagggagaaaaagaaacaacttaggcagatgctgccataattcgagtgtttttaaaattttacacctgtttttcaccttcttggatgctttctaatttcttttcaaatcatgctacatacctaaatatcagtttccaagtttttctactactgctgggagtgtacagtaacactgaaaactgtttttgtaagggcagattgaattggtattgttttgtcgttaaagcaacttacttttttggcagccatactttgctaacttattaaactagcagtcacaactgaagctaccttttttctgtgagttattgtatagccaagtctcctatattaggtaattttatattctgctgtatttggggtttggaaattaaatttgctgtagtcaataaatatgtgacaagggtgcttttttatactattgctttttttaaaaaaaaccggtcagaacctttcagagcatttatatcttaacattttaatacagcaccccacatatatgttgctggcacataccggcactcaaaggtgaatgcgatctatgttctttaatgcttgacatcttatgcatcagtatgttgagctggttaaggtaagaactagagctgatgactcacttagtactaaagagattttggcattgtatttaactagtactcttgggaatatggtttcttgcttacaagttcaaggagacatttagtggagcacttgagggtttttctcagaaattgccaagacagcggctaagaatggatttttcgtcatgcctaatggctatgaatatggcatgagtgttacctgcatattcttgctaaagtcccccccccccagccacagagtaccaagaaactcaagttctaatatcatttatgcctatttaaaatatatatattaatatggcatcagttgcctatcttagaaactatttttatggctagtctgcagtgaatttcatgccacaaaaccctgtttttagcacttcttacttaccaggagcttgtcttctgtgaaacaaaatctctgtaaaactgtgtctcattgagataaagatacaaactaataaaagtcttttgaggattgagttttgtaatacacggtttagaaaaatttatttatccaaactcctgaaactgggtaacagatgtttttgttttcttgcagttcttttatccatttgttcactgctatgtgatccaaacccagatgaccccctagtgccagagattgcacggatctataaaacagacagagataagtaagtatgttaaaaagttattataaaagtggttttacttaatgagttaggcttatactttgcttgtgacagtgccaagaagacttgatatttagtaagataatagttaaaatatggagaaagctattgaaatgtggttatttaaaaaaacttaactaggctttagcttatgtgacagtgaatgctcccctctaaaatgttttattgttgttttttttttcctagcgtgttaaacagtatcactttattctcaacttttggggaagaaagcaaatttttctttaccccaagcatgtttttccaaaaatgttagtactattgtaaaaatttggtctaaatttctcaaatatttgaattatatttatgttcaacttaaccattataactttcatatgttataattaatgctaagtgtacttgttcaattaggtacaataggttagcaagagagtggacagagaaatacgctatgttgtagggtaagaggatctgcactctatggtgcgcttattatggtactgccagcacttgagtgctgcatgcgttaaggcactgtattaactaacaaaaggtaacaaatatggcagtcttctgaaaactgtacatttaactgcttggtctctgtttaacgtgaaagtaaatatctggtagccgttactgcttgaaagtattgcatggcaaagcagttacaatagcactagtaagaaatgggaatttatgtagtatcttttttttttttcaaactatcatggtgtttaaattttagcttgagactttgtaccaatcctatacagaatgtggtggtttagttcaaattttgccaggagatagtaatgtaagggaaaaacacttttaagcctaagcatctaaactaaatgttcattactgacaagcatgcattagcgtcagctgtactttgtggctccctgtatgctaaataaagcctttgttttaaagtgctggctttttgagagagtatccttaggagatgacaatgaattggtagaaagaactttttaaaaagtttagaaaagttgttggaccatatttggttcttggtttgaaataaagctagttaatatttaaacaatataaaaattctcctgtgcatatatatatatatatatatatatatatatatatatatatatatattcctttcttaaggttatcactgttttttgttgttgtaagtagtctatggcatgagtataatccagggggaagctgatagtatttatcaatgttagtagtcttcctgagtaataaccttgcttgtgtgtgaattacctgttgatctttttaaacgaagatgcccttgttgtactcaacaggtctcagtggtgcttattagcctcagttaccacacttattaaaagtaacacgtgattctgatgaacacaaccactcacacacacaccccttttgaaaattactgccctttgtcattctgcccagtgtcatcttccccttctgcctctacctaagtcccaaagccattttttcttgtaatatccaggaccaagtaatttcccaaactctaggattcagataaaattgttctagtaaaagcctagttctggccttggtggaaatttctgtggatagatagaatgtgtatactattttaacatttgtccataatgaactgtaaaaatttcttcacgttaaaattagagcatgagctcggtggtagagaaagaaagggtcttttgatttttgttagcctcccaattttcagtgctgctttcttagttgtttttaaaatactactttcagagcatcaggctctcatttcccacattgctttgagtaccagtgctatttctcccttgttggcttttattctaatcatagtcattagagatgacttcatgatgagtctggagatgataaaatggaaatctttcccttccatttaaagtattaggaattctttattttaacttttaaaaataacatctttatttacaggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattgg

SEQ ID NO: 35632 - DNA, 6012 bp, Homo sapiens
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggtgggcgaggggccggggtctggggccagatctgaagccgggactagggacaggggcaggggcaggggctgggagcggggacccagcactggccgccccgcagggctccgtcgcctttggcctggcgggtcggtgccagcgtggcgcggggcggggcaggaagcccggactgaccggatccgccacgctgggaacctagggcggcccagggctcttttctgtactttttaactctctcgttagagatgaccagagctggggatgcgggcacctgtcttccaggccctcttgctgtgtggccgcagactggtggttcagcctcttaactcggacatgaggtcgaataatctgttttggtttactgctatttctggagaggcgcggagctgaaataacagagctgttgaaagggctgggaattctgcgaggctcactggtctagctcagtatctgcgttcttaaaatggaacctacttcatgaggtctttggggagattgagacttggatataatgtgcctagcacttagtcctccgtaaatgttcactcttttgtgatcattgtgccttctgtgatttatgaagtgtctcttctgagttaattcttttaaaaaaaaaagtgtctcctccaacagacacggacccatcagcaggtcactgcctaggatctcaacactagagatcagggagtggcatcagcctctcccttttctaaattggactgggggacggagggttgatgtcatagcaagattgcagccttcactagattaatgaggccaggttggatcctgtttaagagaactggagacaggaagcagcgggggaatagatggggaaagaggaaagttccttatgatgcaagatgaatagtgtgtgtgtccagccccagtgctgtgacggggatgagtctgaggtggacggatgatgcaatataggagagaataaagcaggtcttcgagctagattgacagaagactgtattttttattttgttttattgaggggaggagcctgaagtgtattttatcattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaaggctcgaatgagtgagctggaacagcaagtggtagatttagaagaagaggtaaaactacttaaggtcaaactcttttatccattgtatacccttccttggtgaatgttctgatatttgcttcccatcccaagttgtttcagcccctattagaatacaattgaatatatgattaaaagttaaactaggctgggcatggtggctcatgcctgtaatcccagcactttgggagcctgagttgggcagatcacttgaagccagcagtttgagaccagcctagccaacatggtaaaatcccgtctctacccaaaaatataccaaaaaaaaaaaaaaaaaaaaggccaagcgtgagtgcctgtagtcccagctactcgggaggttgaggtgggaggattgtttgaacctgggagagggaggttgcagtgagctgagatcgcaccactgcactccagcctgggcaacagagtgagactctgtctcaagaaaaaaaaaaaaagtttgctgggcaccggggctcacacctgtaatcccagcactttgggaggccaaggtgggtagataacttgagatcaggagttcgagaccagcctgaccaacgtggtgaaaccccatctctattaaaaatacaaaaattagccgggtgtcgtggcaggcacctgtaatcccagctgctccggaggctgacgcaggagaatcacttgaacccaggaggcggaggttgcagtgagctgagatcacgagatcatgccactgcactccagtctgggcgacagagcaaaaaccctgtctcaaaaaaaaaaaaaaagttaatctaagttaggacagagagttggtgaagtggtgaagcttgttgagggcagaagtgattgactttgtggcatttggtgctagatgtatctcaaagtagatggatttaacaatgtttattgagtttgtagtaagaaattagcaagggctaataggaaataattgcttaaactttacattcttcctggcatggccagaaattcactaaaggttcctttccccctctagggtccacctgttaatcaatcttaaattgttgccaattacacatcttgaatacatagagattatttatattgtttttttaaccccttggtcaatttgcatatattgagctttttaaagttttaatcattagttggttcttctaagaatcatgagtcaggagcagggattttttttaacttattttggatttatagtcaccactaccacttttattattacctgccagttcaagatagttatttatttttattttatattattattattattattatcatcatcattattttgagatggagtctcactctgttgcccaggctggagtgcagtggtgcaatctcggctcactgcaacctctgcctcccaggttcaagcaattctccctgcttcagcctccagattagctgggattacaggcacccctcaccacatccagctaatttttggattttttagtagagatgggggtttgccatgttggccaggctggttttgaactcttgacctcaggtgatccacctgccttggcctcccaaagtgttaggattacaagtgtgagccaccgagcctggccaagatagtttaaaaaaaaaattatatctacattaaagccacaagtcaccctttgctgaagtcagtattagtagttggaagcagtgtgttattcttgaccccatgaagtggcacttattaagtagcttgcttttccataattatggcctagctttttaaaacctactatgaacaccacaagcatagagttttccaaaagttcaagaaggaaaggaaaccaattatactgaatcaggtagattcttaactgaaataattagatgttttaatagcctcttatgaactttcttccagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaacaatcaaatggtctaagattgacagtagcacagttttactctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatatagaacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgc

SEQ ID NO: 35633 - DNA, 212224 bp, Homo sapiens
caccccatccccgggaggtaggtagggggcccgaggcagggagatgccaactcactggggctgcctcccgggtgggctccgcggcggcggacgggcgggaggaggggcgcgggcccagggccggaggacgccgctgcccgcctgccctgcgcccggggagccgcgtgggggcagggaggctgcaaagcccgggcgggggcggcgcggggagcccgggtcgcgggtgctcattggtactcggatgatgcgggacgaggggcggcaggctctgcggtgaggcggcagcagacccgccgtgcgcaccgctgccgtccggccccagccccggcgcggcgcggcgattcctcctccctgcctccgccggcgcctccctgcagccgggcgcggcggcccctgacgcggaggcccctggcgcggaggtgggtgcggagcggacagcggacagccggagggtctattttcaggtgccctctctgtggccccgcgggtggggagcgggggcggcggtgacagggccgggctctgcgcgtagcggtgcaggggatgcggccaggcgtggtcccggctgcgccgcgctgcagctgagccggaggcggcggccccgcgcccccacctccgccccatccctgcgcttgctaccctcgtgcgcccgccccccccccgccctttctgccgtccccactctcccagggctgggcgtgagccgcctccgggcgccgagccgccgctgcgcccgcccttcagctcctgccaccctctcttcaacaggtttgtctcagcgcagggaccctccgggcctgctttgggtaggtgggctggctcgtcatcaccccccacaccacgcccacggccctcttttagggggcgccttctctttgtttttgtgataggaaaggtgccaactgctgccatcagatgaggagggggtggggatcagaacgcaaacctctgtccattatttttccaatcgaaagccaggccagatagtaagtgaggacagggtgcgtgtgggggtgcttcggcggagcagaaaattgaattcggtggggtttatttgggcggggatgtgcttttttggcaagatggatggctcacggtgccctcgccgtgatgcagcacaatgcagcagtatcgcagcttccttggttctcgctggcggggcttggcacggccgctcggcgcctgcggcccccgcccggccccacccaggcccggggctgcccttggccgaggcctggagctgctgctaccttgtcctgcagcttctgctggatgtggcgtcaggaggaccaggtcagctaggtgtgagcaggggagagtcttttcttttgggatgatccctcctgcacctcttcttgggctgcgctctgccggaggggcgccctgcatcaccagtgcaggcagaggggagccggcctgtggttgcggatcggaatctgatctgcgaccaggggacctgagccatagggaggggctgcaggaaggactgggcccagtggtgtgcggaggcaatgttgcagtgtggggagtcgcagcgtttttctgtggatcgtccataatctgtaaccacaacccagctatgcattaattttttctacgtgaaaagttggtgtttattaattggaccttcacaactgtgacattacagtacctcgtctgtctttggttaataccaagtatgcattttttctgtaggaaaccatttttaaatgaaatgattaatgcattttgggttttatgtcactaagacatttataagtatattaaaattcagtaggttgttttaaaaggaatttatatgttttttaatggatagtaaatgattcctttagcttgtattttgttttcatcgtttgctttttctaagtcaagtacagttgcattatttggatgctttattaaggattattaggtgtatgagtgtcatgatgggggctaaattggtattcagatttctattgattgaggtagccaagttaagtgtccgggcgtaattaatgggattatgacagtaacactgcgtttgtgtttgtttatatgtattttttgtatacatatttttcacagctgtgactggggagagggtggagaagggcagaccaccaaggcctcttgactggcatctagtcagaaggagatggttcccagtgttctcatgtttagtctcggccaggacacagggaatttcccttctaaatgccatctctataattcattattcagtgtgggatggcaaatgggatatatttcaaatgtcaacccaggctttcctaaaatgtttaggtgaaaaaggaaatttcaatatgctagttggaagggaaggtcagtgtttacaagccaagggcgtgcctgcttgtatttttaaatatttctaatgaatccaagttagttgcttttgatttcatgtggctctgcagaatagaactgcatgtacattgtgtggtgtatgtgcgttattttgagtttctctaatagccattaaaatatgagactttttgtgctggttgtgtaaaatcgtgttgcgtacagatttttatgaatgttgttcccatggatcatccaaacgttttggatttactttgttgtaagaaatatcctgtgttgatgtcacaggaggtttagctgttctgacttacacagcaggtgcagaattctgttgggttaagctctttgtaactctgtcattactggagtgaccaaaaccttcatctgagaggagaagtattgggcagtgaaggaactgctgtcactaggtcgtctcccacagttgaggttttctgtgaagaacttctcttgggcaagactagtaacaactatctgtgatgttgcagagcaaatgagaagacctccctctacttgtgacacatcctgagcagaggcttggcattggcagagtttcctggaagggtttgtagagtggttgctttgtcttgatgtttgaatgtatgactttacatgtggaagtactattttgacgtggaaggattttactactgctaacatagacatgattagtggaaatcattcagtgtggattttgtcgaaataattttaagcttttctttttaatagcatattcttatagaacattttaaagcctaattttttttacgtgcaatgacatgatgctcctttaattatgttgcatcgtaactagtatcttcattataattgggctttatttaatggcagccgtagtttctttcactacattattggaaatgcaaaccattcttccagaaggaaggggctaactacccctgttagaagagtgaactttgtaggtctgtggaagtgagtaaagcatctcatgggtttttcttgtaaattttcagtctttgctttttctcagggcatcttttctttgcaaaagacctagtttagtactctgatttttccggtagcacttgtaattatatttaaatttttattgtgtgggaataacatcatctatttttttctactcagtggttaaaggaaattacaccaattagatatacctgtgtttctatttttaaacatctctggagaaggcattttcataatgtcctttgctatcatagtgaggttcacggaccttcaacattagaatcgcctggaagcttgttgcaaatgcagattcttaggccccactctgaactcagccaatcggaatcaacattttaacaagacctttaagtgagttgtatgcacattaaatgaagaaactctattctgttccttcagcaaagggacctcaatatcaaaagtttccttcttgaattttcctttcttttgctgaagtatcagcacatttttttccttgatggtggtgacaaaagtgaggctctcactgtaaattatttgtttaatacaaaattattttataaagctgttctttaattcttggtggaagagtcctatataccatggtttatttagattaatcagtgttttaggttgttttgtaaaacacctctaaagttgaaaaacagtctttttcccctctggaagaaaaaggcattggttttgagacatcagagctggagcctcggaagctaacccctgagcaaagggtcctctctgctccctctgctctggcatcttgatgtctgtcatctgatatagtcaatgtcctgccctctcgtccagtcttttcttagagttcttttttgaatcaactaattggtaggtacaaaataatgttcctaaaatatatgttaaagaatcgtaaaccagctgggtgcagtggctcacgcctgtaatcccagcactttgggatgccgagtgggggcggatcacttgaggtcaggagttcaagaccagcctggccaacatggtgaaaccccatctctactaaaaatacaaaaattatctgggcatggtggcaggcatctgtaattcccagctactcgggaggctgaggcaacagaatcagttgaactggggaggcagaggttgcagtgagccgagatcgcgccactgcattccaacctgggtgacaagagcgagactctgtctcaaaaaaataaaaatcataaaccaagggacactcaggcagccaccggctagttcaggaagagccttatacattcagagcccacctccatcatcccatctgaaacaacccatatccttgattttgtgcatatcattcccttctctatggtttatcctttttaaaaaatcttgattgtgtatgattttgaactttatatcaacaaaattatactttatgtattcttctgactcacatatttagattaagattctattcccaaggtttatccatttcatggctgtatttcattcagtttcacctgctgtatagtattctaacgtgatttatttattcattgtactctagatggagatttggattgattccaggtttttttgctattgtgaaagggttgctgtgagtggtttttgtacacggctcttggtacatatgtggaggcacacacacccatttgctgtctctagggaatgaaattttctggctcacagggcatatgcatcatcagccttagtagagaatgtagaactgttttttacaaagcgattatgttgatcgtgttcccactagccataagtgttacagttccaaagccttgccagtgcttcacataccaggcttgaaaatcttgtccagtgaaacattatctcactgtgatttttatttacaatttctctgattattgagtttgaatgtctgtttacattattaaccatttgggttcttcgttttgtgaagtacctgttcagtcttttacccatttatcttattaatttgtagttctgtatgtagattactactaatcctttgtggattacatgtcttgcgacaattacttctcagcttgtgttttttttcttaactcgaatttgtgatttcttttgatgatcggttatttgtaatttagcagagtcataatcagtattttgtcctttaaagtttgtgagggtaattttcttatttcagaaaagtttttctttgtttggaaagagcattcgttttggagtcaaacaggttgtgggcccaaatcctaatggtgttgtatactagccttatggctaccactaggtactggccttgagctagttagttactcaagaccacagtttcctcattggaaaaatcaaaataatattagtttctcttagttatgatacagcagtgtacagttccaggcacatagtacgtatttagttgataacagttgtttcctttctgttgggactgcctaagcactatgacccactgatcccttttggtatgctttgcaaaaactacctaaacctttttatgtcaggagagctattaaatggcttattctaacttttgtattttaaaaggctgcattaccaatggcatttatatattgattaatacagtctgaagagaccacttactagaaacccttatcagtttaggttctggttcttgaaagtaatgtaattacatttatttgtacacagttcttttgaccattaagcatttatagtattaatgatcttcctttactgctactctgagattactttgtaatattgttttttatttaatgaataattattggatacattatcttgccaggacttgaagttgttatggttttgtggactggcttaaagttgaataagaattagttcctgaatgaaaggactgtatactctagtatatggaatatattttatgtactatacacagaaggtaaaatacctttaacaggctggatgtgtgactttggcaaacctttaaccctccggtctcagatctaattttataaaatggaagacttagatgaaatcatagtgggggttaaaacatggcacatgccatcactcgcttctgttcctggcagacatcgaaaatcagtaatggtactctttttccactgagctgagatagtctcagtcatattctcgacatggtgttctaggcagtaactaccactcgattaaatctggcattcagtttttaagctcctgtacacttctaaattctgtgattataagatacttgagaaactcatcaccttggcagtgttcagaatacagtgagactggaagaaactagaagcaaggagacaggagagaggtgactgggggtccagaagtaaagggagcaagttacagtggtggccaagggaacaaggagaggagagatgggaaaatggttgtgaaggcccaatcctatgcgaagctatttgtagggtaaatggatggcaggatggatgggaggtggacctagtgggtgacgagctaagctaaggtgataaagatttcaaatttgaataatgacaatgagcatgtttggtgatgatgacaaatagacaagtcaagtgcatgattggatatttgattgggaagagtatcagttttgctttaaacatgtttgagtttgaggttccagcacaatcctcagtggagctggagagaggtcatggctagagaggctgatgggaggctttggatggaggggccctgggccccaggcttcaggctctttacacaacccacccacctcgctcacacgctaagtgaccttgggcaaactgcctagacttctttgtgtccctcaacatcttcatctgtaaaatagtcgtaatgagagtatctaccacataggattattaaagccaaatgaggtaattcagcgcttatcacaataaattttaatgattataaaatgtggaatttttgcttagtttgacttaatattatgctttctttcaaataaacagtttgatttgtttagaaaaggtatattctagcaaataacaatcatttagataaataatgctaagttccatctgtattaaacctgttcctatacatcatgtcaaaataataggaaaggaaaatctgatttatatatatgtattttttaaacaaacaataaaatgctaaagccttagtagctaaggaaatgatatgagcagatagtttataaaagaagaaatcaaggaggtcgataactgtaagttcaaactcaccagtgtatgaaatacagactaaattaattaatttttccacttaatggatagatattatgctctgggctgctgtgagatgggagctctgcatcacctgttgagagcatattttgattaatacaaacttaggggaaaacagttgggttatatatatgtaacagaagccttaaatgcttatacctcttgaactgaaatctcacatgtagcttggtaacctacaaaaacaattaaaaataaggacaagtttttaaacaaggattttcttggcaacattaatagagaaaaggggaaatgttttttaatggaacataatcaaataaattatggcgcaactgtagggtggaattcaatgtagtgcttaaaataatggtttggaagaatattactgagatgggaagatgccggtaatacaggggttagtggaaatatctggatgcaaaattgtatagtgtactataatcctggttttactgtattaagtaaaagactggaaggaaatacattaaaatgttaatggtttgctttggatggtaggttgatgggtgatttcctctcttgtatgaaaggaaattcccatgacttaatgtttctctttttgagttttgaaatatttcacggtagagaagaatgcagtaaataatataatagatgaccatgaggaccatttgttttggtttgtttgaggaacttttttttgttttattttgttttcttttgttttgtttgagacagagtcttattctgttgcccaggctggagtgcattggcacgaacatggctcactgcagccttgacctcctgggttcaagcagtcctcctgcctcagcctcccaagtagttgcaggcgtgtaccaccacacagggctaatttttaaaccttaaatttttttatagagacgaggtttcaccgtgttgcccaggctggtcttcaactcctgaactcaagtgatctgcctgccttggcctcccaaagtgttgggattacaaatgtgagccaccgtgcccagccttgggcaccattttttaataatcaaaaaagcaatcaacactttaaaaattctaatttttaaaaaggaaagaaaaaagtaaatctgtccaattgtagatcattattaagaaatagttttaaatccagcgattgttatatctgtccttctttgcagttttctaagagcaatgatacagtgtgtaagttagcatcttaagggtataggtgtgagataaattagtgtattcaaatgtattaattctctacactaacctaggcagcttgaaaagagcagaggaccagggttctttggtatttccagtctccacacttgagtgcagagcagtggaattccatgacgtgcatgttctcactcgtggaaacctaaacactgctactggagctagtttgtaaccattagaccatcaggtttcagtggaattggtcagaaatgaaggtaaaattccaagtgaacattttaaaataaaaatcacttcagatttagatttactttcagtgaatggtatctcagcatctgggaatattgtaggctaagattgagaggaactaattttaatattcttcgttttttgtatgaaaagaaattcctgtgcaatgttatatttttgtatatatacatatatgatgcatacatatcatgtttatctcatatatatatatatatatatatatatatatctcacacatgggagagagaggtgtgtgtttgattgagtaatctctaccacgaagggaggcacatattttaaaacattttaaatggggaattttatagagacagtattttgaaaaggagtcccatgaatgagtcaagttgtccttagccagtggaggaaatgtttgggagggaatagtactttctattttatggtccaagtctctaagtgtgttggtactttgtgaaatgtagcttataaaaattaatgaatttccattaattttgtattttttctgccatcagctttaactgagtggttgtttgaagaagctttcaggattaattgtgctttgacatataaaaataagatgttatcaagattgctttaaaactgacccttgtttataggagtcatacgtccattcttaagaaactctcaactgtgacagtaaacatctgagtgatttttagaaccattttaatatctctgctctagaatcgagaatgccctgttagttctgatttttaatatacaaatttgaagccactagttaggcagtaaaatatgtattagaacataactatagatttttacccaatagatcaattagtatgaaatttaggatgatatataagtacaacagaatttattcctttgaggtatgtattttcaaagtgtaatttgtgtaattaagtatgtttattcttcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcgaagcttgcagtgagccgagatcgcgccactgcactccagcctgggcgacagagcgagactccgtctcaaaaaaaaaaaaaaaaaaaaaaaaaaaaaaaaaaaaaaaaaaaaaagtatgtttattcttagaaagttcatgagcctattaacattggttatcttgggtaatggaattgcagaagatttcatctctgtatatttttttctccatattttttaagttttaggaaataacaaattcttgttctttatcaaaaatatcctaacacttctgaccaaacctcattttagctggatacaaactaatcaaataatttaccagctaaatatactttctgctgttcaatttttttctaccaaacttacggaaaagcagtattaataatgaagatataaagaacactgaaatttttgaaagatcttttcattccttgtttaaatgttcatttttgttacagccttggcagttcattacttatgcagagtgtgggaaaagctctaagaactggccgagagagcgcctgacagaaacattgtccaggaggaatcagccactaatggccactgcctttggctctcggtgaagtttcgtttccctacagtactcttgggtggctgtttcagggatacattttgttctagtgtgtttgcctcaaggccaaatataaatgttgaagggctgtacatttttctggaatgttcttcaccagctgtaaagtcttgggctgggatagggataggggatttttttgggggtgggggggcttttttctctttatcttatttacttgaatgggaaggaaaacttagattcttccttaaaacaatgttatttattttgatctgtgatgtttaaacattttccacggcattttgaaacctgtaaacataggagtactttgttgttgctgttgttggagacaaagtcttgctcttatcccccaggctggagtgcgatggcgcgatctcggctcactgcaacctccgcctcccaggttcaagcgattctcctgcctcagcctcccgagtagctggcgcctgccaccatgcccagctaatttttgtatttttagtagagacgggtttcaccatgttggccagactggtctcgaactcctgacctcaagtgatccaccctccttggcctcccaaaattctgggattacaggcgtgagccaccgcgcctggccaggagtgtttttatagtgattacaatagttttaaaaattaaaatagtctttgtatttttaccaccttagaatccctgatttttttttttaaatttctgctaatacacatagtatatgtggttttttgaatggcttatgaagactatataccatcataaaggcataagttagtataaaatcatcataacaaaatacaaaagtatttttaagatatctttttattactgaaataatagatgttttagatcatatggaaactaaagatgaatacaaagaagaaaattaaaatcactagatactatgtgaccccggaaacatacagttaatattttagtgtttctcggccaggtgcggtggctcacgcctctaatgccagcactttgggaggccgaggcgggcagatcatgaggtcaggagtttgagacgagcctggccaacatagtgaaactttgtctctactaaaaatgcaaaaattggctgggtgtggtggtgggcttctctagtcccagctacttgggaggctgaggcaggagaatcacttgaacccaggaggtggaggttgcagtgagctgagaccgcaccattgcgctccagcctgggtgacagagtgagactcagtctcaaaaaaaataaaataaaaaaataaaaaataaaaaaataaaaaaatatgtgtgtatatatatttatttatttattttagtgtttctcttttaagccttttttttctgtgcatgtttcttcatctcacacatacatattaagggccaatcctccaatcttaaactgaagatgtagagttttgacagtctctataatgacatgatgatgttcagcactcttgcagcttatgcatgttgcatggcaaaacataaaatctaatgactggtctatagttaaagctgtagcatgaacactatctgttgccctgagctgttttaggggtgggatgttaaagaaaaatggaaaggaagaaagaattcaaaaatttgtttattatagctgtttctcttttatgaataatgtctttttacaatggaaaaataccagaaattaaattctcattagataatgtgctttctgttttgttctgaagggaattcccatcacagttgcattaattcccctgagagacatctccatatgcttcggacaacatctgattttacttttgtgttctgatttcagagtctttgaaatacctatcccataatgtgtcgcagtggaatggatgtggttattataatcttggttttaagtgtaataaattttactgggctgggtttggttgtaactgatgaaagcatatactagagctcagctttcttggggtctttgtattagctggattctttacaattctatcttgggatttaggatctgtttcaagaagaaaaagcgttatttctatttgattatgcaagccagttctttaagcctttaggacatcagatggatggaggtgacttgctggcctttgttgcctttaactctagtattcggcttctttctgaggaaggtgccaaaacggcttccgtatctgctgaaggaaaagagggagtgggaagaggggagaaatatttcattggaagataaaaaaagctctttccagcaatttcctttagaaacttgggggttgctgttagtctcatttgggtaatgggccccaaggaaaagtgacaaatggccttcttctggggtttaaacactaaaggtcagtgttggcccttttcacagttaagagggaaaaatctgagctgggctgggtggactttctccaactaagggattcttctgaaactcctaacctgatgggaatcattttgtttgcaggtggccaaagcccatcaagggaaatgcttgatggttactgtgcctgagctgcctgaagcctggtgtaggagtctcaacttgatcttgaggcagctgcaaatgttaggtcttgacacttgggatggcaacaagaccaggcagtgcccagagtggtcccagcggcctaggttagaggagggtagggggctggaatgtggccttagccagtcctctgagcagatgagaatacctgtcactatttcaggagatgagttgtggtcagagatatcagtcaggtgacttctctgagaggggcctggtccttctcacagcaagattgacaagtctgtgctgccagttgtccctaaatacccaatttatctcctggggtggagttggggaagtgcctctagcctggagcaaagagatctgcctgccatttcggaaggaaagaaaccagcacacatcctgtctttcattctctgtttcaaaggtaggtttttgtctgtttgcttgtttttaaatcaacacccagggctaaaggaaatcccgagtttccctgataatcaggatgatttcttattttgaaaggcctattttgccttcgaagtgtgtgtttctgacataggtttcatcctagttctagaaatcttgcttaattcataaaaggtaaaagtttaattagagagaaggctgatgtatcgtcttgtttcaaagggagactattcttgtctgtcatttgaattttttatatatattttttccggctgtgaagaaatattttattggtacatgtgtacatgcattttttattcttaattatagtatgtattttcactggactacactcttgttaaaggaaactttgttcacgtgaaataaacctatctttagtgagtcatacttgagaactgcttctcagtctcctcaacttttaaagtcagtggtatttcatgtaaagagtgtatcggtagctggcctatctctggaatgttgtgcagctgtgcagagcgtgagtctcaaatgtgctaattaaatatgttttttagcaagaatggaatgtagcagcatttgaatggcttcaaaaaacattccattttgtttctgaagagggcttttttcgtttttgccaaatattaaaaattagagagtacactgacttttagaggatgtattgctatgttaaattgttctgttcaccagaacagggtggcatgtgcctgtaatcctagctacttgagaggctgacgtgggaggatctcttgagcccagggcttcaagactagcctgggcagagtagaaagaacctgtctcaaaccccacactgttcttttcgcagagttaatggggctcattaaatactgagattatcctttagaacaatcttgtccaacctacagcctttgaatgtggcccagcacaaatttgtaaactttcttaaaacattatgagatattttttgtgatatttatagctcattagctatcattagtgttttactttatgtatagcccaagacacttcttcttccagtgtggcccagggaagccaaaagattagacacccctgctttagaatgtactcaattaataatcttcaaaatgtagggattaggtggggtggctcatgcctgtaatcccagcacttttggaggccaaggtgggaaaattgcttgagcctaggagtttgagaccagcttgggcgacatggtgagacctggtctctacgaaaacaaacaaaaagaacagaatgtaggcagtggtggcatgagtaaggttctaaggtttaccatctttagttgatcttgctcatttcccttggtatcagttctccttccttacttggtgagtgcttaacctttctttgggcagtaaggcatgacatttctccccaggttgagcagttttctgatacatattttttggctgagtgtgacttgtatctttttggactaagctccattcactcagatggtggtctgatttttttttttttttcagtcaggcattgtgcaaagtgacctgatgggaataaatggcaggttggttgtgtaatgcagcaacatcttacttggttgtctttagagataagtgggacgtgattccagcaaggctgtgcatcaaatgttggaatgtgttggagaactgccaagaggttgggagcaagctgtgtgacaagcactaatgcagccttggcctgccttaaaatagctgcaggttaacaaatatcttgaaacttggcatttcttttgagcaaaattgctcctctgaatgtgttaccaagaggtgctttcctcttttttatcgatttttttttttttttttttgctgttccaactgtcttaaaacatcttatgagcatatgaagaagatataattctctgtaacatcttatgttgaatgattttactggactaattattagcacattatctgaaacttcacttgtagttcttctgctctgctcacccaactcactgaaaaatatatagtctttgtagtttgaataaaaactggggccctgaagatgtttttttttttttttttttttttgagactgagtctcgctctgtcgcccaggccagagtgcagtggcgcgatcttggctcactgcaagctccgcctcctgggttcacaccattctcctgcctcagcctcctgagtagctgggactacaggcacccaccaccacgcccagctaattttttgtatttttagtagagacagggtttcaccatgttagccaggatggtctcgatctcttgacctcataatccgcccgcctggacctaccaaagtgctgggattacaggcatgagccactgcgcccagcctgaagattttttttaaaagtcctatattttatatgtttgataggcttttggaaaggaattattgatgtttgaacactaacacattagagaggcagagtcagaggcattggttactttgctgtggaatcttgtcttagctgattcacttttagacttcttagtaagctcattggtagtttgtctgcagtacttagttcttgtttgtaattaattcactgtctaactgtagtctctcaatttttttcaatagaaaggcttgttttttaagtcagagtggtaaaaacagggggggttgggagtggtctttgaaatgggtcctgtacagacttgagcctgatggtgatgtgatcaaggttgcagggggtgtgggtacctgggtggggctggggctgcctgtgggactaatctaaacagccagttagtttgggtgctctgaatatgacatttttaaaaatgcagtatttgggttaatgattggaagtaaactaagaatttccaggatttatatgttaaatagcagatgaaaacagtgagttacatgttaaatagtagatggaaacagtgagttaactttattttgagaggcttaaatacaaaccaagtttctatactaaaggatttcctaaaagatgatattaacagatatgttaattatcccataacttaaagtcctttagacgtttagattgagactaattgtgataatttcatagctctgtagcgtatcctgaaaatggctttgtttcttttgtttcactgtcttcatatgtgtaagtcttgaattttgctttgtcactttccgtattttacatgtattttagaggtcctctccttgtatagaaacattatttctggttttatgtaagtgccttatacagagatttataatttgtaattactgtactttttggtcaatagaattgaggttatttggggtatgtttttagaatatgttaaaaaccatattttgtgtttttataacatagaaaaatatttcttggaaaatgcgtgtgtgggcagcttcttttagatgtattgatcttttcactttcagatggcaaatgaattctatatggcattgttgccatgttggaaaatttctttattgagcctatgacttctaaagtatcaaaattctgtttttgcttttcccttttattggacatctccagttttgttttttttttaagcacacacgcacacacatacacacacatccttggataactgaactggtaaattgtattgaggagaggtgaactacaggccaccatttcctttttacttagcataccattatctggtcccctcatgtgaaaatatattttggatagttttcacctcccaccatctattaatttagagtgtgcattcctttaaccttgcaggagaattcagtcattcattatacgataagcaggcaaaaagttaaatactcaaatgttccttttctggattattgtctgaattagaaaaacattcattttaaattttacacatgtatatgggatgttctgtctcctcgtctgtatgccttgtactggcacaagcttataggactaggaacaaataagcttagcatttaaaatattccagacataaaaaatctatggaatttgcttatatctactgggggatgcagtcagacagacccagggttttaactggctccttctgcagtgtgaaggcagacggaaacattggagtctgctgcagatggcagcagggtggacaggtgaggcccacatggaagttcataccactggtaggtggagtaatgagttggtgtatgaaatgctagccattttagatgtttctacagctgttgttggctagctgaaaataaattgaacttgttgaactggtaaaagttttgctgtctgaataggcttagataaaatagtgcttcagatgcctataaagatgtctattgtaacattactatgatttttttaagtggtgataacctaaaagtccatcattggtaagttacagggtggactatatattctggaggcaatacagtgtgtagttaaaagtgctgaccgtggagctgtggtgcctgggtctaaaacctgatttcaccatgggcccactttgtgaccctgagcaagtcattaacccttctcggtctcagtttcctcatcagtaagatcaggataatcatagtacagaccatatagggttggttggattaaataagttataggtaaagcagttagactagtgcctggaaatatgtaagtattatttactatattaataaaaactttaatattattatggaataccttctaataacatgggaaggtttttaacatagggagaaaaagcagaacacaagattatataaatggaattaccgtaactatgtagaaaaatatacaaaagggataaggaaatactacaaatattaaggtttttgggggaggggagaatggatgagattccttgtgatttttgcttttgtctcagagctgttttgtattttctgctgttctacagtaagcatatgttacttctataatttgaaaaagtaaactttgttttcaaaagtggatgtaggctgggcgcagtggctcatgcctgtaatcccagcactttgggaggctgaggcgggtagattgccttcaggtcaggagttcgagaccaacctggccacatggtgaaaatacaaaaacacaaaaaattataaaaatacaaaatataaaattataaaaatacaaaaaattagccgggcgtggtggcacatgcctataatcccagctactcaggaggccgagtcaggagaatcacttgagcccgggaggcagaggttgcagtgagctgagatcgcgccactgcactccagcctgggtgacaagagcgaaactccgtctcaaaaaagaaaaagaaaagtggatgtatcccttgcaaacggttagtttgtcaattataagaacagcttattctttaaaagcttagggccttccgtttggcaacagtttgtctccttttggttccataatacttccacattcttacagaagctaatgggaaatgctggattaaaccacattatctatgctgttatctatgtttagaaacttttaatgatgacagatatgcagtcccttctctctgtggtcacatgggagaatcactcttgcctgctccccttgcattttggtggcatgttggactagttctgaggaatggcctgtgtccagactgcagccagagtccttgagtgagaatggtagagcctcctgctaccatgtgacaggcacgtaacatgagtgggaaacatgcttctgtgagtttgagccacagaacggcattcttacagagtgccttggagtaatgaaactcaaaactattttttaaattcatcatttagtattttccactaattcagactcattgtttagtgaaaagaatacagccatcggtaaggcacatgactgttattaacagtatgaatttagacaaattatgtaatagagttttagttttcttgtgtcaaaggcctcacctccacaaactacaaacaaaacttttgatgcttcaaattagtccataccagagtgtttagttttaattcactgctctttagtgcttgaaatgagattctttagaccaaagtggccttaaaggttcattcttgttgtatgcttattccacatttctctatatatttattttgtcacttctggtcactatatataggtttatttaagaaaaattcccttccatagtttatcaggcaggttaggctggtgctgcagtaacaaagatctccagaatctcggtggctcaaactcacagatgcgtattttccactcatgttacttgtccgtcacatggtggcagggtgctctgtgccatcctcactcaaggacggtggactgatgggctagatgcaggccattgatcagaataatcaaatgccccgcccaaatgctagggtagcaggtaagagtaatcctcccatgtagccacaaaaagaagagactgggtatgtgtgatcattaaaagtttctaactaaacatagataacagagtaggtaatatggtcgaatccagcatttcccatcagcttctttgaagcaccagttttgcagtatgttcacatgtactgttgataaagggcatctcctggtcaagtaaatctggagaatgctgggcttaataacatgtactaggcctctttagtgaaggtcgtctccgagctgttgtatcctaacaggcattctggaggtggagagtaacatacgatgtttcccaaacttacctgacctttgaattattttcttacttttcatagcctctctcggatgcaggttttgttgaacatgctttgggataccctaatttgtctaacttgttctcatacaaagcaagtatttggaattgcattttaattaatacttgcattgggaagaagctttgtttttattgtttgttaaaagagttgactatttgaagagagattttttctattgcaaatcaaattgcaggcagtgtttttaaaaattagttattactggttacatgcctgtgttgaatccataggactttttcttcatttagttgcctttgtgttctaaacttaccattgaaaagagaaaggtaaataaactttgaccacatatcttagtggttataaaaaaattaaattggtttggacagatggtccaaacacaccgagttttttttttattggcttcagtgtttttcttggttctctttgactttctgtaacaagttttctagaagttttgaaatgagatactactgaaatgagggctctgataagaaacagagagataacttttgtcaagaggtattaaatatttctctaccagaagactttggatttaaacacaacatttgttgccagggattttatgcctgcgtatgtaacaaatcttagtatggaagttttcacttaaaatggctgtaaacttcatgtaataaactttaggtaagaaggagcagcctccccaacccccgttttgtaactgtacatgggtaaaacttgataaagactaaactctctaactccccagactttcggatttgtggcattacctttttttttttttttaattaattaattcactttctattagaaatcatgttaaatccaggccaagaattcttttttcattttctgttttgtttgcttttttcctttgtgagtaaacaggtgcgaaggacaattgctgttttatgacaggaaacacacttttaaagctgtcagttacctcacagccccaccctacccttttcctgctgccattacgattaagactgactggtaggctgggcgcggtggctcatgcctgtaatcccagcactttgggaggctgaggtgggcggagcacgaggtcaggagttcgagaccagcctggctaatatggtgaaaccccgtctctactaaaaatgcaaaaattagctggcatggtggcgggtgcccgttatcccagctactcaggaggctgaggcaggagaattgcttgaacctgggaggcggaggttgcagtgagccaagatcatgccgctgcattccagcctgggtgacagagtaagagtccatctcaaaaaaaaaaagactggtagtagactttgctttttaaaggtgacttgggaggatttgaggcagagaaaaccttcttcagagccacagttcccagtcttatcctttttgttgataccagtattgtggaaaaagcattcatgacccatcacaaaaacatacattaagaaaacatttttcacatggtctgaggctgacaggaatcaggcttaatgtatccagggatatgacaaacatgggaacctgcaccagttgccacagagctgtccgatcctggtcccagggcccttgtctgtggcaggtcttccccggggaagagatttcactctcttatgagaacgctcgtgtttcatgccctcagatgcttgtgtcaggttccagtgatggtagccttggagtaagtctgcctttgagagaggattgttttttttcctcactcttcaaggacctgtagtgggtcccctgatgggccaccctctggacctggtcaaatgttggggagtttcgtggaagagcagtgttttcacattacagggtgcagctcacagtcagaaagattgtagaggatcatagaattggaagttttgggtctgggccgaaccctgtagatcttagtacatccacatgattgtatcaaagaagagtccagagctccgagaggctaggtgcaatcacacagcttcacacaagagtaagggctgaaactattgctgttaacagatatgtggaagtacttggtgtccttgcaactatttccagtgtgctgaaccttgaaaggcatcttacttctgctaattggaaccacttgggatgcattttaaaattatataaatgaagtaagcctacaagtttatgctcatgtttactgttttcatgttgtcaaactgttaatagcatgaatggttaaacatttgctgggaaaatagaaagtgttctgaaaatacacaataccagagataaaaaaagatgtatgtacgtatatgtgagtgtgtgtgtatatatatgtgtatatatatatatgttttattactagggaaaggaggaaagcccattgtgtatggaactaaaagccagaacctactgcatgtccacctttgttttaataaaaataacaaacaactgagtgtcctggctgcctggccaggctgaaggaaagtaaaggttgttttaaaatagaaaaagatctggttaaatatttgaccagatactttgattaagttgaaatgtttaaacattttcaggcccagggatgtcagtgaaggctgactgcagagtcttctctgcctgcagatgacttgtgttgtgtatagcaatgatttaaaggcaaataaagtatagttatagaaaacatgacccttaccaaccgcctcccccccaagttggtttgtaaccatgtaagaaatctaaggtatgattggtaaaattaaataaataaatcccattgttccagtcctcttctgtggaaggtaggacttgggagggagtattttacagtggttaggttctgtttcttggagccacactgcctggttggaaccctgcctctgctggttactgactgtggtctttggtaggtgaacacataatttattatccaaactaggtaatttatgagaatgaaaggagacacttttaatagttgtaccagtacagcaggcataaactaggaaggtctgaggcaaaccagataacatggtcactctagtcttaacgaagttacctaatcttggtgtcttggtttcttcacattgtggaagggacatgactcacttcctagggtgttaagattaaatgcaataaaacatgtaaagttttgcaatgttgtttggcacatagctattcaatagttgtagctatttaaaaaattatttagggtacttaattcatgtaataaccatttaagtattcagttcgctttctattatctttatattatttctcccaagcaaattttgctttttttttttccaagaggcaaggtctcactgtgttgcccaggctggcctctaactcctgcgctcaagtgatcttcctgcttcagccttccaagcaaactttgcttttaataacattaatatttactaatggcttattccatttatggcacctgctcaaacttaattgcttgctttatctgagccctttcctcagataaaggctcagaaagtaaaattgacttttactttttcagctacgtgtatatgtggcacttaattatataattagcacctgtggcccagagatgggtgctgggtattgggacactcatttatcaggttgtgtgtaattagcatctacactggaaagcaccttttgaacagctggcgctgagatacagaatggttgggaggttgagtgggtggggagtggcaaagcccaacctcttctgcctcttttaaaagttggatttttcccagagtagtgatatgcagggttgccagatttaggaaaaacaaaatcaaacaaaaaagaagccagaatgcctggttaaattttaatttcagatgaacaacacatcgttttttagtgtaagtttgtcttatgcagtatttgagacatacttatcctaaaaattcattgtttatctgaaattcagctttaacttgatgtccagtatttatctagcaatcctagttttgtaatccgaaagaatttttattctattcagtataacccacattcagatgtatatgaaacatgtagtccagatccttttataagtattgtgttaattttttaaaaaatccatgttgtctaccctccattggaatggatggttgagaagtcatcactgagttgctgctgctggttcccacaaaggccaagatgaaaaagaattcagtctggtttgccacagcagcagggatttacatttgctctttgagaacttattggctgtgaatgtggatgaacttaagccagctcttcttccttgcaggggagtccattagttaaggtgacttattgaagccctggccagctctaggagttctcggttttataattgaattactttagtaatattaaataatttggggagggggttaattttgggtcatttatatttcacttgtcaatgtagagggagctacttttattgtcattaagagtgacattcatcctggtgccatggtgagcacctgtggtcttagctacttgggaagctgaggtgggaggatcacttgagcccaggagtttgaggccagcctggcaacaaacaaaatccacatctctaagtaataatgatgatgatgataataaaatcctagaaatgaagaacaggtttggaaaaaaaaaaaagtaaccttcagatactcttcccattagaatctctcttgctgtttttgattttcagcagtgctgcccagaaagtgctggtgagctttttgccccagctttggaactctatcagcagtcaaccctgaagggcatggcatgcctttgggaaatgctgattggaagattagaggctgcagaaacctgagtgtgtgtgtgtgtgtgtgtgtgtgtgtgtgtgtgtgtgtgtgtgtgtgttttgttttgtttgtttgtttgtttgttttccaaactctggatatgatgcctctgttaaaccaagtccctgaggaaaagcttcaccagattaatgatacacttggtgaaattagtaatggcaagtaaaggttgagatttgtgcctgctggacaagagtgagccagagcaaatggattttggaccaataccggctttttaattgctgccatttaaagagtttaatgtccccagtgaaaaagcacaggtttcagataatcttttgaagaaaaatgcatagtggtaagagcttactgttaggcgcagagagtgtgtggatgggttagccaagggaaggaatccaattaaagctgtttgttcggagtactagatttggaggtgtgttttattgttaactggtaactttccagaaaatgaattatttgtatataaagattgatactagccaggctttatatactgacagttatttgtaaaacctctttgcttcctccttttaccttcttttctgagctgtctcttttcctccgcatggcttcctttataaagcagcccattttttggacatggttttgctattgatgagcctgaggtgtggcatagtaccacaggattgcatgatgagtgggatatttggcctcattatttacatggcttagtttttggtgtttgaagtgcctggtcggatagggattgactattaatggtagacattttcacattttggagcactgatcctcaatcttggcagcgcattggcatcccctgaggagacttaaaaaaatgcaggtgtcagccgggcatggtggctcatgcctgaaattccattgctttgggaggctgaggagggaggatcacttgagtccagaagttcaagaccagcttgggcaacatagcaagacctcatctctacagcaggaaaaaaaaaaaaagaaaaaattagaaacaattagagaaaaaatgcagatgtctgggtcccacttccagagaatctgattgaattgtctgggatacagaatgggcaccaggacttgcaagaggtcctcaggtgattgtaacataagccaagtatgcatgctatcctctggcctcccctcaaaattatgtctctggcctgtgctgtccagtagggagccatgagcaccaggaagttacttatgtttatgtgaattaaaatgaagtaaactgaaacttcatttcctcagtcacactagccacatttcgaatgctcagtagccacacatggctcatggctgccctgttggatagtatagatatagaacatttccatcacagcagacagtttcattgggcagcctagatctagggtgtcaacaaaacatgggaggagcatgaacatttaagaagcctgacacaggaaggacaggcttggaataagtaatcccacaggacttggcagtactgagtcactccatacttttttaagcagcctttttctcaatggtcttttggcaccagaagccccacagcagttggtgcaatggattatgtgtcacatcttacagaaaggccccgtttaaagcaggctggcccgaaggggtgtggtgaggactgggggcaggcaaatgtgaccctgaggaggccgggccagggaagagagaatgcagctttattctttcagagccgaggaatgccctggaagggaaccgaagcctgagtattggggttaaactaggtgagaggagatttttatctcttctgctggagaaagacctgcctcaatagtttgcctctgctggctcatctctagtgtgtgggaaacaaggacagtgctagcacatatttcccgtgaaataaactcccattatgggcccccatgttcttggagcactgggcaccacggggttaagaatggaatcaattatgttccatgtttgttcagacatagcacataagatccaaggaaggtagggtcacggaaaagcgaggggttagaggaaacatgaagtgtataccaaaggatgcggattttctacccgttgcttccctcagcaggacctttttggagattgttcctcctgcaggcgtgagaaaccctcacgtggagaggctgtctggaagcccgcagtctggtctgtaccatccaggctctttgctgtgccttcctgtctcctgcatttcgctggacattagcacctccccaggagcagatttctgttgctttctgtgagcccactataaagaaaatgccaagtgttcctgggcacaggaagtgggtaggaagagctctgagaatgcatggatcaaaggcacttgggtgatttaggggtgtgacccccagtggcttcacagggcctgtgagtcatttcaaagagtttctcctgttttgtcattgtctgctgttaaaccagggtgaagtttaagtgcctgttgcagaccttattgccttcttgctttgttccgctggtcaggttagtgttcttgacggggttgtatccaaatatctgtattggggctgggcatggtagctcatgcctgtaattctagcactttggggggctgaggcagtcagatcacctgagcccaggggttcgagaccagcctgggaaacatggtgaaactctgtctctgcaaaaaatacaaaaattggctgggcatggtggtatgtgcctgtgccttgggaggctgaggttggaggattacttgagctcaggaggcagaggttgcagtgagctgtgattgcaccactgcactccatcctgggggacagagtgagaccctgtctcaacaacaaaacaaaaccaaatatgtctgttggcaagtgataactgcacggtattaactgcctttctctgagaaataaattatcggggccctcctaggacttttatatgcttgggaattgtgtttattttcctctcattcacttcagtcctgctcttgactgccagaagaggcctgctctccttcctttcccattgtcagtaaattttagactttttgttagtactcatctgctatttttaattacatttcacacttttattttgccattttctatattctctttcctcaagctcagagagcaaggtaggaaatgttaacttctcctaagaacaggaatatgggaagctggaaagccgaaaaagaatgctaagaggaataataggaaagccagcgttgatgacaagtgtcttctgtagttgccatcctggtaactcttcagggtgccactattcctctatgcttatggatgtttgaggccttttataggatagaatttcaaaggacaagtagagaagtgttaactcctgggagtagttcgttggttttcccttcatccttttgcctgtacccggcgtggggtggttgtgtcggagacaagctcccagaaaggcgcaatgtggctcattccaggcctcaagcaccagaatacgtttagcttcaaaaatgacaagtttgataagagtgttcagaccaagaaaattaatgcaaaacttcctgatatagtatgtcagcgctataaagaagttcttgagtgtcgtgtaaaatacaaaaaatacaaaccattatcaaacctaaaaaatgtgttaaatgtttatgaaagacagtgaaggattcttatcacacagtgtgtagaccatgcgcctatgaacttgaagtttgcacagaatgtggaaagaaagaagacattgttattccgttcagtaaggaaccagaaaaaataaaatattgaaaacaatcgcctctccctctccctctccctctccctccgtctccctctccgtctccctctcggtctccctctccctctctttccatggtctccctctgatgccaagccgaagctggactgtactgctcccatctcggctcactgcaacctccctgcctgattctcctgcctcagcctgccgagtgcctgcaattgcaggcacgcgccgccacgcctgactggttttcgtatttttttggtggagacagggtttcactgtgttggccgggctggtctccagctcctaaccgtgagtgatctgccagcctcggcctcccaaggtgccgggattgcagacggagtctcgttcactcagtgctcaatggtgcccaggctggagtgcagtggcgtgatctcggctggctacaacctccacctcccagccgcctgccttggcctcccaaagtgccgagattgcagcctctgcccggccgccaccccatctgggaagcgaggagcgtctctgcctggtcgcccatcgtctgggatgtgaggagcccctctgcctggctgcccagtctggaaagtgaggagcgtctctgcccggccgccatcccatctaggaagtgaggagcgcctcttcccggccgccatcacatctaggaagtgaggagcgtctctgcccggccgcccgtcgtctgagatgtggggagcgcctctgccccgccgccctgtctgggatgtgaggagcgcctctgcccggccgcgacccgtctgggaggtgaggagcgtctctgcccggccgccccgtctgagaagtgaggagaccctctgcctggcaaccaccccgtctgagaagtgaggagcctctccgcccggcagccgccccgtcccggaggtgaggggcgcctctgcccggccgcccctactgggaagtgaggagcccctctgcccggccagccaccctgtccgggagggaggtgggggggtcagccccacgcccggccagccgccccgtctgggaggtgaggggcgcctctgcccggccgcccctgctgggaagtgaggagcccctctgcccggccaccaccctgtctgggaggtgtacccaacagctcattgagaacgggccaggatgacaatggcggttttgtggaatagaaaggggggaaaggtggggaaaagactgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaccatgtgctgtgtccactcaggggtcaatggattaagggcggtgcaagatgtgctttgttaaacagatgcttgaaggcagcatgctcgttaagagtcatcaccactccctaatctcaagtacccagggacacaaatactgtggaaggcagcagggtcctctgcctaggaaaaccagagaccttttttcacttgtttatctgctgaccttccctccactattgtcctatgaccctgccaaatccccctctgcgagaaacacccaagaatgatcaattaaaaaaaaataataaattaaaaaaaaaaaaagaaaatctaagttctaaccatagaagaagctgcagaagaaatgaagaaagggatgataatttagattttgatgttgatttagaagacacaggaggaggccaggtgtggtggcaagagccttgccggggtcttctgatgcttgtattgaaaaaactgcttttgctttgtaacaagcaaacataagtgttggtacttttgctctgagtcatttacgtgagatcatttatcaaacggcgctgaggaccagtttttgaggctagcaatataataatgtcatcttatttttatatgagctagttcttacataaccatcaattctgaatctggtttactttggtattaggtaatatacacagtttatattgttcatgtataaaatttgtttttctatagctttttctgatttcctcattaggatttcttttttttttttttttttttgctgctttttaactttttcaaaaatcagcacaatttttccctttgaaattaaatagattacttggtttccaacatttaattttgtctattatcagaaaaagttttcacgtaatgaaattaagcaatataatattaatggaaaacattattctcaggactaattactgcgcacctttgatgtgtacttgtttgcatttactatatgcatgacatactactactgtacaatgaatcgcagtgcagagtaatgatgattcaataaatgtagatctattttgcatatttgcacaacttaagaaataccaacatcattttctctgagaagccttccctgattttcagcctaggtacaattcctcagacatgtgttcacaaagctgcatacttttccttcacaatattatctaatgtcacatttcttcattaataattattaatgtcagtctacccactaaactagagtaccattgcttttctagtgttacaataaatgaataaatgaatcagtgaagtcatgtatcattaggatgtcgcagtatcttttatgaaatactcaaagtcaaaagttggtcagaatttcacattcttaaattggcttttaatatagtgatattaattcacttgatggtctcctcctgtgtctttttttttttttttgagacggagtcttgctctgtcacccaggctggagtgcagtggcacgatctcagctcactgcaagctccgcctcccaggttcacgccattctcctgcctcagcctcccaagtagctgggactataggcgcctgccaccacacccggctaattttttgtatttttggtagagacggggtttcactgtgttggccaggatggtcttgatctcttgacctcatgatccgcccacctcagcctcccaaagtgctgggattacaggcgtgagtcactgcgcccggcccatcatatcctttatgaataagaatttctagtcactaggtccaggagtctgtattttgaaattcctaggtgattttggtgaccatccaagtttgagacccactggccttaccgtcatgcctcaattttcaaatgaggaaactgaggactagggcgggaaagtgatttccttgcaattaaaggcagccagtggtaagacgagaccaaggacctttcggaggtcccttgcacccctgagagtcagtgactctctgttttcaccttggactgccgtgatgtctgactcatactgtagtcttcttcctaaaatcctcttctttttattttttatttttggcagtgtgttgaattctcctctagtttcattcagtgagtgctatttcttgcttcattataaaaggtggtgtgtcacaggtcctgtgtgatcacacaggctaagtgtaagctttgagaatgatctcttggaccctttttctcagatttcagtgttgtgcattattatctcatcgtggtggcttctttgtgatttagtttcccctcctcccttcaccataaaaaaagtcttatctcctgatgtatttttggctgcagaataactccagatggtacattttgtgtagggaaaaaaaataacagaatttttcacactcttctgtgaattattttttgactttcaattataatgaagttattaatcttacaaaggctcgctttgtaaagagactaatctgaataaacttgcttgtatacaataagtgccatggcaaaaattaagagtacagttattatcagagactaaaataacaatttaattttctagaaatagaaaattaagaaaaataacttttaatgctgggatttgacattaagaaatgaatgacaaaaatgggaccaaataaaatgctgtaattggccagacatggtagctcatgcctgtaatcccagcacttggggaggctgaggtggaaggatcacttgagctcaggagttcaagactagcctaggcaaaacctggtctgtatttaaaaaaaaaaaaaaaaaaaaaaaaccaggcatggtggtgtgtgcctacagtcccacctactcaggaggtagaggcaggaggatcacttgagcccaggaagttgaggctatagtgagccatgatcatgccactgtgctccaacctgggcaacagagtgagaccctgtctcaaaaaaaaaaaaaatagtaaatggtataactgaaagtaccttgaaaaaatatggcaatatgcagttgcaagttgctgatttttagaatcataattctaagccggatgtggtggctcacacctgtaatcccagcactttgggaggctgaagtgggtggatcacttaaggccaggagtttgagaccagcctggccaacatggtgaaaccccgtcttactaaaaatacaaaaattagccaggcgtggtggtgtgcatctgtaatctctgttcttggaaggctgaggcatgagaatcacttgaacctgggaggtggaggttgcagtgagctgagatcgtgccactgcactccagccaggctgacagagagagggcaccctgtctcaaaaaaaacccaaaaatcacaattctgatttgagagctgatgacagttgcagatgattaagagcttttacaaagagcgtgcatacatttagcaatctctaattgggaatgttttggaaaacactcctgagaatgtaggttatttatagaagatgtcctttactttgatataatcttcctaatgtggtttttatcagttggatttttctggatcaacgagaagacctatgagcctaaaatgtttgtaattctagctgtgtttctataagaacatgagagaacctcggcattaaccattcttgctggtctcacagaacaccccaaaaatctgtgcagttttgctggagtgatgacagagaatggaaaacaagtttatgaatttttttttttttttttgtgaggcggagttgcacttgtcacccaggctggagtgcaatctcagctcactgcaacctccgcctcccaggttcaagcgattctcttctttcagcctcctgagtagctgggattacagctgcgtgccaccatgccctgctaacttttgtatttttagtagagacagggtttcaccatgttggccaggctggtcttgaactcctgacctcaggtgatccgctcgcttcgacctcccaaagtgctaggagtacaggcaagagccacagtgcctggcctgtttatgaagattttataaacagatttctaaattcagaaagtatttaagggatcccctctggtggcactttaattcagatggggtccacaaaataggaaaatatttactaggaaatttgaacaatcttgaaatcactgaaaatggtgatgtgattctccagaaatttctgattgggaataagcactttgaagtaattggctatcttattaatctgctgttcctgaatttccccttagtagcggacatgctttattgtattaagttggataaccaccttagtagcaaagatgggcttgggcttcagtctggtcaataggcatcttattcaggtagatgccagatgggagggatggggacagcttagtgaagaaggatgaggctggaggtgactcttgaaaaatgattagtgttagttggaaagattaaggtgtgggagagtcccacgcaggggaacagcaggcagaaagccagggagagagaaaacagtgtgttttgaggacctcttctgctgtggctggaataaagagggctgtgttgaagagtgaagggagctgaggccaggcaaaaactcttgcatgccttgagaggaggttttacccaaaagacaagtgaggagggtggtgaaacattttagtcaagcttgtgtgttcttcaaagctcgtttgagctctggcatggaagaggatggatttcagttgggcaaaattcagagcagggaaaccagtcaggaagttgtggcaataatttggttaagaaactctaagggaccttactaaggtcaaggttagactttgtaaattttggggtccagaaaaactgttaataaacttaaccgacaggaagattcccctggcatcatagcctgtcactgtgaggatttaccttctttttcacatagtaatagattgtgaaaagtctccaaaaccatactcaaggattgaaggtcacattttctctttcgaccattctacacttaggtagaaaaaaatttcattaccaactagataataggatttgagctgttgtggttgacattcttgatgaaggactgatcagaaattcttggtcatcttatgtaagaataacttcttggagtaaatatgttcctgaagagctgccatttaaagtaaacttttgaatatcatatcttaaatgctttgtaatcataaacatttaaattctgtggttcaagtaatcatttttaagtaatttacttctaatttctctctcttttttttttggagacaaggctgtcacccaggctggagtgcagtggtgcaaacacacttcactgcagtctcaacctccttggctcaagcagtccttctgcctcagcctcttggtgtggctgggaccacagatgcatgctgccatacctagctaacttttcttttctttttattttttggtagagacgaggtctcgccgtgttgcccaggctggtcttgaacttctaggctcaggcagtcctccaccttgcctcccaaagtgctgggattacagtcatgagccactgcacccagtttgtttctctcttttttaaatccaaatttttctattaggctttgcaaataggcccttaaagaaataggcagcatggctggtaaacaaattttgttctttagatgtttccagagaaataatgtggtattttaagagcttttaacaagagacctcaagataattatttttaggatataccataatttaaaaaataacttctgaatatgagagtaatacattaaagaatattcctgtaatcctagagctaagccatgctataattctggtccagtttacggtttgcgctcacatatacactcacatttttataccctttgtttttatgggttgtattcatgctaaaaaattgttttgaaaacactttttatggctgtataaagtaggtgtaccctatttctaaagtaggtgtgccctattactggacatttagtttgtctgcagttgtttttttgtttttttttttttttgctactatagaaaagcacagtgatgagcatcactgcattcatatttttatctgaagttgccttttcccctagatccctgaaagtggatttgctgggtctgaggagttttacttaacacctttttcaaaggctgtgtcattcctgtgacctcactgcaggtggtggacctactgccctttgcaccaactgactgactgctgtggtagatgccttcgaacttaggcaagctagtaacattttatatggggtttggtttttactgaaaaggtttgcttctggaacatttatgtaagttacagcagtcttcatgctgaggacacatggacacgtctcttatgtctcaagcaaagatacccccagcctgatgtagaaatgtaattgactactgagtggatttcctttcatgtggaatagaatgagatttattggcttgtataaactagagcagaaaagttaatagaaataataaaagctatcagactctgtttagctctgttatgctattacactcagatcctttaaaaactgtgtttagaaaattgttgtgcagtttaatatgtctgcagaatattgaatacagtgtccatcagaaaatctaatccttttttaaagtttagatagaactaaataacatatcttttttttttttttttttttttgagacagggtctcactctattgcccagactgaagtgcagtggcacaatcagagctcactgcaacctccgcttcctgggttcaagggattctcccacctcagcctgctgcgtatctgggaccacaggcacacaccaccatgcctggctgatttttgcatgttttgtagagatggggtttcgccatgttgcccaggctggtctcaaactcctgggcttcagtaatcctcccacctcagcctcccaaagtgttggaattacaggcatgaaccaccgcacccggcctaaggagcatatcttgatgtttctagttttcttataatttccttctgtgttctgggttgctcttacatatatattctataaattgtgtgttttgtgttttcttttttggggggttgggggagacagtctaactcttgtcacgcagactggagtgcagtggcgtgatctcagctcactgcaacctccccctcccagattcaagtgattcttgtgcctcagcagagtaactgggactacaggtgtgtatcaccacgcctggctaatttttgtatttttagtagagacaaggttttgacatgttggcccggctagtcttgaactccttgcctcaagttatccacctgccttggcctcccaaagtgttgggattacaggcatgagccaccacacctggccttatttttatgtgttctgaatttaggttaaaattgaagaagagggtccaagactaagtgccaacatagatatttgcaggtgaaattgcttttctttgtgtagcccatgttgtattacttaatagcctcttaaactggagacccctgataccttacattcaaatgtgagtgatgatagggtgtctatcaaagacaacagaagttaatataacttccccaaagtcacgtgagtgggttactctctttacttggaacacatgcaaagaaagggtcctccttcaacacttgaagataatcacagtgtcatgctctttctcataaatgccactgtagagagtacagagaaaaatgcaattaatggtgctacccaaatcctgaaaagaatgaggtacggtgtaggaattggacagcagacagagtgcaagtttttacataattgtaattaatacagacatgacttacttgagaaatttaaaatgtgaatattttaaaaattacagaggatgattattcacattataaagtgactcatcatcccttttaaaaaggacttatcttttaagaggatattcctctggtgcatttgagtccttgtctgctcattgttttaaacaacttgcagtttttttaacaaattacagtatgacctgtgatattacccagacattcaattccgaggtatttaactagagatacctaggaatgaaatgaaaacacatattcgtacaaaaaaaatacacaaatgtttatagcagctttatttgtagtaaccccaaactggaaacaacctacatgtccatcatgggtgaatggataaacaaactgttgtagccatttaatggtatactattcagcagtaaaaacaaactattggtatatgtagcaacatcagtgaatctgagaataattatactgggtaagcagccagacaaaaaaagagttctaactgtatgattccatttatatagaaattacaaactaatctctagcgacagaaagcagatccatggtcgtctggaggtggagaataagggtaagtgaggatgggccaggaggcatggactccaaagaggcatgggaaacttaggagtgatgggtatgctcattttgttgatggcaatgatggtttcacaggtatatacataggtcaaaacttgccaaattgtgtaatatgcacattgtatatcagttatacctgaataaagctgtttttttttaaaaaaaaaaaaatgtcctgaaaaaagttctgtcttcccttgtctgccaattgcaccgttctttatatctcatccagcctgctcacagtcaagaacaggggcagaagtgggctgacaggtgtagtgcagtgtgtggaatgctgtgacaggtgtgggcacagaaggtacaatgaagaccccctggaggaggtgagcttgaggcgagtgtagagagggcatctcagaggcaattctgagaatcataggaggttgcaggtgtgtggcagaggttggtctggaggacagcagggaccatacatttggagcattgttttgaaagcgttgtacatcactgacgggtggtaagcaggggacagacaaaatcaactcggctttgcccactctgggaagatgaagaggcaggaatcccaggttcagagctcaaggaacccttatgtgatgccaccccctcaaatctgtttaaatcatattaggagaaccttgttgtccaagagggctctgtcttgctagacagttctgcgttgtccaggaaactgcagactacattggaatcctacctgtacaaatacttaagatgtttcatttcaaaaataaagtgttctctgtagaaattaaggaaaatacacttaagaaaaataagaaaatttaaattgcctttaatcccaccacccagtgctaaatacttttaacattttggtgtatattgtttcagatatatgtatgttttaaaacaaaattagaatcataatttgcatgtgtttttacctttatttcctctgagcattattccatgttttatgtagacataaaatatcattgtttttatttgatgcatgagagtctacatattatatgtatggtgatttatttaaccaataacctcttttggggatttttttggttgtataattttgtttaaaaattctgggaaaaccataattactttattaaaaagcaagtaaatcaaagaatatagttaatttttttattaacaggtgcagtttcttaattcatattaaagaaaaatagccttggtctagtagacattttaactaaatgaagggaggatggtccccttctagaagtacacatgggcttatacagtagttctttgttacccagtgataattatttcatctgtgctattcccaaaaagtaaccatctatgggaactctgttgttcccaaaggaagatttactccccatatcagaaatatgttaaaaaaaagtataaataggccaggcacgatgactcacacctgtaatcctagaactttgggaggctgaggcagggtggattgcctaagctcaggagttcgagaccagcctgggcaacacagtgaaaccccgtctctactaaaatacaaaaaattagccaggcatgttggcgggcgcctgtaatcccagctactcgggaggctgaggctggagaattgctagaacccaggaggcggaggttgcagtgagccgagattgcgccactgcactccagcctgggcgacagagtgatactccgtgtcttaaaaaaaaaaaaaaaaaaaagtatgaataacagtaacagctaacattttttttggaatacttttatcttctacatattattagaagcatttcacatgtattaacttatttagtcatcaaaacagttctagatgtaagttcagttatttttctgtttaacagatacgtagacagaagcacagaatgttagtaacttacccaaataaatgatcaacttatatgaaaacatatccatcatcactagtaagcagacttgcaaatgataataacaagctatcactttggagacctgcagtgatcttagaaacttaatacttgacgctgattaaggtagaaggaaacaggccctctgtacaaggttgatgggagggtccatttctgtagagcagttggtttccttctagaaaatttatcctatgaagataattggacaaggttataatgatattactgtgctcatggaagtattgagaatagtgaacaactatgtgtcctgtaatagggacttggttaaataaattttggtacatccatattgtagaacaccatacagctattacatatgatgatatgcgcatatgtttatggaagtcgttgctcaggaaattgtaaatggagataaacagacagcatggaacatgaagatacgaaatctgcttctggctgttggtctggggcccccaccaggaaaccagcacacctggcttccttcttttttaccgtaagaccagagaaaccctagagttgcagtgaggaactgtcttgggttctctgaaaatgagcatcatgaaaaatgcctggcttaaaagaagagaaggaattaatacattttgttacaggtattatattggcttcatttaacaaatgcaggaacaattttataactggaacatttagccactgcaaaaaccatgaattagttttttggtttttttcaagttttccactaagctcacttgagtactttcttccttcttcctttgagactcactctaaccaccagggagtcacctctttattgatctgcctcttgatgccaggaatttcctttcttctaccatactttacctatgtttggtgaaacatttgaattcacatgttactgaacagtgacttggtgtgttaaccttcttaggtttttaaactttgaacaactgcctttcctcaaaggcaaaactaacttttttgggaattgcagaaatcgtaactccccagggacagctcaccctcagtcctccaagccatagaatttaaagactgccttgatgccaccaaaaacctcagtaccttttgttacagaaagaacattgtgtggtatacttcctatgttttgaaaaatatctgcaaatattttgggaactgaattttgggaagggctaccctctggctgaactctgcttacaaaatccataaaaacagggttccagctctgcacagcaggacaggtgcaagtgtgcgccagtaacctcacagccggagaccatctctacaaacatcctgccaggagaagagtagagaataacaaaggaaaaaaacaagccctccagttggcattcttgttgaggaagtccatcaagaatcaagttcctgtcaacttgtttctgtattcttttgcttaaagaatcacagtagagagtcccaatctgaaaaaaactttgttatatttcttaggttggggatacatacagcatggagttggaacttcagtctgtggagccaaacccagactgaaaggcagcaagagagtagcagctaagagcatagactaagtgcttccactgggtggagcatgaccagtgcattcacaagacgggaatgttcggtagacttgctgccggccatgtgtgtggcttctgagcacatgtggctggtgtgaattttaaattttatttaatttaaattaaatttaaatagctacacatggcttgtgatgactgtgttagacagcacaggatagacttagaagctagactacttgggttcaaattccagcttcactatcgtttacctctgtgaccttggacaacattccctgagcgctttatgccacagttttctcatttgtaaagtgataaaaagataatagtgcctacctcaaaaaaggttattttgaggattaaatgagttaatatttgtaaagggcttagacctgggcacatagtaaaagctatatcagtgtttcctaaataacgcaactatatatacatccctaaagtgaaaaattgaacctagatccatactatattttttttcaagaagctcccatgcatccattgtcaatgcatttttcttaaacaccccttaaatattggggaaagcagaaaagtcatttatttgataaatatgtctggagcccgtactttatgccaaatgctgtgttgggtgctggagatacatgtgttggtgcatagagacttgattcatcctaataaaagggtaacggtcccgcagtgttttcacctagtggttaaggaactttataatacgaagggactttaaaagtagggtaaaggtgtagatgtagacggagaaacccaggagactttgcatttgctcctagtcagctggctgggacttcacccttcacctcctgttggctcatgcttttccctttgcacctgtggagcacaggtgtgtcctgaggccctcaccagccatgcagaagccttcaggtagggttaacatttgcccacttctggaagggatcgatctgttctcagatgacagtgataattcttggcctattttgactcaatagtggcaatattagtagtttttttgtatttgttttaatttttttctccttatttaaggaaaagttggaaactaatgttgcttcctccattttttttgtttgtttaaactttgctggttcatgagattgaaaagtctgtgcttagaccataccacccgatgcagtttgtgtaagccttaaaaaataaatatttcagccccaacattcatgtagtactaaaagtgagaggcttttgaaccataactgatttgacaagaaatggacataatggaggaaggtgactggttgtttgcgtgttgatttgctttcagcacttgctaaaacgtggagccaaggggagagaatccaccaggttgctttacatgtgaaaaatattaaaatgtcagcacagcccagccactgacataagaaaaaccgtttcacagttaagtctctaaataatgtcctaaaaacacaacatttgtaattatctaattaataaaggatacaggtaatagaagtaatatggaaggcattttctggtagataaagcttcagaaaccttcacatctgcacatgattatgaagcccctgttattactttgctttcccccttcctttagcccatgtttctcactatgaactaatagtacataataataaaaccctggatgtcagccaacacagagttttggctaacttttccagtgtttgttaaagttgaaaaagcattgcagctgttatgctgggtactttccaatggaggatgtgttttccagatgaaggcgcaaatggtaattgaaatgtaatcagtatttttggcatcttggaattataattctttttacgtttgtaatgttaattgttcatttcttaggatttgttttgtgtttttctgtgatctgtaatctactaaaagtgagagaatgaacaaatgttttaggcggtttttcattctttgaaagaaaaatggcaagtagtcacgtttgttaggtgatggcttattttaaataatcacaaaatttatgtttgagacattttattgtaagactcatgtttcaggcaacagaaaacagaaaatctaaatctcaaatacaacaaaattttagagatgaatggaaacttctagatcacttggataggctgaagactcagtgggcctcaggtgttcccaggaccaggctgctggagatgtccctttctttgagagatttgttctgtttttttttcatctcgatccactgtgttaaggaggggtggggtgtgtctgctgatggttttattggtatttgaggtttctaaagttttttgtttaagctagaaagagctctagctgattagtagctctcaatccttggctggatattttattttttgttttgttttgttttgagacagggtctggctctgttgcccaggctggagtgcagtggcgcaatcatggctcactgtaacctctgcctcccaggctcaagggatccacccacctcagcctcctgtagtagctgggactacagatgcatgccaccacgcctagctaatttttgtatagatgggattttgccatgttgcccaaggtggtctcaaactcctagcctcaagggatctgcctgccttggcttcccaaagtgttgggattataggtgtgagtcactgtgcctggctggctgcgcattttaaagatcttgatgctcactcatacctgagccagcataattaaatcacagtatctccacaggtgacagtgatgtgcagccaagaacagtgttcctttccagtcctctctttatagacgaggaaattgaggccctgagcagctagatgacttgtccaaagtcctctgctgggactgacccaaataaggaatggctgatttctggaagggatgtcagattctctgattacagatctctcgtgatcttctctcggggctcgtggactgtcctgtcaacagtcaggctaggcagctgcagagagcaggactctggggtccccagtgaggaggaagcaaagagtcctcatcttcctgtcccctttacccgagtagaaattgcccttccttatcccacatgagctaccagaggcatgataaactgcctctggggctttttggctctttggctctttttttttcttttttattcctttagaaagaaataggtttgtaattagctaactaagactgacaaataccagaccagttgctatatattacaaaggagcttcttgaatagctggtcacttctgcatattgtagaaaccttccttctcccttttagggaacactacacattatttaggtacagtgttagggataactgatcatttctaatgctgtgtatatccattaagggtaatttaaagcaattaaatgctaacctggctggacagccaggtgtaggtttgtggcatccagaaagaggagatggacttggtggattctgaattggtcagttccacctcttcgtgttttggaggctttgtctcgttacttgctcacctttctgctcagtgctccttgacatggcgggtcaggttgatgggaggtggtacctggatgccctttgctggcactgggcactgcaccggagagttaccacccctgcctggggatggagcctctctggggagaggacagtgcaaaggtgggggactggggagttgtgagaagtgggagctagaatatggagcaactagtgtgtatagagacttcgtgagaaaagctcgatcacgttttggtaagtatttgcagctccctgaaaatttgtgttgggaggtgatcattagcatcttctggaatatttgcgctaaagcaagactagattaaggagctttggttcatttccagacctgtcctgacagcatcactctccaaatgctaaactctgagagagagagtatgtgtatttttcttttcaggatgtcagtcaaataattcactcattcctttccccaaacacactggcctttgaaatgacaccctacccctgccaatagtgagactgtggttctgatcggggagctggcgagtttctgctttctagccccaaaggcctcacccttgctctcatctggaagctgatgggaaggtttgttagtcttctcaggagcctgtcacaggacctcaggaacgtagcctgtagtgggcagctggcatcaatttagtgctgtggggatggcaggctgtcagagtggttgcactttacctgcacgccccccaacccagccctctgtgaagggttggtttacatcagggatggctgctcctgacataattgtctatttccggcaacagaggaagataccttctgccatttagagaagagaaataaatattcacttcagagaatacactttgaagtggggctgtgtgtgcatgggtgacagctccctgcctacttttcctgcaaggttcttgtacatcaggaaaggttaatggacttcccttgaagtcagacagagatgtgttcatggaaaatccaagtgcaaaaccaagggcaaactctggctttcctgggggtttttttgttgttgtttctccttttagaatggacagtgaaagcaaggtgaagggcttcattattcctcttttgtaaagcctgttgagcaggaaccttctggagcttctagatggaggttcctggagattgtgtgagtggtgagcagtctggttgaagagggccagtgtttgttggctttgccctcattgtgtcaggaatgagctctgcacggactcagagagctaacagatcagctagggtacctcagagaagaatgcactcgaggctactgccatgttccctctgtggtcatgaggaaaggagaactacctgtgtggcttgggggcttccctgacatagtaatcacattggattttacaactgggtacattcttagccttcagtttggtgatccctgtgtttaaaaagaaaatccttttgttgtgtggaggttaatctgctgagcttatttttggtcatccattctcacctgccccacgacactggtcactggtgtctccatgctgatatattatgctcagcttttttgcatgctccgcatggagatatgaacacaattctcatgggaacttggcccatctttcagcacactatgtcagccagttgctgccttcctgttcatggaggactaggcgtagtgtgggggtctcattgctcatctggttagtggctttgcagtcagagcaagctgagggaacagtgccccctacctgtctgttctcctgcaggcccagtgtgggaacaagatgctcttcagagaaatctctttgacactggctgtctcacccagcacctacactcttgaaaatctgagggccttagcagaatttgaaagtgtccaagggttagaaatgagaagtctccatgagcatgaaagcgaccatccttgtaggtcattattttgatccatgctctcatcactggtttcacaaacaggcctttcctttctagtctttgaacataccaactcttttcgagtaacacagcaatattaaaaacatatacccattgccaaaaagcaaaaccaacccacttctggctgagaaactgctgaatacataactattcatccctcagtagctgagtgtggttacaatgaatggctttcccatattttcttgatgcttctaaatgtatgggttcacttttggggggaatattttggtgctgtcataatctatatatggaagatgttaaggatatttccaggaactgcattaaaacagccataacaaaccatattctgcagccttcaggtgtagtattttgattgcttggtttggtttatcaccaactactcttctgagtatcccccacactatattaggaatttgttacaatatgactaatgctgaatatgtgtgcattgatttttaagtgcactgggtgggactgacttgttcaaatctccgttaaagcaaatgtctgattaggagaaaagtaagggagtaatttgttaggaaaactactttctgaggtgcccccacctcccctccttccaacctgaagaggcagagaggtttgtgtaaacaaaggtcctgcaaggcacagctgttttacattctgatgttctatgactttcttaaataaaaaccttttggattttcatatctatttagctagtaggaatatttcctcctttttcggagaataaaatcctagacttaaggatattccttgggtgactgagaagtcataccagcctaagcagtacagctggccccctgtatccatggcttctgcatctgtgaattcaaccaaccatggatagaaaatatttgggaaaaaaaatccacaaagttcgaaaaagcagaagcacgatttgctgcttactgagaactgcattgaatccatgtgagtaaggtgatgtgtaggcgttgtattaggaattataagtaatctttaggtgatttaaagtatttgagaggatgtgtgtcggttttatacaaatactacaccattttatataagggacctgagcgtccatggattttggtattcataagaggtcctggaaccaattgcccatgggtagtgagggatgactgtattttctaattaaaaggttttttttttaataagcaaatgttttacttagtaccttataatattttaaaaagcgtaaaattcccaaataaagtaattggtttagtgataaatatttccagtggcgtacttaaaatgaatgttttcatcagaatgcagaagctgttttgagaactttttgctcattattttcagtggggttgtgaaatccaatgaaaacgtgtataaatgtttgtagaagaatactttgtttatagagtgcaaatattttcttgatatgacaacaccccaaacaaagaatggttacaattaaagtaatggtgattcagttaaacatagagctggaaaagccattattttgaaatatcttctgagcctcattgaagagagagtgtcttacacaccttgggaaccaagttttgcatattatagtattaccacattgtattcgatcacaagaatggtgtgaatacttggtggttaaacaaattattgatgcttgttagttggatgagatcttggaatgcatgcatcccggcttcccacacagtactcagttctttctgtagctatcctgttgaatatatggagagtacagtatactttcaggcaagatggtcatttaacaggtcattatttaaacattgtttcagtgtgtgctgtgaaaacaacaacaataacaacaacaaatcgaatacctctctgctctctgcatttttggagcgctctagctgttagaaagtacctcctaacccctagccactgtgaagttgttgctccctgcctgctgggaaatctgtgccagctctcccaggaaggctcctgaagctgcctgcacatacctgccaggtgtgtctcctggacttttccccaggggtcctagctcctgggctgggtctcctaggtgtcttacagcctggctgccccttctggacactcttggcttggtcagtacctggggtgatttaacttggcgtctaacagtgaagcttcctttagttgtatcttctgctgttgcttcacattgagcttgccacgttttccttgaattgctgtcagtttttctctcttccaaccttgggaactttatttttaaaaatctgggccaggcgcggtggctcacgcctgtaatcccagcactttgggaggctgaggcgggcggatctcgaggtcaggagatcgagaccatcctggctaacacggtgaaaccccatctctactaaaaaaacaaaaaattagctgggcgaggtgacgggtgcctgtagtcccagctacttgggaggttgaggcaggagaatggcgtcaacccgggaggtggagcttgcagtgagccaagatcgcgccactgcactccagcctgggcaacagagtgagactccgtctctaaataaataaataaataaataaataaataaataaataaaatctgaatgcaagactgtatgtgtgcttgaataatttgaatcctctcttggccctgggaccttccccgtgctacatgtgctttcggaggttgtgaggaaagggctgaccaggccatggacctgtcccagagccggcacccttgagcatggctgctcagacagcagtgaaaatttgtcttagaaatttgaagttgcttttgaagctttttggtcagtgagagaacttaaaaattctcatgtaaatataatttaaaaaatatagatgactcaatctacaagagcttatctgtttggtttttttttttctacttatagtttacatttgaaaaaatttaccacttgatgaactgagtaattttttcttcttgatagtagaggaattggtagggaaagtgcttctaatactcttcgaagctgagaaaattttaagtataaagtttgttcattaaacatttgtgtattgttgtctgggagctagacactatatttagggatacattgatgaaaaagagagaaatacccaatagttcttggagagtacagtatactttcaggcaagatagtcatttaataaatacacaggtaattatttaaacaccatcgtagtgcgtgctatgaaaaaacaacaaaccagtaggaacatagaacaggagaggccctgggctgggactaggggtttcagaagagtctctccagagaaagtaaagtttaggttgatctggttctctctcttttttttttttttgagcaacaagactgtttatttcacctgggtgcaggcaggctgagtccaaaaaaggagtcagcaaagggtggtgggattatcattagttcttacaggttttggaataggcggtggagttaagagcaatgttttgggggcagggggtggatctcacaaagtacattctcaagggtggggagattatatagaaccttcttaagggtggtggagattacaaagtacattgatcggttagggtggggcaggaacaaatcacaatggtggaatgttatcagttaaggctattttcacttcttttgtgtatcttcagttgcttcaggccatctggatgtatacgtgcaggtcactggggatatgatggcttagcttgggctcagaggcctgacattcctgtcttcttatattaataagaaaaataaaatagtggtaaagtgttggggtggggaaaattttggggggtggtatggagagataatgggcaatgtttctcagggctgctttgagcaggactggggcaacatggaaacctagtgtgggagagatgaagctgaaggaagattttgtggtaaggggtgataattgtcgggttgttagaagaaacatttgtcgtatagaatgattggtgatggcctggatatggttttggatgaattgagaaactaaatggaagacacaaggtctgaataagagaaggagaaaaacaggtataaaaggactaagaattgggaggacccaggacatctaattagagtgtccaaggggggttagtgtaattacttgcttggttggcaagcttttaggctctatctttgagttttttttaatgttgtcatataccaggccagattgatttaggtaaaaatagcactcttcatttaaaaatatagagtccccttttttttttttttagcagtaagtcgagacctttgtgattttggaagaaagagaaatgcaaagccagcaattgtttgttaaagaaggattagaaacggctaggagagagtaactgagattgatagtgtgatagagatagctggggagaggtagagggtggcataagaacgggaatgagaataagagtaagtataaaagtaaagaataggacttcatcagggtgaaagtattggagggtaccttgccactgaagatcttctatccacttaaagagagacttaagggtggcagtttgaggaaaaaccaggtgccactgaataccaacagcctgagaaactgcttgggtgatttgactagtaaaggccggtccgttatcggactgtatagaggtgagaaggccaaaccgaggaactatgtctgacagaagggaataaatgaccacggtggccttcttagaccctgtgggaaaggcctctacccatccagtgaaagtgtctacccagaccaagaggtattttagtttcctgactcgaggcatgtgagtaaagtcaatttgccagtcctgggcggggcaaatccccgagcttgatgtgtggggaagggagggggcctgagaaattcttgaggagtagtagaatagcagatggaacactgaaaagtgatttccttgaggatagatttttgcgatggaaaggaaatgagaggttctaagaggtgggctagcgggttctaagaggcgggctagcggcttgcaacctacatggaagaggttatgaaatgacgaatagaatgggcctgtgagactggaaggagatttttctttggtccaagaaccatttgctttgtgtgggaagagatgggtggaagtttcagcgagggagtaggtgggagtggccagatgagaaggaggaaaactgccctgagggatagaagttggaacgctagctgcttttttagctatcttatcagcataggcgttgtccagagcaatgggatctgaagccttttgatggcctttgcagtgaatgactccggctttctttggaagtaaagcagccttgagaagagttcttattaaagaggcattattgatggaggactcttgcatagtgaggaaacttctttctgcctatataacagcatggtggtgcaggatatggaaggcatatttagagtcagtataaatattgatgggtagtccctttgcaagagtgagggctcaagttaaggcagtgagttcagcttgctgagaggtaatggaggggggcagagcggtagcctcagtgatagatgtggaagatactatagcatagcctgcctttgctggtgagtggcgattaggcctggtggaactgccatcaataaaccaagtgtgatcagggtgaggaacaggaaagaaggaaacatggagaaagggagtgaatgtcatgtggatcagagagatacagtcatgggagtcagatgtatccggaatagtgtgggaggctggattgaagtccgggccaggaacaatggtaactgtgggagactcaacaaagagtgagtacagctgaaggagccggggagcagaaagtatatgcatcaggtgtgaggaagaaaatagattttggaagttatgagaactatagagagtgagttgagcatagtttgtgattttgagggcctctaaaagtgttagggcagcggcagctgctgcacggggacatgatggccagcctaaaacagtaaggtcaagttgttgatctggttctcatttatccattgtccttatctttaaaatcacaagatattgagagttagcagtgccattgctaatgagattagaaagccttcattaattacaggatccttggattgagattggagtttaatggcacagaaggcagctttagggttcacttggtgaattaatctgctcaggctgccataacagaatgccacagactgtatggattaaacaacagaaatttattttctcactgttctgtagggtagaagtccaagatcaaggagctgtcagttgatttctgatgaggcttctcttcctggcttgcagatggctgccgcctcactgtgtcctcacctggccttttctttgtgcaaatgggtgggtgcaggggaaccatagtgtctctttgttccttgctttctttctttttttttttttttttaatgataaggggtctcactctgtcacccagggtagagcgcagtggcatggtttctgctcactgcaacctccgcctcccaggctcaagtgattctcccacctcagcctcccaagtagctgggattacaggcacccacctctgcgcccggctaatttttgtatttttatttgagacagggtttcaccatgttggccaggctggtctcaacctcctgacctcaggtgatctgcccaaagtgctgggattataggcgtgagccactgtgcccggccattctttgttccttttctaataactacaccagtcctattggattagggccctaccattatgaccgcacttaacctagattacctccctacaggctctgtctccgaatacaatcacattaggggttactcctacaacatgtgaatttggaaggtgagcacaatttggtccataacactcaggcaccactaaaaatccagctactgctggtgcccagcccctgatacttctctctgtgcagagtcatagaatactaacagaatttagttccctctaaatgttccaaattgccctgacatccggttcattcttctgtgctgctgattttgacaacagaagcaactgctttgaaagcattttgagataggaaaaacaaagtgcatattatgttgcagatattttgggaaatagaaaacttgtttattagtaacatatttcaaggagatgaagttatggacttgattttggtcaagtaagtagttgaaaaatgcagtttcaaaaatcacatcaccagggagattttaaagaaattcagagtggtctggatgccctgatcttttcttctaagttttttccccctactgggagaacgcagaaacttgctgattccttttgctcttatacctgattgaagacttcaccagctaagatcttattttcattttgcagtcatttgagcgatagtaggagccagataagtttgaattacaagcccatgcagctttggacaggctgtgcattatcctgtgactttctggaaagtgtggtgaggtatccccagcctgggtgttgggctgattggcttggttggattagggtctggccccacagtagacatacttaacatacttaacttatggctgtcacctatgataaatgcactgtaaatcagagatctcctttgtggttctaaacttatggcaatattttaggcaccatcgctcatttttcttgtatactcatgtttagatattctggaagccaaagtgaatccacatttactttaactgacttttgttaccaagcttgatattgagttcctttgaaaataagcttttaagcagtcatgtgcaggcctctaatggattccagactgtgtagactgtattgttaaacaatattttgtttttaaaaatttttttcttcggattgatcaggtttaaacaaattttagtaatagaatagtggtctccaacctttttggcaccagggactagtttcgtggaagacagtttttccactgacgggttgtggggatggtttcgggatgattgaagcacattacttttattgtgcactttattattattacattgtaatatataatgaaataattctggccggacatggtggctcacccttgtaatcccagcatttagggaggccaaagtgggcaaatcacctgaggtcaggagttcgagaccagcctgaccaacatggtgaaacccagtctctactaaaaatacaaaaattagccaggtgtggtggtggcgcatgtctgcaatcccagctagggattgcagaggctgaggcaggagaacctcttgaacccaagaggtggaggttgcagtgagccaagatcatgccactgcactccagcctgggtgacagagctagactccatctcaaaaaataataataataataattctacaactcaccatgatatagaatcagtgggagccctgatcttgttttcctccaattagatggtccatcggcaggggtgatagaagacagtgacagatcgtctggcgttagattctcataaggagcgcacaatcctgatccctgtcatgtgcagttcacagtagggtttgcgctcctatgaggctgtaatgccaccatgaatctgacaggaggcagagctcagatggtaggtataagcaaactatggggaacagctgtacttcgcttgcttgtccgctgctcaccttctgctgtgtggcctcggggttggggacccctctaatagaggtttgatcatgttaaaatgataattatttgaatgttttttctaggattgatattctcttcctttcaagtatcataggccaatctttactcattttgtttatttgaaaggttatggatttctaagtaagtctgggaaacatttaccaagcatacaaaggggaaaggcttgttgctgcagtgttaatgcaagcgatggtagttatttgaacagctctttgagaaaatttaataaagtgtaaatctctggaaatctgggttgccatgacagtgtaggacctatttaggatattttacaaagagaaatgatcttaaaatcgtctacatttaaaataaatatgttaaaaggcaaatgctggtgagattgtgaaattagtgattactgcaatcctatccaaatatgacccctcatgttttgcgacagttgaaaataaatttataattttataacttacaaatttataaccttctctgaataaatctgagtaaagagaaggttgttcctgtgtaacaatgagaattttactgggatccaaagtacatactatttaggtaggaagaagcactatgttttagagttagattactctgctgcaatacagctcctaccatctgtgttgcatttcacaattgtttttgagcacctgctatggcttaggtgccatgctggttactaatggtttaaagatgaacagaataggctgggcacggtggcttaggcatgtaatcccagactttgggaggctgaggcgggcagatcacttgagcccaggagaccagcctaggcagcatggcgaaaccctggctctacagaagatacaaaaattagccaggcatggtggtgtgtgccagtggttccagctaccagggaggctgaggccctggaggcagaggttgcagtgagccaacactgcaccactgcactccagcctgggcaacggagtgaatccctgtctcaaaacaagcaagcaaacaaaaaagaaaccacactagaacagaacaaagaggatgctggcccttgcagagcttgtggtggtggggggaggtatatgtgtctcacatatcacttagtatagtgttggttttcagtgtagttttacatatttgtttcatttcattcccttccaggtaattgagatatgcatttccacttgatagatttgcagaggattttggcattgggttgctctaggagaagtcagattacaaataaaaagtgctttattgctcctgtgttgttcaggcacatatgatactaacttatgaaatttcacaacaaatagggcagtgaaatgccaaactcactgaaattcaggactggtattttggcagcagcaccattagaactatactctaatgtaatttaaaactatttggaagtaaatgtaagaccaaattgttatttgtggtggctagaaaccccacattagccataagaccatggtgctaggtctgtattgagttaatagtttctatttttaaaaataatttagtcaaccagaagacatcagttaatttcagttttttaatagctcttctctgtatgtggaacagaaacaaggatggccttgaactgccatgtatatgagaatagctgtgtatttatttggtaggacttaaaaaatattttagttggttcaagttaggtgatttcaagatttgtaactgaacattggaaaaattaacttttctctctagatctatctactttcaatattcagctgatttttcaaaatattaggacttacaaaattatatttagattttagagagtattatatgtaagcggagaagaagtactttaaaattttaatgtacgagtagtaaagaaggataaatttctatgcagcagataaagaattttcttctcagggactcaaataataaatccatttgtaatatcactgttccttgtgcagtttgctctgtaaaatggaggaaggtgagaggggtgccatgtttctgtctcataccgttttttgttatagagtgtattcatggttatactgtataataatgataataagttcttaaaccgtggtgatgagatctatttggcagaatgttttaaaataaacagtgtatttcccacgagtgaaatcttaaaaaacaattaatttccattatagtaagggtgaattttgctccttcaaagagtatagagcctggttgaatttgcccattaagaaaaaaaaatgtgtctattggactgtgttgtttgtaaagctagaatcaccttccagtggcgttttccatccttacaggaaagaggtttatctctgaatattgagaatggaggttcataatgggcattttagcgtttgaatgttgtaggaagaagatggctaaatcttcactgctcccctaaagtacacacgttagttctggtggggagtagccactctgagattttatatcagagacataatgaatgggacccatgatatgtgaaattctaattctttagtacagagaaatgtgctcttcatctttctgtcttctgaggcttttttcaagtgttcgaaactgccgttgcaaaactctaactgagacagtggaagagatctgtactaaccaactccatcttgcttctaacctccaagcagtccttgctctttcctgggcttaggccaaactaactttgagagggacttagtttgtagtttaaaacaaagatgataacaaaacccccttcttgcctggggactagattgcttttgtaggactagcaaattaaccacaacattagaaaatatggtttaggagtcatgctgctggaggctgcaagattctaaacctccccaaatggttcctgggaataacatcactattgcaaaacctaagatgagtgcttgtgacattttgcagaccctgtcctcgatggatcatttggcaccacccagatggataaactggcttatctggtcttgtggcccccacccaggactgactcaatgcaagaggacagcttcaactctgtattcatctccacccctaccaatcagaactgccaactcagtggacccctacccagcaaattatccttaaaaactccagtccccaaattcttggggagactgttttaagtaatagcaaaactctggtctgctgcacagccagctctgtgtgaataactttattgcaattcccctgtcttgataaataggctctgtctagacagtgggtgaggtgaaactgttgggtggttacatcttcattaaaggagatgagcatttttttctttagcttggatagtgtttttcatcatttttttcattattcccatcccttatcaggaattttttagattatttatttatttatttatttttgtgacagggtcttgctctgtcccccaggctgtagtgctttggcatgatcacagcttactgcagccttggcctcccaggctcaagtgatcctcccatttgaagatgaatggctgggactacaggcatgtgtcaccacacttgactaatttttaatttttttgtagagacgggctcactttgttgcccaggctggtctcgaactcatggcctcaaatgatcctcctgcctgggcctcccaaagcactgggattacagatgtgagccccctcgcccagtgtgaccctttttttcctcctaattgcccacccatgaaattttcatgccatagatacattatatatctatgctaatatgaaaaagaatacaattttttgcctcatccccaaaatgaattttcattccttgtgggggcaatatcacccccattgtgtatgtacaaggagacctggctgggtgggtaactggcctaggcgtaattagactttgatgcaggtcattcatttccttatttatttaagagccttgagtctttttgatatttttctgacatagaccactattaaagggttcttgccttagagggtaggccaatttgttcatttaaagcatgggctttggagtcatacccacttggttcaagtcctcttggtttcttcatttttttcctgtgccaccaccagcaaaactttagtttattcacctgtaaaatagggctaataatagtatctacttcaaaaggttgctgaggaggatggaatgagaaagcaaataaagcaccgcaccccagaaagagtaagccatcctcccaaaatgtaatttttagctgtgttagggtttagagtcatcacctctgcattttaaagattaggttgtgttcttatggtacaagattcaatagtgatgaagatattatgataaaagcatcatagctgtgtgacttgattgagttgtttaactcttggggccccagtttccatatttttgttaattatgattgaaaatacaaaataaattgactgaaacgtcaaatatggtagtaatcccaataaatgcaaatggattatgcttgccgactaagtgacagaggctcttgggttagattgaaacaaagagaggcatacctaagacaaagtgactctagaagtgtgaactcaaaatgtctgagacaagtctcagtcaatttagaaagtttattttgtcaaggttagggacacaccagtgacatagcctcaggaggtcctgataacatgtgcccaaggtggtcagggtacagcttgcttttatacattttagggagacacagtacatcaatcagtacatgtaagatttacattggtttgacctggaagggcaggataggggcagccttccaggtcataggtagatttaaattttttctgatggcaattggtcgaaagagtcattatcagtagaaaggaatgtctggcttatggtaaggggttgtggagacctaggttttatcatgcagatgaggcctccaagtagcaggcttcagagagaatagagtttgagtatttcttatcccacttaaggtctgagttgatgttaatgctggagggggatggatagtgaggcatgtccatcctccccttttccatcatggcctgaaagagattttcaggcaactccgggatgcccttggccaagagggcccattcagatggttgggggccttagaattttatttttagtttacagaaggtttgaaataaggggatagaaaaatacataccaggcaaatattactgtcaatcaaaatagagttcatatgttaatagagatacaacaatatttcataatattaacagctcatctggaagataaaataattatgatcttgtaacatactcagggaatgagaaagaaaatctgataatcatagtgggaaatattactatactctgtcattgataaataaaagttagtacagctatagattatttgaagtccaaaatactttattaacaagagtttagtaatttaataattattaataggtctcagagaacctttccctgtcaggatgatctgattttgtgaattttggctgaactgtatacagctctatggtgccttttttttttttttcttttgagacagagtctcgctctgccacccaggctggagtgtagtagcgctatctcagctcactgcaacctccatcacccgggttcaagcaattctgctgtctcagcctcctgagtagctgggattataggcgcccgccacctcgcccagctaatttttgtatttttagtagagacagggtttcaccatgttagccaggctggtctcgagctcctgacctcatgatccgcccgcctcagcctcccaaagtgctgggattacaggcatgagccactgtgcctggtattgtttttttttttttttaaacagtggatatgtttctgtaaagctgcagtacactggattgttttaaaagtgaaggctactttaataatagacattatatgcttgtgacttttcttgtgttgttaattatcatgccgtgacttttcatgtgtgtctttatatttatgagcagagaactctgaatgtttgggatgcaatctcggtccttttttggcactagccccatgtacctgagtaataataggtcagacaggttattaagaaacagtggtttcttgcatgttctcactcataggtgggaattgaacagtgagaacacttggacacagggcggggaacatcacacaccggggcctgtcatggggtggggagatgggggagggatagcattaggagaaatgcctaaagtaaatgacgaggtaatgggtgcagcaaaccaacacggcacacgtatacatatgtaacaaacctgcacattgtgcacatgtccactagaacctaaagtataattaaaaaaaaaaaaaaagaaacagtggtttcttgtagatactcctttttggcaactgaacagttgagatagttgaagcaaaattctcagacacacgatttgcagtttggtgccttcagagtccttagaaggcctttttaaagatagcataccagcatccagtgtacactttttcaagtcttttatgaataaagtgggagtgttttaagtgtttgcagaacatttgggtctctgaattctgccaaagtaattgttacatagttttcttcctcgaaaaggactggcaaacattggtcaccttcttcattttatttaatttatttgagccttttaagattgggtattaaggaagtgtgtgtatatgggtgtgtgcatatgtgtagtgccaatgaaaattccatgtattctctatttgttgctttactctctgaaatctgagtagttcagacaaaaaataatttttttacaagggtaaaaactaaatttaaaagggaaatctaaattttattatgtgtatggagaggcaccttataaaatattcactctttcattagcagcctattttaaaaaatgtgacttccttgaaagcagagtgtctaccagatctatctaaatcagaggagtatatgtttcaggcgttgtgactgatggagatagtaccagagtggcagctccaattgactttgcccctgtgctctcacctcccagtcctccctctgccacctgtccaggcagcccatttagaaacaaataattagcaagcacttaatgttaccaggcaccctgctaggagttataaagacagaatgatgggatcatgacctcaagaggccatggcttattgatggtaagtaaatagaaggtttgtaattatgaagcagtcttttaatgataggtcagcggtgcataaggtgtcggagggagtgcatgtgggcactgtctaaggttgtctaattcagaccaggtggtggtggtggtgagtgatttgaggaggttcctggatgtagtgatacctgagctaggatttgcaggaagagcaaagagctgttccaggtgataggtttggaactgagacaagaacatgattcttctctctcaggagttgcaagagcttaggacatggatagtgggaccaggctagagagatgggcaaggtcctcgtgaagaatctcattttctctcctaaggcttcttggcattattctgatggcattgggagccatttggtagattttagtttttagggggataaaataactggaattacattttagcacggtccctctggtagcattgtaggggaatggattagggattacaatgagagatgaggagctggaatgagaaactcctgctggaactaactcatgagattttcaggaggtacgagttaccttagggccaccctgtggagcgagagggagaaatgaaaggtgactgcgaaggtttgtgtctggggcggctaggagaagtggggatgccattcagcgagggagtggtggaggagatgcagggcgtagaggtcggggctgtgagttcggtgttcgacaggcggagttagtgattgttaggagacacctgcaccttgcagggagcagctgtcagcaccgggtaaccagcaaagacagagaagtggatgatgtcaccaaggaagattttgtagagtaacagtagaggatgctggaaagtagcctggggattattgtttcttcataaaacaaaaacctgcaagtttatctgataacctgtgcgacttagataataaatgtggtatcttgggaagtaagagaacaggtaaagtattttccctctgggctgttccaggtattgactttacgaactttaatcaatatagaggagaactaacagaatacttacaaagcctggcatggtaacattccagtttctttcctaatggttatgacctgtggtagctcatgccagagctgtagaagcctctttacctcaaaggtacaggatgataatttccacatccatttctgccttgatccacctgtttgaagaaatgaatttagtgtctgcttattgaagcagaaaataataaagcatctggaatttctgtgcatcttatggaaaattccagttcataggatgtaggattagagaagagtaatttgagggggaggatcttggcttttctacatattcctttttatacatacacacacccacaccctaccccatgccaccccaccccccaccccacaatagagaagagcagggaaagtagataggcactttcctatctttttgaaacctagtcacaaagaacatgggcattacccttgtcacacgcagggtattactgtttttattcattcaaaagttatttaacgagctcctactgtggtgagcaagtccagtggaatccaggcccttgctctgctattagagggatgagggcctttctcttcaaggggagattccctttccttgtgtcagccttacatagtcctttctgggtttcctaatggtggaaccaccaggcagagttccaagatggccaagccttcctcccttctcttcctaaacttcccacagctatttaagaagtacagatgacttcacagcccacgggaggcatggccaatagcaccttgagaaaacccagccctttttagataacctcctgggacacctgtatgtgtgatataaactgtcctcacagctggccctagtcccatgtggaagtgggttagaggatgatgatgtttgtagcatgctggagtttggagtctccatgccatgggcacactcttccatactgttgccctcactctgacttcttcaccctcacgtcactcccttgctgctgttgagtgcctagaagggacctttccatgatggctatggtgggagcgagggatgttttgccgtgaaattgccttgaaaataaaatagtgggttctatcactgtaaatactcagctttctttggacaaaggacattgtctttgaacagatggagaatattgaagaaaaaagatgtctctaccatcaaattctggacacttgagtgaaacagttgaataaaaagaactcagagcattgctttttttttgagacgaggctcactctgttgtttgggctggagtgcagtgacacgatcatggctcactgcggccttgacctcttgggctcaagtgatcctcccacctcagcctcccaagtagctgggactacgggcacgtgccaccgtgcccggctaatttttatagagatagtgaagaagggttgggagggtgtctcaccatcttgcccaggttggtctcaaactcctgggctcaagtgatctggccaccgtggcctcccaaattgttgagattacaggtgtgagccactgtgcttggcatatatttatttatttattttgtacacagactagtggataatttggatactttgacttcccattcacctttctgttttttgtttttttcttttgagacagagtctggctgtgtcacccagggtggagtgcagtggcacagttatggttcactgcaacctccacctccctggctcgagtggtcctcctacctcagcctcccaagtagctggaaccacaggcgcatgccaccacagctggctattttttttttttatttttgtggagatgggggtgtcactgtgttgtccagtctggtctttaacgcctgggctcaagtgatctgcctcccttggcctcccaaagtgctgggattacaggcgtgagccaccactcttggcctaacctttccgttttaaggaacaatagtagtgtttttaaggaataccattaagaaagaacattaggaaaaaaggtgctttagttctctgagtgacttcttttaagcttaagacaagaattatcacttacttactaagtaatctgtgggctgggcaaggtaggctcgcacctgtaatcccaggactttgtgaggccaaagcaagcagattacccgagttcaggagtttgagactagcctggccaacatggtgaaaccccatttctactaaaaatacaaaaattagtcaggcatgatagtgcacacctgtaattccagctactcaggagggtgaggcaggagaattgcttgaacctgggaggtggaggttgtagtgagctgagatcatgccactgcactccagcctgggtgacagagcgagactctgtctcaaaaagaaagaaagaaagagagagagaaagagagagagagagagagaggagagagagagagagagagagaaagaaagaaaggaaagaaagaaagaaagaaagaaatctgtggaaagcagttgttggttcagtgatagaaagagagattcgcaggtgggggcagggcaggggccaggctgggcttctgcaggagtcaggtgcggtggatgttgcagcgcaggtatagcagccctgggggtttcttctcattggtcagcaggtggcaccaaatagctaaaacttatctggggagaggcatgccttgcttgggttttaccttgggttgggttggattaaattttactttctgtactttcagaatttgggattaatagcactttcacattttctccctagagatagaatcctccaagtttgaattttataaaagtctctgatattgataatagtcatgaaagttaactatattcaagatcagatgattgcatgacattattaattttcattttttggaagggtttatgactttgaatgttaaatgccactgtaagatcattcaatggaatatacttactcgattagatttctgaagtttttgtgtttttatgaaatcccataaataaattgctaacgtaggtgtgaaaattaatacacccgtgaatgtacttaattgagattgagtatgtctctctgatgagaatccaggattttacttccattcaggatttttctattagagcagagatgggtgacagtttgagtcacagatgttgtggctcagtggtaaagtggattcagtgcttcttcctcaggaacatgtggggtgtgttggctgtgttcttggatagcatgtgagaaaacagccatgacaaaagagcaggcagttgtgtgctggtaccacccaagagcctactgtttatttaaggtgcagttaatttgtttcagcttatttactatggaaacttggttgcatgtggcatgtgtggttatgtgctggaacttttaaaaagctgcatttcaagcacgataaatgtttcttttctacatatatgggtttgtttattttttgtgtggtggcatatgtgagggggaagaatcatctcttgaatgatccttctgtgttgctgagtggtgtctggtttggttagcacgcaggctgtggtgaggaggcctgctgactctggcctaggtgcacatcttggtgcacactgaacaaggctttcactaagtgagcatccagctacaaaaacctgacaataaatttttgagttttaagatgttgataacagccgggcatggtggctcacgcctgtaatcccagcactttgggaggccaaggtgggcagatcacaaggtctaggagttcgagaccagcctggccaatatagtgaaaccccgtctctaccaaaaatacagaaattagctgggcatggtggctcgcgcctgtagtcccagctactcgggaggctgaggcagaagaattgcttgaacccaggaggcggaggctgcagtgagccgagatggtgccactgcactccagcctgggtgacagagcgaaactccatctcaaaaaaaaaaatgttgataatttattttttttcttgggatagcttcataccactttaaaaggggtgttgtcttttcactcctttcttcctacatttgcagattaacaacttacttagatagcttcatatgcctgactgagcctgtttccccccagtgaaatttaaaatatgcgggaatttaaccacatttaaccacacccataggcatcaggcatagcactagctcagtttctcaatgtctcgggtctagtcagtccttcaccaggccctgtcagttctccctccaaagcacatccacctctaagcacatccacctcttaaccatccccgcttctccacccagagctgcaccgccatcatttctggagtagcctcccaagtggcccctgcttccattattgccgcctagaatctgttttccacacagccctgggaagaatattttacaaatacactcaagggtggtgtcggttattagcttaaaatcctgcagttgcttcccgccacacttgggctcgcccacctccctccctaaccttgtctccgagtctctcccgctgcccactagactcagccacattgaacttgccgttcctcctgcatgctatgctgcttcctttgcctgaaacactattattcttgatctgtgcgtgactcattcctcttgacattgagttctcagtttcaggacccactcgagaggccttccctgatcaccagatctaaaaatagtcacatgactctgctgtcatttttttttatttaaactatcttgccttttcttgtgtgctttttgtccagctcctaccactaggatataagcttccctagagccaggtccttattgcgttcatttttatccctagcatctggtccagcacagagtacgtagtaagtcttcattgtattttggttcaatgagtgaataatagctatattgaagggagaagctgtgtttaaagcttatcagttcaggataaagaatagcaagcgtgtattgagcatctaccatgcactggtactgtccttggttgccatacacttacatcttaattttttttttttattggagttttgctcctgttgcccaggttagagtgcaatggtatgatgtcggctcaaccaaaacctccggctcctcggttcaagcaattttccagccttggcctcccaagtagctgggattataggcatgcgccaccacgcccagctaattttttatttttagtagtgatgggttggtcaggctgaactggaactcccgacctcaggtgatccgcccgcctcagcctcccaaagtgctgggattagaggcgtgagtcactgtgcctggccttacatcttaatcttaagcatcagttttctaatatgtaagtgagatgtttagataaaatgatctgctagttctcttatataacattttatgaatttccaggagaagcttaaagattataatttatggtgatacacaatgggaataaatgagttcattcagaagccccacgtaggtgttgatctacctccgataacatttctttttttttctttttgagacggagtctcgctctgttgcccaggcaagagtgcaatggcacgatatcggctcactacaacctccgcctcccagattcgagcaattctccctgcctcagccacccaagtagctgggattacaggcatgtgccaccacgcccagctaatttttgtatctttggtagagacgggttttcaccatgttggccaggctggcctcgaactcctgacctcaggtgatctgcccacctcggcctcctaaagtgctggaattacaggcgtgagccactgcacctggccctctgataacatttttaaattgcagagtttaaactttagaaagaaggaataaacccaccattttgggggtatccatcatctcattcagtcctgtcaacaacctctgaagtatcttccctctttaatggttggggaaactgaggcttagagatactaagtaacttggctaaggtcacacatctattatgagacagtgctaaaacctaaaaccagcattgctccagaagacctattcttggcaagcactgtttttattttctgctcactcttatcccagttggttccgtggggactgtatacacttcagacgtctaaatgtttttccttttctttctcatagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcaggtgagtccttcacacctgtcacagaggcccaggatgcctaaaatcaggatgccccttaaaatcatccaccctgttcccatgacgctgtcatgttcgaaggttgtctcacttctatttaaatgtgtccttgagagccagctgaccattttataaggtagtcagttccatatttggagagctgtcaactctaatggccaaaattattcagagcacagagtgttatttatagcaattcaagaacagctgccctaagtttgtaagaattcttttatttttgacaaatcttacattccaaaatatcaaagcatactattccttatactcaaaaatatacaaattaacctgtgtacttagtgcctgtgatacattaactggcctgacctgtaccaagatgggttagtattacacgcaaggattttacatctgaaaagcaaaagctgaatctggtaaaggcacatttaatacagtaacgagtaagtttgccattggtccattagttcgtggaacatgtccttactttgtgatttctcattcccttgttgctggtgaacacctagagcacactttctccatggccccagtgagggtgaggagtgttttaccctaaaattgccctgaaaatcaggaaagcgttctgtggctctgaaaactcagctgtactgaatatatgtaaaccaagtatcaaaaccgagttttttcaaggtcctgcatctgtactttgagatttcaaatgaaatttcagatgaagtttattccaaatgatttttttctaatgtctttaattgtgacaagtaaatcaaagtcatgacttgagaagttaagtttactgttaattctaactacataactcacatttttgttgcctttatagtggaatctgattatgaagcatgcatcatttagagtcatcttgattgtggacaaaggaaacctaacccagagtggtttaagtgacaaagaggatttattggtcacacagtaggcaaattcagtctttaagcaagacttactcctggacttaaatggtgtgaccaggatctagtttctttctctctactctggctttattttctagtgcaggctctgttcacaagcaggctccatcctgtagtcccaagatggctgccccaggtccctggcccccttggactatggacatccagcagaaaagaggatgcttttctgcttaccatggcccggatatatcagtctcactggcgtgattgatcatgacttggatcatgtgcttctcccgctggtgttggagaatctcatgtgctgttaacttctaaacaggatgcaccccttagagtgaaagtttggtcagtctcaaccaaacaagttggctagaaagattggaatataacagaaaagaggaagaggagaatggatgttgggggtacagctaacaatgtactacagaaaaactattcagctgctttaggataatttgtctcttgagtggtgttgatttaaagatctttcttgagctggcctgaatgaatgattaatcagtcactctagaattggggcttcattatcattcattaacatggaactctatggagatcatgaccctggcttgtgctagtaaagtgatttgtattttaatctctcacctctttttcttgtattttcatttgagtctttaggccagtatgctagtgatggccagttacctttgatcttgagtcttactttctgattccaggctatgtattatctcctttctaaaggaccattttgtttgcaaactacagaacagttccttgttctttgcatgtggtctttcctacagtttgagaggagagcctccagctgtccttagtatccatcatttgtcttaacctttctaggatgtttacctaggtccctcagtaactgtagtcataataatagcaagcactcaatatagtacttatactgtgtgccaggcactgtgggaaatgccggcatatattaacagttaatcccataacaatcatatgagagagattattactgtctacattgtatagatgataaaacaggttccagagagattaagaagcttgcccaagggcttactgctgctaagtggctgaaggcatactaactctgcagtgtatactctttttcagtattcagtaaagtaaaaaaaaaaaaaaaagatgtaaagctcattggcagagagcattgctagtgaggtaattcaaacatgttaaaaagatctttggaattctcaggaatgcatcctgtggtctagaagaaaccagggcaaaatattgaaaaggaaagatgctgcttccaggttaaatgatactggatgggggggcaggaattgcattcagtgaatttacaagataccaggaaacccatctgttggaggaaggtaatgaaggaaattatcttatcctacttattattttacttccttattctgtgggacagaagaatctcttgagtcctctaaaaaactatatgctgatagcaggagttacagaacaattcagtagtgtctggaatagaacagtggtttgaaaagtagagggcttgttaaagcacgggatgctgattcagtaggccttgagtggggataatttacatatccaacaggccaggtgatgccctggcttggggatcacattttgtgactgatgcagagtactgatggtcatccagtccccttccttcggtgtttgagaccacttcatctggaccgagctaaagtctaggaagaaataaagtttcaaacccagtagagttacctcaaagatacacttgagacccttttcagaagatggcaccgaaagtgaagaaggaagctcctggcccgcctaaagctgaagccaaagcaaaggctttaaaggccaagaaggtagtgttgaaaggtgtccacggccacaaaaaaaagaagatccgcatgtcacccaccttccagcggcccaagacactgagactctggaggccgcccagatatcctcggaagaccacccccaggagaaacaagcttgaccactatgctatcatcaagtttcctctgaccactgagtttgccatgaagaagataaaagacaacaacacccttgtgttcactgtggatgttaaagccaacaagcaccagatcaaacaggctgtgaagaagctctgtgacattgatggggccaaggtcaacaccctgatggagagatgaaggcatatgttccactggctcctgattatgatgctttggatgttgccaacaaaattgggatcatccaaactgagtccatctggctaattctaaatatacatatctcttttcaccaaaaaaaaaaaaaaaaaaaaaaaaaaaaaaaaggtccacttgatgtgggagtggtgtggtaggctaaccacttgactttgaggaaagggagatatcttcctgtcccttataggggagtgatacagtgataggcccaacaggagggagtgctattgtggggtttctgctgaacatgcatgttctaaagcgagacattttgcttagagccataaaaatgtacatatcacatttcctgtgtccctctagggctttcggtagatacaatctaatctaggtttcagtctgaattctgaggcagatctgcaaaacatgtaggaattcatcttttaatggtgtagttcatcttgtactgatagtggaaccaccacctgtgccctttactaagctgctttcagggtttatgtatctaaggaaatagggtgaggtaaactacttgttactaattctcacccagttgacagatacttcctattattaggttatctgtgaattgtaaaaaactttttttttttttttttttttttgagacggagtcttgctctgtcgtccaggctggagtgcagtggtgcaatctcggctcactgcaagctccacctcctggcttcatgccattctgctgcctcagcctctcaagtagctgggactacaggcgcccgccaccaccccagctaattttttgtatttttcgtagagacggggtttcgccgtgttatccaggacggtctcgatctcctgacctcatgatctgcccgcctcggcctcccaaagtgctgagattacaggcatgagccaccgcgcccggcttaaaaaacatttttaaaataacttttactttacgtgtcttcatcttattcaccctcaggaattgcttttaattcaatgcagtataataagaaatatatttggtctttgttctgggttcctggcatagagctcctaaaaccaatggagtctgccgagtgatgggagtgtcttttgttacccataaggtgtcccttttctgacacctgagtttgtgctaattccatgactttgggtggggatagtctcccatccctagctagcctcaggatgatgctgtgcacccaagactgagcagttagagaattggaactttcagcatcatccactcatctgtggggggagttggtgtaggtagggtggggtgccctgagaggacatggaagccccacctcaccccagtaccttgccctgtgcacttttccatttggccgttcctgagttgtaacctttataataaattggtaaacataaaggggaaattgttttcctgagttctgtgagttgttctagcatattattgaacctgagggggttcttgggaacccctgaatttacagcctgcggcctgggacttggaactggcatctgatatgggggcagtcttgtgggaccaagccctttatcctatgggatttaacaataatgtcaggtagaggtgtcagaattgaattgaattgtagcatacccagttggtactggggaatcagactactaagatatttcacaggggagatagcatctctagtatagtaggcagggtgtcagctggttttcttgtttgtttagaaatggggtctttctgtgttgctcaggctagagtacagtggtagagtcatagctaactacagccttgaattcctgatctccagtgatcctcctgcctcagcctcttgagtagctgggactataagtgtgtgccacaaagcctggctatatcggtttttgttttttgttttttttttttaatgtagaaatcaggcctgtgatcacttgtccagtaccagcttatcattacaacaatgaatcggccagcaatcagtcacttccagtgcctagttctttcattttccttaaactctgctgcttgaaaatcagtctgattcatatctgcgtcactcatcgccacccccagctccttagtagccagaaacatcagcgtgatgatcaggaggaaatacagagaacttgacctggagcacctggcaggattgaaagcaacagctttttctccaagcagagaaaagcttcatctgaaagcttccccctcatgcaagttgaatgataagaaacctcaagtcttcagcttgtaaaaatttaagacttagatgtgttttaagaaaataattagaattgccgggcgcagtggctcacgtttgtaatctcaacactttgggaggccgaggctggtggatcatgaggtcaggcgttcaaaaccagcctggccaacgtagcgaaaccccatctctgctaaaaatacaaaaaattagctgggcgtggtggcgggcgcctataatcccagctagttgggaggctgagacaggagaatcggttgaacctgggaggcggaggttgcagtgagccgagatcacgccactgcactccagcccgggcgacagtatgagactccgtctcaaaaataataatagttagaattaacattgagtattgtcatatactccaaaattttatgtttatatccaagaatatttatagatatccaaaatatattaacatgcaatcctcatgaaaagttattaatgagacactttacattttttatactacgtctttgaaatatacatcttttgtatatgtaacagactggcaagatatatacttattcctaaagtggaatgtggagtgaaaacatggtagatggtacttccccacttctgaggtgttactgtttacagtttggaaggaagctgaggagagcgttggtcaatcctgttaactagcacagtgaagtagtttttatgttttctgtaaatgattgcttgcatcccgtgattgcaggcccactttcctgacctctgaccagttgccttggtatcatggaacatgcagtgattcaaactaagctggactttttggaaaccagcattttatttgaagtaaaaagaaaacagttacacaattttttaaagactacgtcttcccctaatttgtgttgattctactgtgagacaagaaaaatgcatttctgcttgaggtgcagtaacaaaactagcacaaatttctttccttcttaactatttctcggatagaagattcattcttaacatagaccttatcattataggatttttttttcttttcttgttgagaacttttactttttcacttaaaggaagcatttgacagtcgcttctttttagcatatctgaattgccagcccagggccattattaagtcaaataagggttacctgacagttaatctgataatcaagacggctgctaagtgactaacagggagcgtctgcagtgtgtgtctgctggacaaagggatgattcacataccaggcgggatggagcgagatggcgcaagatttcatcacagtgctcaggatggcatgcaatttaaaacgtatgaattgcctatttcttcagtttttcatttcatatttccagaccatggttgactgaaggtaactgaaccatggaaagtgaaacccaggctaaaggggactagtgtgtgtgtgtgtgtgtgtgtgtgtgtgtgtgtgtgtgtgtgtgtctaaaccatttgacttctagtgaacgaacagagccaacctcttcctgaatatgtaaagaaatctataaaacatggcctagaatgatctaattaggaggaggaaacctatttacatgagactatatatgtatacaagtgcctggaagttagtataggcaatgattgctgtagtaagatggagtttcgctcttgtcacccaggctgtagtacgatggcgcgatcttggctcactgcaacctccgcctcctgggtccaagtgattctcctgcctcagcttcccgagtagctgggactacaggcacccgccaccacacctggctaatttttgtatttttagtagagacggggtttcaccatgttggccaggctggtctcgaactcctgaccccaggtgatccgcccgccttggcctcccaaagtgctgggattacaggcgtgagcctccacgcccggcctgctgtagtaatttagggggaaagattgatctctctctctgtctctctctcacacacacacacacacacacacacacgcacgcacgcacacaaacacacacaccccagtcattttaaggggtagggtctagtgacctaaagagcactggaacttggagagaggaatctgggacctgagtctcgtcgtggctgcttcattttccactgcagcaaaattgaagaggctaggctgcaggtctctgagaacacctctccttaaaacagaaagtctgctttgggctgcttaagatagtatatgccatctcacgcctggactcattgtctaaatcatgttagggctcttcttgttcgcacacctaacattctgttcagaggtgacactttcctgccccaagggaaagagaacagcttcttgcatggtggaatgggtttttacagagaggattaacagggatttaatagctacccattattttcctcatctactcttcaggctgtatccctaaattatgcattatttgggactatttgtgaaagaggtgtggcccctagcacacagtaactatactaccattgtttgtgaaatctgaatctgaaagagcattttatatccaagttgttcatgaaagctattgagagaaagtctgttgaggtctttgcacgtagtcctagattataccctcaatttatttttcacatataaatggtttccatggttttctcaccatagaggtggaagaatctttgctttacttttttaggtgtagttttcctctggttccttctccctcctctgtctgttcaccactatagacccagtttctcccctgcttctgaaatcagcttggattccttctcctgttctacctcagactctcttctcacctcagcaatggctgaaatctcacagtcgctgaggtgagtgatccaggcatgggagaacatgcagatggaagcctcgtgctcccagagtttctgactattcaccatgcactcatcccccttcctggcccagcccctattcctgcacctcactctttgagagcccaggttctccttcctcagtcacctcagagaacctctcttgatcctcattcccctttttgtctcctgttccacccctagcctttgtctgaactcctcattctctccactccaccagaattctttccctaagtcactcacttacttttgaggcgctccgttcttctgtgaaaaatctcatagaattgagagttgatttatgactgaattaaaggaatacaattgctcttcatttggggactgcctgtgtaagcaaaagaggaaaaatgtatgtgacctttctgccttcttatccttttcctggctctgtctgcatacatgttctctcacacacacatatcagctttattgcagtacaatttacataccataaaatataccccctttgaagtataccattcagcagtttttaaaatatactcagagttatgtgacaattaccactaattccagagcatttttattacttcccaaagaaatcccatgtacgttagcggttacttcccattttcctttcccccagccccaggcaactactagtctacattcagaccctatggatttgcctattctggacatttcctaaaaattgaatcatgtaatctgtggcctttttgtgtctaacttctttcacttaacaaaactttttcaggtttcatccgtgctgtagcatgtatcagtaccttatttctgtctctgctctcttagataagtaatagtggtagattagagagaaagagcagaaaatactctgtaaaagctactagtaccatagtgctgtgatttttatttggtggttgcctggaaacagatggcaaatctgttgtaggcatcagaaactactgtaggccagatgcagtggctcacacctgtaatcccagccaaggcaagtggatcacctgagatcaggagttcatgaccagcctggccaacatggtaaaaacccatctctactaaaaatacaaaatgagccggatgtggtggtgcacacctgttacatgtgagtaaccacctattcaggaggctgagacaggagaatcacttgaatctgggaggcggaagttgcagtgagccaagattgcgccattgcactccagcctggctgggtgacaagagcaagactctgtctcaaaaatagagtaagtactgtagacttaggaagtttttcatttccccaaatgtggtcatcataaaggcctattggtgggtgtttggtgtctcagatggttctatttgttgccgttattaaattcacttacacagttaacccctttgccagttttctaccaaagtggacctgtgagaaagtactatcataggatgataaaaggtataaatttaatttatatataaggcacttgtaaagttatgtgtattttaaaaataaaacatgtcccatgataaaagcaaactcagaatgacacaaagtatatttttaaatttaacagtgcaacgcagctctctagaattttatttaacctccatcttcagtgataccattcaatttaattttctaattaggagagaaaattgatgctaggtagatgttaaatagtttcttaagttgcatttgatttttgataccaagtcaattaaagaagatagttgtgattattaagctataaattcaccagtagtttgacatgatcatattcaatagcagtccagtggagaggggtccaggtgacagcagagctaaatatttggtctatgtctaatgattgacttctgaaaaaaatcatgcttagaaaattatttttggttaggtccttctggttgtaaggaatacagattcacttgagttctctgaacaacaaagatatgtgtgtggtggatatggggtaaaagaaggagaggccgggagctgtggttcatgcctgttatcccagcactttgggaggctgaggtgggaggattgtttgagtccagtagttaaagaccagcctggccaacatagtgagaccctgtgtctctgaaaagtaaaaaaaattagctgaacacagtggcacacacctatagtcccagctacttgtgaggctgaggtgggaggattgcttcagcccaggaggctgaggctacagtgagccgtgattgtgccactgcacttcagactgggtgacagaacaagaccctgtctttaaaaaataaatacatacatacaagagagttattacaaagtttcatgcaaatgagccctgaaaaatctatgtgacagtggctgctgtggacctggaggcattacttatatttccgatgggccatgcgcctcattcattggaaccctctgcttagtatctgctcctccttgactcagctcacatgtggctttggtatactgtcattccaaccccagctcttgcctatcctttgccttttgtcctcattgctaaatgactgaatatccttgtttcctgtagttcaaatgtctgtaaggttgggtacagagatggggttttgattgacccggaagatccttttataccagatcatggccaaccggatacttagagtggataccttcagaagaggtgtccccaaacattggtgaggagctggaagccatatgtacagaacacatcagctccatccatccatagctcagaggcatctgactggcagttggaggatactgttggcatgcctaatgcagaagaattgtggtggggtggaggaaggcattttatagtaggacttttggggaaagagactggagtatcttggatgatcaagggaagggctaaatagccaatctgaagaaagggtgaagggcccctaggacaacagaaattaaggcttttcatctctccatctcttgttgttagtgaccttgtgtaagtgggcttctgtctctgccccttgtaggtagtcttctagatgacaggaaacatggctgccatctgctcctgggcttcactctctaccacctttcattttttctggttccagttggaaatattaggggtgtttgggagaaaggctgtaatttaccaggctttactcaaatgtctagagcagtgaactggagtatggagtgtggagggacataagagcatggcagctctccctggaaccacatggaactgtttcccccaaaggggaaagtttgctgggaagatgacagtaagtaacaatgaatgtttacgacacattttcagatagactgatgttcttgattcagagataaagacattttataaaatgcaaggtgatgtttaccattggttggttacttaaaaaaaaggagcccaataatggacagtttcatttaagatttttgaataaacaaaattaacaaagagaaacaaacattagcgtttcagtctttagaatatgcctttaacatggtgtttcatttgcattgaagttattgtcttgtgaatatgtgtggttgataacttggaaacagtctatcccaagcttgcatctttggattctcaagaaccaagcatcactcttagagcatgacaggtgcttagtactagagtgccattctagattctttagcagtacagtgatataagtactctattaacactttgttccttactcacatgtaacctcttttggggaatagacaatgtgtataaaacaagcaatgaattaatatgaaagtgttgtgatacttcctgaaaacctgaatcttagccttttcatcctctggttgagaaatacatctgttttctacaattcttatttcttctgtatttttattagttaatcttcaagggaatttgcagagctctgaattttgacctctttgctgcaagcctgtgaattttcagaactctcagataatgacatcattgactgatgggtacctgttattgggtgaggctgataagaattttgccattcaggtttaaatttctgcagacgccttagactttttgaacatgtatgtgaagtcgccttattagtcacaagattgtgtctttaggcatcctaagaaacagatggactgaagtcggagatgccgggccatttgcgggttctcagcccttccctgtgttacatgtttacctattggttcactctaagtttgcaggaaacccaagctctccccactgcctccactctgagctccagccctggccaggagccctcttgcctgtatggttcacagtaacctttcctcttcaagaaacttccttggcccttgctattctgtaccccatgttctctgtgtcttattagtgtcatgtgtgtacttaggtgggtgtatccatagtctccctccagctgatgactaaattccttgaagacagtgacagtggtaacatttgtttccacattccctacaagcacctcacctaagtctgaatgcacctctgctttttattgagtgcttgtcagactgaagaactcattcatggtcagagctattaattatcactttcatctggggaaaatttcctcctaatttttgtgatacctattaaagatttctttgtgtttaataattttacattaaaatgcattataaaatcatgtattacattgtacattacagtgcatgcattgcaaaaaaaagttcaaacactgcagaagtggacaataaatgtttctctttccccaaagcctttcccatctttctccctaaagataattccttttaaaagtttgatgtgtatcttttgagatattttctgtgtacttttttgttgagacagggtcttgctctgtcatccagactggagtgcagtggtgcgattttggctcattgcgacctccaccttccgtactcaagtcatcctcccacctcagcctcataagtagctgggacaacaggcacacaccaccatgcccagctaatttttatatttgtttggtggagacgaattttggccatgttgtccaggctggtcttgaactcctgggctcaagaaatcagcccacgttggcttcccagagtgctgagataataggtgtgagccactgtgcgtggactctgtgtacattattgaaaacattatgagctgaatgtttgttcctcccactcaaactcatatggtgaaatcttaacccacaccatgagggtgttaggaggtgaggtctttggcgggtaattaggtcatgaaagtggagccctcgtgaatgggattcatgtccgtataaagtagacatgggaaatgatctttctccctaccatgtgagaatctgagaggatggctgtctgtaaaccaggaagaggtccttcaccaagaacccaaccatgctggcaccctgacttccagcctccagaactgtgagagagaaatggttgttggttaatctcccagtctgtggtattctgttttagcagtctgaactaagatgaatttttcttttctagtaataaacagaagtaagaccagctgattgatagaatcctggagtttaatctttctcctaccagaatatttgtcttagattttcattctggcagtgtctgtatgatgttaacatgctgcaatgttaacttggtagagatgggtttgggaaatttaaggcattgtttgctagcttagtagaagccattacacagtgactcacacgtcctttactgtggatttggcccctgccttcttttgtgctccaggtatctcaccctaaggtttttaccctttttggttaaaagaactaaagctaaagatttctttagttttctcttccttccttaggtcactgggatgtttctggagctcttccccctttgcctctttaccttccatgttccttggatatcaggggcactcagtagagggcatctctaaagaaactatctccccaaggttggcctgcagtttgcctgtgttattctctgtcatcattagcctggagtacatgttagcagttgaagtttgagaatttcatggttaatttttccaaacgttggccacagttttcctggagaactgtattgtgacaaggacatacagagtattaggtgactatagtgaccaagcaagatagggaatggaatgttaaaattgtagtagtttatacgtagattacctctattttgctgcaacagccaaaggccattcatctgcccctcactgtagagcacaagtggaggagaatgttgtcgtcgttttaactgatgtgtaatttaagccttttttcctgtggttaataacaacaaaaacaatctagtaacttcctaaatccatgccactagcagcatgttatttagccagtgtggctctccagttagcttttacctttttctctagccagggacatgtatttgacagttccatggattgccagtcccaaagctgttttatatgccgattttggagaagtaagcctacagaccaaatctattagccccattatatgtctctactatgaacatacacacttttatgcctagaactgcagaggatttgtgtgtgcttccagcatttgccctgggcccctatacacactgtccatggaattatactcattgtctccaagcatttgaaggaaggccagtgttagtatggatgcttgtaaataatgtagaggcattcaagactaccttgagaaatacaggatggagaagaggcgaggctggaggatgcacttgatactaatgtgaaatctaaaacccctcacactgaattaacagttgttcccgtgcagctttgtttgtgcattcatttaatcagtcgtaatcttcaggcatgcccacatgtggattttctttttaactccctcacattcagggagccattttaattgacatacgcaacacaattattgtccgaactgaattttatgatgggggatgatgtttctatgttttaaaaaactcaatggatgacttcagagtactcatggagatgtaacctataactgacttgtgattttgaaagaaataattttcaaccatttcagtaaggaatatattttatatggcaatatagtacacataaaggtatgtatatttgagaatatacatacacataaatgtatgtttatgggtgtatttgtgtgtatccacacacatttaaatttcacaaagtagtgtttacgtgtaccacatgagatgctctgatactttctattctattccattttttaaaatgctagcattgatctattaattcaattttattacatggtgttggaatatcctgtggtagttaggtacatttcaaagtacacctaagtgatctatttttaagctttattagaatgagtgcttattgattttgtttcattcatttattagtgaatgaatgagtaaaatatttgagtacttaactatgtgccaggcactgtgatcggtggtagaaacacagttaggtgattaagtgaaaacaagtctgtggtcagcagaaaagattttcagttttcacagaggagagttgttgtcagtagatgaaagggatttcaggccaagcaagcagtgccatgaatggcctgaacatgcatggctatgtcgagatgccatgagaagagctgcagaaggagctcaaggcaggactataggagtgaacgaggagtgccgtggtgccaaagagtttagcctttatcctgtaggccagtggtttccagaatctatctcaggagaatttttattttcaaatagaaaactgttaattaatctcaatatgtaaaactaccaacttggagttacgctagaagcagcagaggaccctcccctagatttccatccccagggggctcaaggccattgtgactgcccctgagaaccactgatgtggaatttgtctcagaaggatccctctggggacactgtgaaggaaggcacagggaggaacgccattttaggggactgttgtgttcttccagggaagaaacaaggccctgaagctgagattgtggctgagggcttgagaaagcagggccttttcaactgttgaattagacttcctaggacatgctctccaaggggatgggaaagggaagaggaaggaagaggaatttggtttgggttctgtgaagcctctggatgttggatgcttgggatagatgagggtcgtgaggtattttggtcacaaatctgcaaggtttcccctttctatcgtgtggcctctagtttttaggattatgtttttcttagctcatatttgtctgtattctgtccagcctttggaaactgtatgggccctgaggctctctcagtctgcctgtctgaatacactttggaggtcctcccactgctggagcacctgaatgttcctgggtttggattcagctatccaggactgtccatctcggggctgatgctgaggaaggaaggatggcttcagaggcctggagtcccacatgaggtccctgctctgtcgcctactagctatgcgatggtgggcaagtgactcctttaggatgaggataatatccaccttatgggaatgttgcaggaacttaaaataatgtggaagattcctagctcggtgtctgcacacagtgggcatgcatgtgaagtgttaattataacatttcattatggaaataaatcttttgaagggagggcttctatttcctccctgcaaaaaggccttccatattgagaaatattgcattcatgcaagggaagatgaggagaagccaaggaggaggcaggaacattcaaaaggcacatgttctgatggcctgacgacactggggacctgtggctttgtttgctgtgaagtttagagggcatttgtgaccctcagtccttctcctgggaagcaggaaaagcaccaaaaaatacttgttttttttttaattaaaaaaattaatatggtctttgcatttgtatcttctctcactgtactttcctgtttcggatttgcactcaatgcacattaaaatgatcctgcataatcctaaacatttattgagagaatgatttaatggaaaaatacaataaaaatattttaaacttttgataaattggtcccccctcccaccccaaaaaaaatgactgaggttggaggaagagacagatgggagtgggagatgcatgttctttggagggagagagacatggtcagtgtagaacaatccaagtcagacaggctggctcttaccggaagagggttggtccttcatgggggttatttagctttagtgctctgttcctctttgttgagacagctgtagttaggtataaggggataataaagaagaaatattactaaattcccgggaggattatttataatacttaaaatgtgtgtatcactttcatcttggagaacattatagaacattactataatactaatagaagtctttggaaagcattatatcccgtgttacagatttcagtctgagattttctgaatcaggttgttgtttaccccagcttgctctagtggtaatataaatcagaggcttctgggttccaggcagtaattgaaagcttctgatgcctatctttgacctgccttttccaaccttcttggaaattgccttccttcacataagtatttgtagggctctgaatactctttaattaatggggggaaaatcttctacctctccctacaattactccatattagcaaattatgagtaagactttgagatacctcaggtatctcatttgtgatgtcagagtggttattgaacttactaaacctttcccagaagagccagaccttgcctaaacttaacgaaaaggtttagagttgagaatcagatacttttacagggtcatttttgtctgtttgtttctgactgtcaagcacaagagatacacatgactaatttaaaacaggaggcctaagagacctattaaaaaatgtcaaacatttatttgtactaaatactacatcaaaaagatatggcaatatgaataagatatagagatataaaatatatcctagataggatttttggtaggctatacaaacttgaacaaagttttaaaaaggagtaaacttttatttttttatttttattttttattatactttaagttctagggtacatgtgtacaacatgcaggtttgttacataggtatacatgtgccatgttggtttgctgcacccatcaactcatcatttacattagatatttctcctaatactatccctccaccagccccccactccccagtaggccccagggtgtgatgttccccgccctgtgtgcatgtgttctcattgttcaactcccacctatgagtaagaacaagcggtgtttggttttctgtccttgtgatagtttgcttagaatgatggtttccagcttcatccatgttcctgcaaaggacatgaactcatccttttttatggctgcatagtattccattgtgtatatgtgccacattttctttatccaatgtatcattaatgggcatttgggttggttccaagtctttgctattgtgaacagtgacacaataaacatacgtgtgcatgtgtctttatagtagaatgatgtataatcctttgagtatatacccagtatactgttggtgggagtgtaaattagttcaaccattgtggaagacagtgtggcaattcctcaaggatctagaactagaaataccatttgacccagcaatcccattactgggtatatataaaacggagtaaactttcatttaaggaaggatgaagttaaataagcaaaggtacccagagaccccactaagtgatagatactagctgaatgctttatttaacaagcctactattctattgctaacctgccattagaaaaagctggcagatggacattaaaatccagcaaaactatttttaggtaacaaagctttttgatggcatatacaaaaatggattcagatggtggtgggtggggggcattgtcagtactgttactgcaatcaggagctctgggagtccactggacttctctaacttgactttagagaactccatctagcctctctgtctcagtgtccttatctgaaaaacaagggggtgggctggatggattctgagggccctcagacctctaagattgtgtatatgctcttagggagttagcatgctaacgggctgttgctaccaaggtaagttttggcatttttttcctggtggtttctgtgtacacagtgagacacagagtgtgtattggtacagggatgatagcaacctttgtccttctacaggaaataatgccctgtgactctgactcaagacctagtctcttgttaatttttgttaatgttttatgcttgatgagtcagaaatgcaggctcttgtagagtgttattaacaagaactagtgtaactttgattataatcactacaaattacagacctctttcctgtgtaatgatttttgccatttgcccttccgtgatctctaataggccaactacaaggacaattttttgatcagtaagaaccttggtctgttgcttcataagcccttattatggcaaaattattcgtaacagcaaactatgtatgtacccacattgacagaatatcagtgttctttagctggctgggcaaagtctaagtgtttcaggatagttgatgatgggggtatcacaaaaacttcagagtaagaaaaacttgtctgatatctgttaaagtgatctgtatacatgtaggcattctcctgtatatgtgcatacacacactcctaagttgtgtaaatgtgtacctgcctgcttgagtatgatgcattgctactatttctaaactaccaatttatttcccctgtgttttgaggactcaatctcaaagatgctgactgaaaaataaagtttttgaacaatttcatgaaggttgggttgtcgagatcatgagttctgactctaatgacaactctgtgggaaatggataaactctgataaactctatcgcactgcacacaaatgtgaggctggaaggcagtacgtaatttatgaggccttttgttgtaaaaatgagagttggcaggattccgagtaaatatcttttttcctaagggtggaagataggacttggagagatcaatgtgttggttgacagcatttgagaatgtttgatttgagcttcagcatcataggtggggaacatgtggctttatagatctgctgtttcttcccctgcccagtggtgcattccttgtctttactgaagtatgtttttaaaattcatttttaatggtggtaaaaaaaaaaaaaaaaccacataacataaggtttaccatgttaaccatttttaaatgtaacttcagtagagttaactatgttcatattgttgtgcagtcagatctctagacccttttcattttgaaaaactgaaactctacacccattaaacaataactcaccacgttccccttcccccagctcctggcaaccaccattctactttctctttccatgagtttaactactcaacatactgcatgtaagtggaatcatgtaatatttgttttttttctaactggcttatttcatttaacatgatgtcctcaagcttcatccatgttatagcatatgacagaattttcttctttttaagtaatattcaattatatgtatatgccacattttgtttatccattcatccattgatggacattagagttttcacctcttgctattgcgaatgatactgcaatgaacataggaatgcaagtgtctctttgagatcctgctttcagttcttttggatatatatccagaaggggaatggctggaccatatggtagttatatttttaattttttgcagaacctccatactatttcccacagcagctgcaccatttacattcctaccaacagcgtacaagggttccaatttctccatatcctttactgaagcttttagaatgttattcaaaatacgatataatggaaaaaaggcaccaacgtggtctcaaattgtgtttttcttggtagatggtaattaaaagggtaatggtgattaaggtatcggtgataaaaatagtaatgaaaagaggtgagtggagaggtagttataggtgagcttggcaggtattagaaaagagcttagtctttctcttctttctcttcattcttcacctgtcattaaaattctagttgtggccaggcgtggtggctcacacctgtaatcccagcatttgggaggccaaggcgggcagatcacgaggtcaggagatcgagaccatcctggctaacacggtgaaaccccgtctctactaaaaatacaaaaaattagccaggcgtggtggcgggtgcctatagttccagctacttgggaggctgaggcaggagaatggcatgaacccaggaggtggagcttgcagtgagccaagatcatgccactgcactccagccagggcaacagagcgaggctccatctcagaataaataaaataattctggttgtgatgaataaatccatttgtcaggtatttttttaagtgcctcctgagtaggctattcctcaggacaccataagaataataaaggaaagatcaatgtataaaactgagaaaaaggatttttaaacaacaaagtttgctgaggccaactttgtgtatggttctacactgggctggaaagatgacatggaagctgtgcttgtaccgcatcctgggctgtcattctctctgagctggtgcaagttggacatcagagaacataaacagatatcactcatctagcactcaggacaggccttttggctccacctttgtggtggatgctggaaggcagtggggaaaggacattaaggtgagttttccctgattccaagccctgggcccacttcattgactggcatgagaaatgcacgctacttcctttgtgcttagcttcctcttccttcaggtttgctctagaaatggcagcaggaattcagaaggcctgctttctaatctccagcatgccggtagcttgctttgtaactctgggcacacggctctgtgcctcatttctcatttttcttactataaatgagatgggttggcttagatagaggaatttttaaaaggaacttctgacacctgttaggactttcagctatcatcttctgactgtgaaagattaaggtatgcatgagggggtgttacctaggctggcataggctctctgagtcaccatatggtgccacctccctcacagagtccttgttttcatcagtgttcagctttcaaaaatggctaaatcatttttaactgttccttaaagatactgggctgggggtatagggtgaaggttctgtaagacttgcatttggctgggcacggtggctcacgcctgtaatcccagcactttgggaggccaagaagggtagatcacttgaggtcagaagcctggccaatgtggtgaaaccccatctgtactaaaagtaccaaaattagctggtgtggtggtgcgcgcctgtaatcccagctactcggaaagctgaggcaagagaatcgcttgaaccctggaagcagaggttgcagtgagccgagattgtgccattgcactccagcctgggcaataagagtgaaactctgtctcaaaaaaaaaaaaaaaaaaaagacttgtatctgtcctaaaacagtttataatattttccaagagcattatgtcctccatgctgcagcatatgacaggatttccttgcttttaagtaagattctgttgtatgtatataccaattttcagagattttctatttcggatcctttggttttagggaaaacattggaaaagccaagtgaatggctcatggtcacatagccagtcagtgttaaaagctgagaatggagtgtgcccttcacttctcttgagtctgtgtctggtgtactttccattattttaattaagcagataagactggtacacaagaagagataagcaatgctctcatagagtgtatgatatgtgctggacgacggaggctgacagtgctggtgtagagtttctaagaaggagccatcatcccagctgggtaatctgggaagccttcctagagaagggaaggctttgagctgggcttgaaggatgaatggacttgggactaaaaggtgaggggagggccaagagcagaggcatggaaagcccaagacaggtggggcactgatcagtttgggtgtagcagaggggacagttaggaggaagagatggggacagacatttattgaggatctgtcttgtgttgggcacagtatctggtctttgcccatgccatctcagtagcctgagcatgggaatgccatcctggtcatgcacttgtttgaggacatcactttctccctaccccttgggacttatcttccttacagtaaaagtcaggtgtactttgatcctgccagaaattacctggtttaaaatggggagataaagcaaagagggaagggtgttttatggtgtctgtaaagaaggtctcagaggtagctatagtatttattttacagtaatctggagcctgcctcctacttacgaggcagctggcaggccttggcgctcctgagtgactgggctgtccatgaattattcaggggctgtgcccagcgagtggctgcctagcaaagtcctatggcagggaggctgtgctatctcagtgagagatcagcagaagctcaggtgctgaggaggaagaaatgactgcacccttaaaatatttcacattttaacacaccagggctgcacatgttgttccatatctctgcaactgggtaatcggtacctgtttttcaaagagcaagaaacacaccccacacccccaactatattacctacactctcatgttagaatggcacatgtcagcagggatttggttagaagcaacattaaaattgcatagataagaccgaataggaacagagagtgtttgtgtggaagaaatcctgctctgatattttctcagccaagtagagaaatgtagttgttgcttaatttagaatggtacttactgtaactatcaatagctgttactgtcactaacctgtcatttgttacatattacacccttgtgtttgtgtatgcatgtgtcctagtgtgtctgatttcctcagctaggttgaaagtccctgcagagaagaaatcagttctcaccatgtcatgggtccctccaatagcctatgcccatggatggggctgagaacgtgtcagatgagttgacttgggctctctgtaggggaggagtatgtcttgacgatgagatttgcatgtccctcacctttctcttttctcctaccctctccaagtgcctgccctacctgcccttttcacattttcttttcacagctcctggaaaaggtaatatgggtgtgaatatacttgagggcaggacccagaggcctattttcacaaagaatagatttgtatttattccttacccatttctttctcatgagctctgctacccagggaacagtatcttctcactgccccatatcactcttgtaaaactctggcctggatggctctgaacacctgtgtgtgtcagctgttcccctccatgttggaggtgaaaagcagaaccaagaactctgggcaagagcaggcctggcctcaactgcattcctcagatgttcttttccttttaaccactctacctgcaacagaggagcccagccctggctctggctgctgttacattcacaggcatagcaccacctgtttggcaaagccagggcctctggaccggggcattcttttgtctgtgcagggaagctttgcatgtgtagataacagacacggtaagaatgcagggataaggtttggctggggtagaagattcaataaactacattcattccccaggaccttgggtgcttgtttccagtgtaacttgccgtttttctcctcagcagtgatctcaggtgttttgtattcaggtctgatatgaccagttaggcaagaaacaggaaaaggatataaatggaaaccagctttgccctgttatttcagattcggctgtatacttagatggttttatgggtgtggggggaatggggggaaggtgtaaagagagggagaaagaaccatccatatctttcatggaacagagataataattcctatggatagaaaaatatcttttgtcctctctttttttttcttgttattttgagtcctgaactatcaaatctgacagccccacctcaaataaacattggcttttctaaaatataggacttctgtaacttgtttcatagtaagtattgtgttctggttatctctgaggtgtcactgctataaaatgtgattctgagtatgcctttcccagtgcataatgggctgagttaaagagaagggaagggaggggtatcagtacatcccagagggaggactggtcctgccactgagaaatgccctttgccaaaaatccagaggagtggtcacccttgttcccagcctaagttctgtgattccacatgaaacgcaacatcgtgcagctgatagcttccttggtgaagtaagagatggccaaaagtgggatagaattaatttttgaaatttctcctatgaggagataaagcctagcaattatagccacgaggactgtactataatagtatctttgtagacatgtatctcacttaatttataaattaattgagataatttataaattatctcaacctctgtgaggttggtcccattattatgccaactttttaggcacagagaaccaaggttaaaaattggcagagccagcttcttaggtcccaggtctgcttttttctttttttttttgagatggagtctcgctgtcacccaggctggagtgcagtggcgcgatctcagctcactgcaacctcaacctcccagattcaagcgattctcctgcctcagcctcctgagtagctgggattacaggcgcccaccaccacacctggctcatttttgtattttcaatagagactgggtttcaccatgttggtcaggctggtctccacctcctgacctcgtgatccacctgccttggcctcccaaagtgctgggattacaggcgtgagccaccacacctggccccaggtctgcttttaaccactttttctcctgtagcttcacatgtccaagccctgattcaaatgcttacatgggcggtactctgtaagttgagaagtggtctcacccatggttttctaagagtagtgtgagtcgtgaggggaggggaagtgctcctgactgcttctagctgcccaggccatgggccttgagtgggaggtgccactggggagaaaggagatgttctaaagaggtggcaggcaggtagcaatggcatagaaataccagtgtcaaatgtgctatgccagtagggcttttgaaaattgttcttttggggggaaaaggaggcttcatataatttcttctgtcttttcttttttgctggatttcattgtggtatgcttggttagttggttgagttttctggttagtggggaaatttccattgaaaaaggactaggtttttaacagaggcaggttttagggagaaaagaaggtggcaactagtagttagggagtgggaggctctttgggagttagtggaaagaaaagaatgatctcagttaaggattcaagagtgggagaggtgggcaagaggttcctaggaagggagtgggtgggccagagaggtaagacagaaagagaactagagagatgagatagaaacataatataaaccagtgcttagtgcagcataaatgcagtggcatggtttggagccgcttctctatctggccacgctaatggaagaggattattttagcattattttggtttcctgtaaagaaatgcttaggagaaattggctgtggtcatccaatgccaagggacttgacaccgatgaagaatgaaagacagatgtggagatggcagtagaaagcagcagagaatttgacaaaacacaatcctatatgaaactttgttttctgtccctccctgttcccatcacttctttcccagctctcggattggtttttcaaatcccaaggttgaatgtgtacaaatcccatcacattttgtcattttggacatcctctcccagacacactgagtcttgatagtgtctggatgttcaggaaatgaacatctaaagtttacccactcaagcttgctgtaatgcaggaaaagcattcatctttctttcccctcaagactgtgtaaagcctcttagaacaaacagaggcttaatcttaccttgccacatgctaagtcatacagaatcttagtgtacaggtccaccaagtatgagaagaggaacaaaaccaaacaagacctaataaaacccactcagaaccacagaacacttcaagcagcaagctctaggtgaactagcagagcatgtgcctaatcctgactcaaaactaaatgttgtagaggttcgtgtagaggcctgcttgggttttaggttaatcttgataccacttactgagttctgtgatttttcagaaaagcttagaaacccatagtaagctggatatactctgagcatatgggagaaacagcagaggtggggagatggggagcacgctgacttggtggatctggggtccatgtgttggttgtgccactcaccagctggggccctgggcaaggcactgtatttctgtgaacctcagctaccttggttgcaaaatggtgaccatacctgcctcacagggttagtcacttgagaaaatatatgtggaagcattctgtaagctaccaagtgtgatggttctggttattacggccattcagtttaagtggagattgatgataactgggactgcagttagaagtgggacctaagcagggtgaacccaaatcactaatacatttaatactaaacattccagaaggaattttttatgaccatagattccaaactgtttggtttatagacgaagattgagaggcccagagaacatcagaaacatgctcaagattacatagctccttggtactcagaaattagggtaagcctgagtccctgactctggacttgagtctttccaccagcccacagcacttttgatctgttccatccatatctttgagccatcttcccactggccttttcctacctatgccaacttagggctgaaacctgtgcacagaggacatactcagttgggccctgccttggaacatcttcccctgagtctgataaccctcattcactagtctcatcttcatagcttcttcttcgtcctcctcctcctcctttctcgttattttctaactccctgtaacccagcttttgcttttattaacccagttgacctgctaattggcacaccacatgccttttctctaagttttattttttagtttgtttgttttgcaacacttaagaccatctaccctctttcctctttgagtctctctccttagattttcattctgcaactccctggcatctccactggtttttcttctttctcccaaacccaggccttccccagggctccatgcttagccccttgcctcttacttcctttcctagatttaaccccacaactatctcaactcccacctctgcactcaggactgtatcttcagttttgagctctagttccacatccctgactgctccagacatgtcacccagtggtattgcaggtaactcagattccacctgtctagaaggaaatgtgcacttgtcccctgcacccctctagccagatgtaaaaccctgagagtcttctttgtccctttcctttgatcctcccacatacagttagttaccaaagtcctttggattaatttttacgtcagcccattctttttcatttgattgctcctttgacctggactgttgcactaaccacccagttgaccttgctgccttcatttcctctcctttctgcccattcttacataccacttccagattaatcatctctagagtccagcccacaccctctactcccctggctcaaaagtctccagtggctccagaccaggcttagttctaacttgcttttcggggctttcctcccagcctgacggttccttatcctccagccaaactgcagcacttgctggtgctgtttcctgggcatccatgcttttactgtgctgcttgagaggaggcttctcccttgttccagcctgttgatgtctacctgtgtttcaaggtttgatcaaaatgccagtccctcctagagttcttcccacctacctttctccaaaaggcagatgtgtcctccttgtcctctgaattcttagagctgtcctcccctggcccttactatattcttttggtactttactgtttgcacatttgtcccatttcctttggctagcaacactcctggtcacttctgaatcttctaaaacacctggcagtgtgccttgcacacattaaatactgtaaatacagaacagtaaacactgaagaaataaagaatgaatacctctggccttcctttacctcctccccacttctgaactggaggtggtcagatgggccatcagggatctgtcttattcttccctggtcccatcacaccaaatggattcccatttcttacttcttatccccgtggggttattaaacccttccccagtgtccaaacctttctaatacttgcatgtgttcactctgcctggttcattcagtgttggcttcacaggattgagtgtggctacgttcgtcccagctctactgccatcatattatgtgcaacctggttaattaaaaattatttcatgtactaacccatactagagggagctgaaagggagatactgagtggtgactccctttcttcattaagtggcccaatgattaaaacgttataagttggcaaagcactttgtaatctcattttcagtgccatagctggacacttagagacttatcatttcaccagtatacttagttgtgaaaaagggcttgttaaaaagatcttcattgagacggttcccaattcaacttctcttgtagtcttgatgtggtgtgtgtgtgtgtgtttgtgtgtgtgggcggggggtgatgaaaggaggggtgcattttgaagaatatactcttaattttgaaagtatgataatttttagaacatttccacatcatctcctcagtgaccctgtggaggtgggcattaattattactcagtctgacagctgaggtttagaaagaatccagggtttcttctaaggtcatagggtaattaagaggcttggccaggactagcaactcaggtcttgggaatcctagtcaagtgctttttccaagaccaagtgttttgtaatgctctgcctagcctcccatcagcattgtgaattggcagcacttaggggctttaaaaaatgttctacatcttagatgataagaaatgttgtcttcttcaggttgggcctggctttcaaaagccaaaggttgacatgtggaagtattaaaaacctagttatgtggctggaaggagttgggggttgttcagcgttgagcagttagctaggctctgggtttaattctaagcctggacaggatgcagttacttcaattacaagtgccctggggactgaggtgaacctggggtgggggaccacgtctttactacatattgggatccctgaggaatgaaattaccttcttcagtgagtattgctgtagggctccaaactggaaatgccaaaagtgtaatttgttgtctgcctgtttaggtagtgaggaaaaaggggggacaggagggtggagagagaggggggagatctagagtcaatttcccaagaatacattttgatcattctcttttctatgtggaagatttcatttttggttgagattggtgggagaagaagctgggaaggagagatttaaaattttggagaaccacaagtttagaggccttgttttacaaatcagagtaggaatttgagggtagtttcggttccctcatctcccctccggatcataaacaactccaggtcagggatctcggcggtgtttacctgtgtacctttttcccacaatgccttgcaaatcggtgctcccataaatcttccttgcgtcgaattcctatcataggcccgtgttattccaggaaaccaccgccttcatatcccctgatggcagcgtaagtcagccgagattcttcactgagcccgaacttacacctcccctggctgtggcgctgcacagcgccctgagagtgactttgtctgacttcttcccggtggctcgccgggccgccgccgcgtggttggcgccagcgcactggggcagtcgcgcgcgcccaggtgcgggccgcgttacctcagcagacgctagagagtgaatgagccgcgcgggcccgggacccttggggctcttcactctccaggccgtcccgtgggcgcgctagccttttcaagtgatagtaatcggagacttttccgttacatgaggctcaacaaaagattgtaattccagcagctctgtttgggaaggcactaccgcggcgagtccagggcccggccgggggtcggcggctgccgggcggctggggcgaccgcggaccgtgcgggaccggtagggggtcgcgggccggctaggctcccccgcgcccctcctcgtggtatagcctgcatttctaatacaatgctgttatgctaatcaggtgacatcaccgcccagcacacggcgagtggctcctgataaaattacaaaccggcggccgccgcgggcagctgggaggaggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaattagatgcctgtgtggtaactcctcgcggagctaaggtggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaaggtaagccccctcccaaaggccgggcctgtcctgggtgccaacgggggttcttggaggctttatttgtgaccctaatgaagacgggcggcttcacagctcggccccagaccctgtggttggctgcgggcaccccattcacgacttagggaaggcagttgctcatactccactccagaagagctaccatttggagtccctgtctctccagcacctttttggctttctaggttgtcagataactgctgcacacacattttctttacttttagctaactttacctcctagtagatcagtgctcatagacttattagtatgcaggtatttgattccgggtcgcctctggctcccagcccccagcctcttacctctgggaagctttaaaggtgtaaagtgccgtgctcagacccagtcctgtagaacaatagcaaaggggaggagggaggggtctttttgttcctaagcctttggtaaattacagttttttattcagaagcttaattttaatttttctgatgtgttgggaagagccttcccatctatttagtgggctatataatttctaatgaaagccggttattgtcatttcaaccctatgggttggattagttggatcaattacaggtttcttggagtctttttaaggctcagacaattgaatgagtccaatattttactgaacatatttttagggagagcagaagcctgtgtgtgcaccagtgtgctgttttccctgcggcccctgcacccctcagctgtccctgcccagccagcaggccctggccagcagtgtctcagagcttatacatgaaaaaaggttcctaactgaaaacagaactccttccgtttggaagcccctggagtcagtagtaggctgggaatggctctagcactgtaaaaaagtagtattcgaggactgtgtgtttcttattttaacctcctcagtgctgcaaatgtggttcctgtgaggaggaggaaggaaggaagccgctcagccctagaatgtttttcattgggaagaggggggaggatgtctttcattcattggtttatttgtcttgtgaaatagttgacagtaatgacacttctctggaaaacgaggcagaacaggacgtgattttaaacatttgctgggctgtgccacattcctctggcagttagctcagaggaagctcccttcgctctggggaacggttctgtgtctctttggttcatttctcttgagctcttcggcagtcaaatttgcttttttgaaaacttaagctgggggcgcttgcaagtagtaaatagaggagttggggtgggggggggcgttcattatctaggtttgttaggggcctcacggttttcgggtcggagaatccactgcgtgctcctcctcttcccctggcccggactcccagcttcattgtgtcatcccgcctgggggaaagcacccaccgggatcgtcagcccactccaccgccagcctagcctggaagtctcagaaaaaaagcaaaactgggagaaaatagaaggtgtgagggaggagtgcacccctaggcccacccataacaaaaggctgttattccgaaagggctgaggaaggttttaaaactgctcgccgagaagggtggagcctacacacaggaaatgtcttaactgtcctctctggacaacgtaaagtttaaatttaaaaaaaatcatgtgcccctgatattttacctcatacgctgtttctcaaggaaatcccttcgaaaggggtaagcttcgtgttttgtgtggtagctttaaaaataattttttttagtgtgacccttgtctcctaatttagccccagtgactttcttatttttaaatattgtggtttaggagttgcacaagtttagtgttggtatttctgtagcagaaaaccacccatgttgaggaattgagaaagggtgaattaactttcaagtatggtggacctcaggagaattacacacatttgtcagcatccttcagaacaaatgaaccgattgcattttaaacaatcctaggagaattttgattaaacacacacacacaaaacctttctttaattcccatccctggttttgtgttttgtttggtatttgtagttctgattatcacatatttttgataacatataatttctatctgctgatttaattttgtacattcctgcaagggtgcctttttttactcttctgagtataatctttcctagcacataatctctgaatattggcaaaatgctcctctgaaactgtattgggttttttgttttcgttttaagagacagagtctcacgctgttgcccaggctctagtgcagtggcacaatcacgactcaacagcagccttgaagtcctggctcaagccatcctcccacctcagcctcccaagtagctgggactataccatgtctggctaatttttaaattttttgtagagacagagtctcaccatgttgctcaggctggtgttgaactcctggcctcaaatgatcctcccgccttcacttcccaaagtgttgggatcacagatgtgagctaccttgccagtcctgtactgggtttaatgcctctgatatgaacttatttatgtattgtctgtgcctgatagtgctatgatttttctggagttgtttctgcattttggctggtttcaagttactttccacactgggtcctaaaaatttcaggaggtgtgccatagaatgagatttggagttctggctaaggagaatataattttaaaatgagtctggtctatttagataaaatggtttatagcgatttatagtttataaatttatagagatattataaatttatagtttaaatatagttatatataaatataaatcgagttatatatttatatataaatatagttatatatagtttaaaataaaaataaggatagtcataaatatatagtttatagagatttatggtttgtagagatttatagtttgtagagatttgtgggtcagtaaataagtgtgattaaaaaaaaaacctcattgagatacaagagtgatggctttatcacacgaagcctcctggcataagaagacaagcccttcaacctctgatggctgtagcattcaccaccaacacccaacacccaacacacacacacccaccccttcctctttttctttttcagattttcacctgcaaaattaagttatcactttcctcagaatcagttcatgtatcgtataaagttgtatttgatgtttttttctctgttaaataaaagaggaatgttgaaatacagcaaaacccaacctcccatatttagagaactgtgtagtaacagaggtgcaggttcatgataaccatctctccacttcacatcagccagcttaactcctcatgagagaacactcatcatgccactttccccctcagaaacagttgcttgtgccattgtgtaaatgaagttccagagtctagcttggccttcaaagattctccgtaaaatggccccactccacttacttcttattctaatatattccattcaaatctggtaggcaggcctacagctttttataaaacccatccctgggtttcacgcttatcttctacattttgcctcaaatgcctactcttccatttcatctatagaaatgcttacttttcttttctttttcttttttttttttgaggcaaggtctgcttctgttgctcaggctggagtgcagtggtgtgatgatcttggctcactgcaacctctgcctcccaggctcaagtgattctcccacctcagtctccccagtagctgggactacaggcacttgccaccaaaccctgctttgtgtgtgtgtgtgtgtgtgtgtgtgtgtgtgtgtgtgttttgtagagacagggtttcaccatgttgcccaaactggtcttgaactcatgagctcaagtgattggtctgcctcggcctcccaaaatgctgggatcacaggtgtgagccactgcacccggcctagaaatgcttaccatttttaaatactatgcctgcattccaattattccataaagtttcttctttcttgtcagggttactgggaaaaacgattttgttgagtgcttaccatgtaccagtcagagctttctatatggaattttgtctggtctttataacatacctgtgaagttttagaggtgataagatagaggcaaataactcatccaagttcacaggcattgttgagtttaggctgcacggtgttctgtaactttctcctttcagacttctagatgttcatatttatatatatattttcttttaaatgaaagaatgacagtgtgaaatgcccaccctaacctggttccctctcctgccaacctgcccctggagaactgattctattggctctggctgtgaagttgtaatgtagacaggatctagttaaaaagcatcaaaatgaagtttttctgtctgctttgcagccagatgctgacactccgcatctgatctttctggagaaggtgcattctctagctattctggctcagtgcgtttgcaccaggagaggtatgaagtgctctgtcttccttgggacatagagattaaagaatttcaggtcatgaaatgcattactaccaagtttattacgtattgagagttgtcttgttgaatttcttaattttttaaatttcttaactcttagaaagtgaagtgctgattttatacctctgaatcatgaagaaaatttattcttttttttttttttttttttttttttttgagacggggtctcaccctgtcgctcaggctggagtgcagtggcgcgatctcggctcactgcaacctctgccttccgggttcaagcgattctcctgcctcagtctcctgagtagctgggattacagccacctgccaccacgcccggctaatttttgcatttttagtagagatggggtttcgccatattggccaggctggtctcgaactcctgaccttgtgatctgcctgccttggcctccccaagtgctgaccacacccggcaagggtagctattctcgaactttttgtagataaagaaatagatcgttggattattatccatctgtatgaggctagctttccagaattcaggttttctgactccaaatttgatgctcttcccgtagtaccacaaagtgtgggttagatgtggatcatggcgcccaaataacttgaatacatactgctggcatggaagattaatgtgttaagggagctgcccagatttctggacatgggctgctctcggtttttgttgcattaagaatattgacagtcaagggaataccaactttttcttaaatctaatattttactaggaagaacattaaaaggattcttggaggctagttatatagaagaggaaggtgatagataactccttttgaggaaaagatagcacttttcttaggagagtcagcctaaaatctccctggctgctgagaaagctttctggatgatggttccatgtcatcacctctcctcactcctcattcttggaaaaaggggtctgcacagcctcactgctgcttcgtctgctttagtctcttttcatggcttcctaaagtgtccccatgcagttatcccagtctccccacagcagggccctgagaagagtgctccgtgcaaacatgtctgggattcatctttgctgggatttgactccagtcccagctgcagctgctgccacacctgtaccccacagaagttgtgattccttaaacctgccctgcattttggcacccttgacaccctgccctcttggtttcttctgcagggaatcatttcatgtgtcaggatcagtcttttgaggttcagttcagatgccacttattctaggcattccaggaggttggggaggtcaacatccctgcttggactcccttccttttaagatttgaagtttcagcgcttgatcattcacctgtgatttttcattactgccttttgttacagttccagtctttgtctttttgttttccctgtatttcgtgaagtctgggagcctgaagaccaaagtctgaatagtctgtcttacacatacaagccgctaaatatttgctaaagagcaaaattaatgaagtcagtgttatagactcccttattgctgtggttcccaaattgaggttctcaaaatgaggtccccaggtcagcatcagcatcatctgggaattggctagaaatgtaaaatctcagatctccacttctcacctactgaataagaaattctagggtgggtcctaccaataagtgtttccagctactctgccaggtggttctggtgcacactaaaatttgagaaatagtcccttattggatcatttgtacaatctttgcaaaattttgtggtggggatggagaagcagactctttaagttgctcccaaacaggagcaggtattatacctgatttcttatagaagaatgaagagttgggggaaaatatgttttttagaacaaaattgtgaaacagtgggaaaaacattagctactcaggaatggactctgtcctgcttaaattagagaagccgttgaacatctgtctcagccacctcttctgcctcagatgaccctcaggtggggtcagttacctgcctcagttctcccacagttggctcaagagccactatagaaagagatataagtttagaaaaaatagagataaacctaatagtgtgtgtaggctctaaggatagttcagcaaggcatcaaggttagtttcacttatattcttaataaataatctattgaatttaaccttaaaaaacaaaaatcccagcaacttggcatctgtaagggagacagatcaatatctaggctgctttccttatttgaataactgccaggtctgcttcacaagattgtgttgaccagcaaatgatatgatctatatgaagtttccctggaaacatccatgtactattaaaatgtgaaggatggctgttgtttccatgactgtattccttttaaagaaaacttctacatataaatgaacactgacaattccagtattgttgattactagtaaatatagtacagcaattcaagtaaggacttcagggtttgttttttcttttaaccttctggaaaataatgtggacagtgacagagcattaagtttttagttaatgatagctccacctcttgtgcacataatcaaaacagaccaggtggggtttagccacttgtagatcctagtgccttttctctcttgacaactttctatcaactctgaaacccagctatgaaaaacaaatgaaagggggaaataaaggataagggcattgtaagcatttttcttttttcttttttttttttttttttgttgagatggagtgtcactgtgtcgcccaggctggagtgcagtggcatgatctcagctcaccgcaacgtccgcctccgggttcaagcaattctcttgcctcagcctcccgagtagctgggattataggcgcccaccaccacgcccagctaatttgtgtattttctgtagagatggggtttcgccatgttggccaggctgatctccaactcctgacctcaggtgatccaccccccttggcctcccaaagtcctggaattataagcgtgagccactgcgcctggcccctgtaagcatgtttttcaaatgtttaatattctctgctgcattgacttaaaagtttgacaggccaagctcagtgtctcatgtctgtaataccagctctttgggaggtcgaggcaggcagatcacctgaggtcaggagttcgagaccagcctggtcaacgtggtgaaaccctgtctctaataaaaatacaaaaattacctgggcatggtggtacacgcctgtagtcccagctactcgggaggctgaggcatgagaattgcttgaacctgggaggcagaggttgcagtgagccaagattgcgccactgcactccagcctgggcgtcagagtgagactccatctcaaaaaaaaaaagtttgatgattgttaaatcattttgttggtgcagagaacctgccatttaaaatggcagttgttggcactaacttagactactttaaaagcaggaaggatcctaggaaataaaacactaaaataaaactttaaaaaatacagggcttgctcttttggtattctacttacttattaacaaatatttattgattacctgctttccagtgagcagctgtcgtctggttaaaaagtgcatgggtgtgtttcagctgtgctgggaatgctggctaagccaactgattaatagaagcaagtggagaaataaacttgatctaggtaagaggtgaggaactgaggtaggggaatctgtgcaggttcagggttactggaccttaaagtacagagtgaggatggggtggtaggaaggattctagaaggataataaaggatgcaaggccctgttaggtaaaggagtttggacgtaaggcagtgggaaggtactggaggatttttattttatttatttatttatttatttttggaaacagggtctctgtcacacaggctggagtgcagtggcacaatcttggctcactgcaaccctctacctcttgggctcaagccatccttccacctcagcctcccaagtagctgggactacaggcatgcaccacccaccatgcccagcaatactggaggattttaaataggagaggattttaaatctggatttttaatttaattttattatttttatttgtatatattcacggattgcaagtgcaatttgctacattcatgtattgcattgtggtgaagtcaaggccttgagtgtatctattactggagcaatgcacatgatacccaccaggcagcctctcatccacttcttaaatataaatatacctatttacatttatatataaatttcttaactctggtcactgaggcatgctttattctctctctatatatatagaaaggctagtctgactgctggtatgatgatcgttttggagggtgctggtcaaggaaggagacagaagaccagtgttttatttgctggagtgagaaacttagaaacgacataacctcctagaattttgaaagtgaaataggggacttagaaccttgttattcagtatagatagatgacttggggtttgttggaaatacagcatctcaggccgacctccccacagacctcctaagtcagaatctcgtcttttaaaaatccccaagtgctttgtatgcctgttcaagtttaagaagcactgctggcagtgcgtggtggctcacgccttaatcccagcactttgggaggctgaggcgggcggatcaccagaggtcgggagttcgagaccagcctggccaagatggtgaaactccgtctctactaaaaatacaaaaatcagccggttgtggtggcgcacatgtgtaatcccagctactctgggaggcagaagttgcagtgagtcgagattgcaccactgcattccagcctgggcaacagagtaagactctgtctcaaaaaaaaaaaaaaaaaaaaaaagaagaagaagcactgccttggaagtaatggtgtctgccttctaactcctatgaacagacaaggaaatagtttcattaaatggaggagtttttggtttttttgaataaactggattattttaactaaatataaaaataatcttgagtataatagttaattaaaggaagtttagtattgctctagaagattacagggctttaaaacatagttaactaattctgagctttagaagtaagtcttttatagaatttggctgggattttcctatttgctagtcctgcagttctagaaatttgtgaggtaaaaaaacagtttcttttcatatttacccattgatattaatggagaatcacaaaaataccctgggtcagtttctctaaattattccagaatttcagcatgatgtcctgggaagtagaaatttatgagtccatacctgttttatgacttaaaccttttaaatactttaaaactatttttttcagaaacaaagcacaaatactcttcttcagccacacttcatcttagtagaatgatcctatattaaatgaacgttcctgttcttgcagttggttagacttcagtctagtttcatgcacatcaaacttacctagtggtgccttcaggttttagcgctaatagtggatttgaagtatgtgaaatatctgttacatggtaagtgctcatttcctctgagtttgtaggtgaaactttaaaattactggttattgattgggtaggggagaaaaaacacctgctgaaacttgttggccggaagtttttacccctgggaagaagaaaggaacggggtgggggagataagggaattcagttcttggctggcaacactccagaaccgtcctgatggaagggttgtggccagttgaaagcagcagtactggagaggggactgggggttgttctttcaaaggcagggttgaaggttattaatggactaagttaaatttctagctgttccttcctgttactctagatactttttatatatttattatgtcacagcagtattgacgccctgaaaagaaagaaaagtgaaagaatagttcacgtaagatcccacaagtcctacaaattttaactttccaatagttaatatatataagcacacacatatacacacacgtgcagtttagaagtgttaatatagacgagttttgtcttggctttttattttttacttaacatcatcttaagcttttcatatgtggttatttctgtgcctcttaccaaatattggcaattcactttccaaatcagacaattacttaccagtctgagagcctgcttctcatctatgggatgaaggtcatacaaattctgtgtaatgagattgttgtaagaattaggtgagattctgtgtggaaactgtgtttggcacagtccctggtacataataagggctcataggattattacagatcctagttaaatggcaaggcagggcccagcagggtgagccttgtaaacttgagtgcctcaactcccacccccacccccaaacctgttctgggtgtggtttcctttagcatgttgggagagtgtttagtttgcctgaaaatgcacccaactgaaaccattcccccccccctttagaaagattagaaggttcagtcacttgggcctggtgacttttgatgtagtttgaaggtcacaatgctggttcctctctcaagttcataaaagcctctggagcagctattgctgcagccagcgagcatccagcacttggtcagagagccgcctttgtcagagagcgctcctgtagccagactcatattaactgccccccatgggtgtgttgaatgcctctactgtgtttgcctttgaaaggcccttcttagcctttctctctcccccaaccccattttcaagaggcacaagacctttaagtagcaaatacagtaatcacagtagcatggagacacaggctggcctatatttggtttcacaaaggccttgtgaaagatctggccttaaagtccctttttaatgctgaaattatgcaagtggaaagttaatttgaggatcactgaggcacgctttattcatgaagaatgtgagcaaaacataaatacaaagtctggaggctctgttctacgctggtggcaaggaaattacataggtggtatctttatttggctgaatccccctccctccaccaagagtgcaactgtgatagaattttggagtgagagctattgttttaagcactgactggttgcaggtgtgtgtgtgcatgttgcctgaaactctctacaaaccatagacatgattttggtggaattggcgtgccaacagtggttacagctaagattgtagaagaccaaacattctgttggaatgtgaccttaacattttgaattatgtttcttaagtaagataaatttcgaaggtctattttatttttatctttattctttgaaggcctgctttaaagtttaccgtgtctttgaaagtctagtctgttgaactcttaaatcccagtgagttcctatagattgctagcttgagtgtatagtatttgagatgtgaataaagtctagtgcaaagtgtgtttcttgtgcttgaaaatggtgccctgatttctgttgagggagacgtttattcctataaaggtttaaacgacttgctgtacaattcagtcttgcaatgacagagagattacacactatctgcaaacaactgccaagcagatgaaatcctggctgtgggaagtctgcggtgaagagtggtgggggtggtcaggagagcagtggaagggaagtggctcagaacattgtagtggtggtttggcgtgcctgtcaagggctgtgggacgttttctctctcatttcagaaacaagggtggtgggaaacacatgggccgtggatttgcataaaccaacagtcaaatcctagctctaccagtgacttcactgagcctcattttcttcagggggaaagaataaatagcccttggggtgattgtaaagcctaattaggtatgttataattgtattaagaggatgacgagttcaccgtttgccagggagttttccggttttagtgccaaacattccacatccggggaatcttcctcagtcccaggcacactgggtggtgagtcccccagttatatatgaagatacctattactgttccctaattgtatgtacacacacacacacacacacacacacacatacacacacacacacacacacacacatatctataaataaagggcttctggaagctggctgcctattactgtgtacctgatactcagtgggtatttgtgaactcccaggaggatagtgtgttagtgtgtttgcgtgtatctctgtattccttcttagggatggcatacaaataaatgtttcatgaataaagggatgaatgagtaggtaaagtaatataagcagtaatgcatatgttttaaagtgatttagctggttttccttccaggggcctcttccctgagaaaagagccacttaataaatgatgtcttgaatgaaagaatacatcatgaaaataattttgtccatgatgtggctaaactaaaactccaggaagggcttaggctgggcctatctactttttttgataaaatgaagtttaatatgaccctagtgacaacctcccctcatccccttaaagctcaaatttagggaactcttgtggttggactctcacatactccctaggactctgctgggtgctggggaatttactaaactttggtgaggagaagaggagaggagagggaagccacggtactaaggtacttagggagacagaaacagttcccctagaaattagacatcacattgtctttttcccccctttcttttgaatgagatggggcaagaatatttggaccaggataaagttttaagatgcatttacactaatgtaatcaggttacatagcaaaaaaatgttaaaaatgtaccctgggaaattgaaatctatccattcttctaggtgtggcagcttattcagatttttatgttgtgtgaccataaaacgaacacagcttttctaaccgcgagtgtctttgtttacagagataacagtgtgagtaatgctttgctagaagccaggcagttaaatcacactctgagcaaatagaggctgggcttcagaaacttagatagcacacgaatgtgcaaacttggtcttttaaactgaagacatatctgaaagaaaactgcttttggcccatgaactactttcccagccctttgtgcctcccaatctctgcccccctttacaaaaaatctttgtttttcctctacaaatatacatatatgatttcaatttggaggtgggatgttatttttttcacttgaaacacaaggaagcaatttttaaaagtcatactcgttcagcagtgggcttgactgtagccagtttgactaggagttcttggctacagaaccatacacttgcagtctttatcagggtagtaaattcagatgggtttttggaaagggagagggctggagttgagggaagggcactagagcagtgtgacccacggcccaggagcagtgtgagtgggaaggggctctagaagctgactgcctttgtgtttgccacagcgtgctgggaatcagatgagaaggcgggcccagaccccaccagatactcatctcagccattgttgtcattaaatgactctgaaatgacctttcttacctcagtttcctgtgagctcatagttgtctgcagatgtgaattatgtcattgatctttgctccctctttgcttataaggagtagctgttctgctccatgtttctggaagaggaaagtgatgcacaggtcacttagtaaagcggtccccagcctttttggcaccagggactggttttgtagaagacaatttttccacagatagggtggaggaaatggggagttggtttcgtgatgaaactcttccacctcagatcatcaggcattagattcttattaaggagtggtaacctagatcctttgcatgcacagttcatgatagggtttggctcctgtgagaatgctgctgctgatctgacaggaggcagagctcaggcagtaatgcttcccatccaccactcacctcctgctgtgtggccggttcctaataggtcacgggccaggaccaataccggtctgtgacctgggggttggggacccctgactcggtgattcagcagttgatttgggatcctctgtctttgttcctcctccctcagcgggaattcacagtgtaactcatttgctaaggttttctgcgttagaaacagaactccttttggactactaggagacatggtcattagaataattatgattcttagtatgactcaacccctttttaatattcagccttatggagggcctctgcctgcggctctttgctcaggcactagggccacaggggtgtaatttctatctctgccctcaggaagctcacaaacaagtcaagagacaggaaaacggatcctgtttttctaatgggatttgaatggatgtatttatgggaggggggtgctttgtacacctgcaaaacagaacaccagccctcccttctcctctggggttgctgtgagaatcagttagaataatgtgcatgaaccccgtatggaaaatacaaactcataattaaatctaagaaatttttgtggggggacacaaatgttggggttgtctttgttctcaggtcccctcaactggtctaatgaaggaaacagacacctttccagtaacaatagccaacatttattggacacttatgtaccagactgtgctatttatgacatacattatctaatttcacaatcagaagaatgctagagatagggtcaggcgttatctctgtttacagatgaggaaagcaaggcttggagagaatgccatacagttattagtgtggcggagccggcctttgcacctggctgttgaccacgccctagcattaaaccattacctcacactgcttctccgagatagttatcttcttgggatcatttaggtgtggcaggatctggagggagcagttggacccaagtctcctagcagcagcctacacgtttcttgagtctgttttgaaacaacttccttagccctagctgcgcagaaagcatcctcccctcagagtgatgatttttatcatgtggtttccttcctcctgcctttggaggtcaggtcttctcacccagggtcagaaagcccatcagttgctgataagctgcagcacttgagtcacagggtgcaggcctgtgtttagaatgggtcatgctcatgtcaggcacgtggggaatcagtgatcccatgagagctcgatcagtgcagtctggtttggaattgcaggtcacacccttccaccactttgctcatgtgtctactgatgcctgtgatgtagttagttaaaccactgacttctttctcctgcatcaaacatgactttttgaaaaagtgtgtgggggctttccagcatgaaccaggcataaaccaggtaccttcatgaacatattatttatcccttcagtcaccctgtgtgctaggtggtatcataactgctttgtggattgaggaacctgaggaccagaaagatgacttgaggtggcagcctcatttagccagcaagtaagaaaatgggtgatggtgaacttctgcagcaagagggggccgttttcaacatttctgtgaattcaaggcgtgtgcttcgtctaaataggtggagacacgtaggaaggcatagtgtatacatccatcagcacatgggtagattttgaggttttttttgttttgttttaaatccagagcgttgtgtatttgatcattcttggagattcagccacattcacaggtgttaagtgtcacacctaacctagcaatacaatacacagctgaaagaaaccagtcaggttttcccaatatcaatttctttttattttcttttctgcaactccagaggattcaataatgtcaatttctgataaagcttttgctattgatgagtaaattcttccattaaaaagataacagtctgctaatttgcttatcattgatgttgcaagagcgtaacattggagggatgagtaatgcatctgcatatctcgaaggacaaaactgacgtccacccacttgtggatacggtatttggtaaaagtaactaaggtaaaattgcctaagggcatttaacttgagccatagcttaaattcaggtgatattgagcgttgacatatcaggattcttttgtacacagagacgtggatgtagacccactggtagcaattgcaaaggctctggatttttagctgctggatgaaatacctgcagctgaacatctgttatgatgcaattaagcagtgactcagtggcgtgaaggctcagtttcgatgtatcgggaactcctttgaatctgtccacaaacttctcaaccaaaaggagaggagaaatgtgtacagacatttgagaggctgggtctcaacatgcctctgcctaggcagtcatgggaacctggtcttttctcctgagacaggaattaacctgtagtacgagaaacatggttggatgagtggttaaagcagggcccagactttggtacagtttaggttatggtagcagggatagggagagaggtggatgatggtaatggtctgtgtttttttccttttgtcactcagatccagctttttttttttttttttgagagacagtctggctgtgtctcccaggctggagtgcaatggtgcgatctcggctcactgcaacctctgcctcctgggttcaagcgtttctcctgcctcagcctccccagtagctgggattacgggtgcctgccaccactcccggctaatgtttgtattttagtagagacagggttttaccatgttggccaggctagtcttaaactcctaacctcaggtgatccacccacctcggcctcccaaagtgttgggattacaggtgtgagccaccgcgcccggccttcagctcttctttctgctattgctttggcctaattaataacttaaagctggaacgttgatgtcaggtatgtgtaggtccaggaaaacagctgttggctctgttacttcaattttttttttactctatactttgaagaagtagtactttctagaacttgtactcaaaactcaactgacaaatcctggaaggccgttgcttatacgctctagttgatgcgccacagctgcctggctgtgagaatggagtagcatgtacctcttaattagccaagaataagtgccgtggaagaaggcaggatgactttttagaacccatttttagcttgaagatcactgagggagccatcaaatccatccacctgttcaatcaatattcagccagcaagtgggtgtcaaggtgagcagcttacagtgctgagcacactggaaacacaggtgtgtaagggacagccacggtctcaaattacattctgaaagggaatactaggtaagtgatcccaaacatgcaaatatcattccttggtcctgggatgtgggggaagcattttggaggaattgacattgattgcaagtttttaaatatgacctggattagattatgagatgatgggtgcttgggggtaggggtgtacagagggagtcatgaaaccatggaggatgttggggaatggctagaattctacttgggacatcatgcaagttttttttccccttccatttcatttgttaatgcttattattagttgggggttttgcctcctttttgttagccaacagccagctaatcttggcacaggtcccgggaatcaggtgctgcttagcagctgatgttggttaaatgaccttggacaagtgacttgcatttcagttctctaacctgttagggttgtagattgtctgatacagatttgaaggcccctgcaaataaatgcatggccgtttactctggtcactttcattttaccgaatgtgctcccccaaggctcttctgggtagatgcccactgccaaaacattaagcatttttggcttctcatgctttgagctcacaaaatcagtcctgtgggaaacctaacaagctacaaaggagagggaaagcaaaagaaaaggtatatggattctcatgcaaagagagaaggaaagtaggtccctacctaaagtctagccctgtattggtggtggtactgataatggtaatagccaccaaaacttcttgatactccccttgtgcaggcattgtcctaagtactttgcagtattgattcatatgctcctcatagcgtccttgtgtgatgtgttatttccattttgaagatgaggaaactgaggcacaaaggaagctgtgcccaaggacacttaactagtaaatggagccaggattccaacccacgcagtgcgctttgggactcaatttttaaccatcttgctgtgctgcctgttgagcatttttcacctggtgcttttgtagatcccacattaggattttgttaggaccctgggcaaccttgatttagtgaaagcagttgttgagaggtagaaattcctgatccttttttcaatcttaaaggatttgctgagactctcactcttcattggtgatggtaacaaggagcagcatggtgaatgccatgtaaaattcaagccttgccttatcttggaggactttattcccttttctttgatggtactttggagattccagactataaaggactcagctgacagtacagactctcttgatctgtattttcccagtatatgaaattatttgtaatgtacccgtgagaacctggaataaactgtactggcactgaagtagaatcttggatttaaaagtacagtgttcactgctgcatcgttgagcatttgctacacagagaataaccttggagcaatgttcaaaggtgatggcattacccagaaacatggagttaggccaggaaaccacatctgaagttcagattattggagattgctgatttttcttgactttaaatattttcgactggttgagtgtttgttggtgtttttgggctaagtgttagccttttgttctgtgatgtccctgtgtgaataaaatggataatccctgtttccggttagctgctgctgctgctgctgctgccaagtataagtgaagacttccagctgcgatttgcattgtgttttcaggccaccttttgagtttccccatagcagatataaaaactgtttctaagagttcatccttacgtgttcagccttacttgtatcctaaaaccacaaacttgattttgttcccattcattatgatctatatttggcatcagtgaggcaagttatttatatttattatttataccctgcccacttccagaaatgatttaatttggcctaggcaagtgtcttctgatggggtgtgtgtgtgtgtgtgtgtgtgtgtgtgatgataattctgatgtgtgtgtgtatgatgctacttctgccacttcaagagtccagaatcataagattcctaataggattgttgggttggtgaatgctgggtttgttctcttctatgccctctctgtccaggagaaatctgagtatctttcttaggaatgcctaacactgctagactgaaaggtgccatgtcaccatttttcccaagaaattttcttttgagggtgctatagagaagccctctggtatgaatgtattaggctggtgcaaaagtaattgtggcttttgcaattaaaagtaatgacaaaactacaattacttctgcaccaacctaatatatattatatattcccattttgttcttttcagaataaagcttcctaggagtttctctagctcatgacctcttttacctttactttcagttgcagtgttcttagctcatagaaggagctttgacggcacatagaatgaagtataacagcttccgtttgacctgaggcatccctcaggtatgagaatgtcacccagagatcgaatacagtgccaggttatcaactaccattttttgggactgattctctgctcatgtgtgaccattatttggggaaatcatacagtaccacaaaccagaagtttctgaaaacacctaaactccccatctttcacactcacccatagggaccgtggcccccaatgaggggtagttcgtctctgtattggtagcattagcgcacgtgctatatagctctcttaatacctgaactgtggacagaccagatcctcactgagctgaagcacattggcatattaagggagcccagcattgctgtttggccctgcttttgaactgggaagatatattgctgcatggagttctgaaaagtacctttgtaagtcccgagaactcctgttgacctttggatttaggtaaaatgtaagtcttaggagaattgatgagaatgtaggaaccagttttagccaatgcattaagactaaaatgactctattgtttgtcaggctttgccagaaagtatagtgagagagagagatcctaaaactctgaaagcaaatagcccacagcagttaactgtattgactttggaaacaggttataaacccaaacctctgtgctgaacttgaatgggtgtttcttctctcctttctgagggtaaaagctgctggtgagaacggctctctggtgttgctaggacagacctgtatgaccttctttatgtaaataattaacaggggaatattttcatttacgttaaagccatatatgagagagatttccgggctggctctgacagcctctggccccactggagaaggaagccagcactgaaaaaattcaagcttccggccacacggaacctgagaatattctctatgacagcagtggctgtgaagctgtttctttaaagtaaaaccccttttgaaggttagtctggggtgactttactgttacatagggagtagattttgtttcttgatggttcgttgagtggtagagaggttaaaggtagaactaacatatgtagaactaaaaagcatctgaaacttttagcaaaccagtaatatttagaggcttctgcccactctgggtaggcatttttatcttgtatacccataccagcttttcacatcctgtttcttgagaatacataaagagcacatttctccacattatcaggaaaacaatttgaagcacaggtcttgtgaattgggaagaccactagtattgccattagctgcttatttgtgtgtgtgttggaggatggattataatccaagtgtattcatattctcacactttaaccaaaaaaaaaaaaaaatctccaaaatcttctctcttgcattgtttattgatagaatgggaaacttactgctggtaactagttaattctgaaagggttagggtttctactgtatacttccaaaagtacaggcctgggggagccaatatgagagacacacataaccaaaaatttgtaaaaactttattttttaataaaaattataaataaaaattataggccgggtgcactagctcatccctgtaattccagcattttgggaggctgaggcggactgatcacttgaggtcaggagtttgaaaccagcctgggcaacatgttgaaaccctgtctctactaaaaatacaaaaattagccatgcatagtggcacacacgtgtaatcccagctacttgggtggctgaggcacgagagtcgcttgagtccgggtggtggaggttgcagtgagccacgatcacgccactgcactccagcctgggcaaaagagcaagacttagtcttaaaaaaaaagaaaaaatatataaatatatacacacacactttatatatttttatatataatctcatacaacatgttttgaaatacacgtgcattgtggaatggctatattgaaagctaatacataacaaatttaatgataatacaagtgtagaatggacaacaaaggggttgtgcataatcatcaagtacttctcattagtaaaaacccttttcatttgcttagaattgaggaggaggggatgctctaaattgaggattctccatagggtcgtccgtgagacacaagatgttgactgtcccacttacccaggacatgggtatccttttgatgctgacagcatttgctgctgctttccagggaatcatggctgacattgaacttccactgcctctgggctgctttgctcactcctcctaggcaggcaagccgacccttgggaagctcagcatttagccttcatgctttggtttctttgccctttttttttttttttttttttttgaaacttttatttgctctgggaccactttgaggttgaaggtacagcccacagtttaagaaaactgtcccaaacctgagctaataaacaagagtaaaagcctttttctcttgtcattactacttcctcctcactgactaattagccagctgctgcaggtctcattaaacttcattaatcctaagcatctgtctgtaggaactgcctcaagataaaaagaggaagctccgctaaacatttttgttgctgctgctaattaccacaagctatgctttttattaattaatggctctacttgcctccaaatcctactgaagaactttgcgagacaacaggcacttcattcttctgtagctgcagacatgctgctctgtggtttggtgcatggggtacctgtaaattatcagcaccgagaatacgctagctctggaaaccaaggtagagaaaaaaatacatctggaagtctggttatgtgtaacttgaacttgctcaaagccttcagctgacactgatgctttttaaaaacatggcagtgataaattatttcatcactttgctcaaatacattaatgcaaaacattacaaaactagttttcttgactcagcttccagggtctaagaaagcattttattggggggttgtgatgccagagcataagggatgttaaaggtgacacttaaaaaggaaggtgtcgatcttggttctggtctggtggtgcctgagagcagggactccttgaaggtgcaagatgaattacactcctcccaggtgtcaggcaggggagagaagcaccctccatttagaaatatggaggattagccaggcatagtggcgggcgcctgtagtcccagctactctggaggctgaggcaggagaatggcgtgaatccaggaggcggagcttgcagtgagccgagatcatgccactgcactccagcctgggtgacagagcaagactccgtctcaaaaaaaaaaaaaaaaagaaatatggaggattctttctgatgagggcttctgcactgaattacgtaaaactcccatttcggaattatcaggaattaaggtggcaggataccttaagagatttaattcagtgtggtccatttaggttggggggaatcttactgagcattaaggcttgaaccccatttcatatcagttggagccaaaggtccttgctaatgtagaactctctgtagagtggtgggggctatcaagtcaaactgctgggactgtgcttgcttcgtgactgtgggcaaataactgaatttttctaggcttgaatttgctcttatacaaaatatgtttggtggtaagagtacctacttcacagagtagttgtgagaattgagttttaatgaagtgcttagaagagtacctggccctagtaaacactcagtaaaccctgactataggggtggacatggaagaagataatttaattcctccgtcatctaggaccatgctggagcccttcccacttgcgtagctgaagcactggtggatgaacccccatttgcctctgatcttattcctgccgctgcttggtgatgtcccctggactcagttgtcagctctgaagctttgaccccttgactcacctctggtcagttggtcccacagtgctttgcttgatcctctctgttgccatctgttcccatgcggtataattacctgttaataaggctggtgtcagtaaactgtaaactctttctgcttctgcgtctatccttatttcctactgcttagtagagcaatttaaaacctttttaagaatggatttgcatttcctgtagatgaaacctgaggtggaaccccagtaaatcaagggtatgaaatgggagcttttctgaccaaagtgtaggtgagaagatacctggaggctgaccctgggctttgctctttctgcatcccttgctaggaacatggtttgaaaactactcccctggcatcctgtagaccccagtgtttcttcagtgaatgtcactttttaaaaattaatatccttagtgtctccatctattacaaggaagtattaatgtttgtttgccgtattatgcttacaaatgttatataaagttaactaccaatttagtatgccccagaagaaagacatgaaaattcagggtggcattttattttagcatattcattgaaggcagcagtacacataggaccttttgtgatgccccagaagagtatgttttcctccagtgagtgctctttttattcctactcatcagtcccagacccatcgggtgaacctcaattctcttatcaaataaaaaatcatttcatattttcccctttaatgggaacgctctttaaatttttcaaaattaatatgtgctcctaaaaaaacaaaaacagaaaaccagcagtgtattcatagaaatacagaagtggaaatgcctcctgtctgcttctactcccttgagagaagacggttaatagtttggaagatatccttcgatatctttttatgcagttacttacatttaaacatatacattcgtaggatcatactgaatattatacactgttctataagggactcttgcattcagtaatattatatggccactttccgaagcctgtatgctgtaggttttccttactctttttaatgcatacatattattttataaggatgtcccgtattttaattattcaacctattaatgtatatttagtttctagtcttttctgttttgctgttgctattctttttgacaattattttttaaatctgtagtgcacattctgtacatcttcgttttcttgcacaaatatttctagaaaacaaatatctatagatgtgattagtagatggaggaaatacatactataaattttgatatcactacttaccttctcaccaaccacatgtgagtgtcctagtttctccacaccttcagtaggtgaaaggatttgtctttcaaatgttgtatagaatagggttatagtttattttcccctacttccacctagtcctgaaagtggatcctctgctatctgccaccccagcagaacatctataagtttccagcccttcccacccagatccaagattattatctttatggaggctgttgagaagcagccaaggtcattattaaacaataaaatgcccctgaagaacaaatcagcaagagcaagaagcttcctaggctatgtcaaggtagctgaacaataagactacacctaagacaatattggcttactgtctccctccttacacccaaactgacaaaactacaaacagccaggtccccacacctgttggaagcacctgactttttggagtgggagataaaggcttgcgtgtagggacaagggagaggtggggtgggaggcttgcaagtggatgcattcatggatgttataaagatctgtattccgttttatgggaagagatttacatttaagtttagcaacactgcaagaggtttacatttccaaaattaatagaacaacagaaaaatcagatctccccatttatgccctcttgttcaaaactttcctttttcatttgaagaaaattaaatttagacagatgaccagttttaagcttagaagattcaatatgaccaagaccatacattgtcttgtataaaagtgtgtttaaagctttggttagtgttcctataatgcaaaataggttttgatttaaagtaacaacacagaatactcttgtgttctatgaactgtcaactgccctgccctcttctgatgagtgtgagggatcttatggtgctaccctgcctgttggctagtcatcttggggttgaatctgaggtcattttttcctccagtttttctgtcctcctctattaaaacaaggcaatgtacattgggtacttacaggatttgtccaccaaaactctgtagtatttggctttgaaagaaatcttgtataaccattttatgtgtgaggttgaggaaagccacaaaggaaattagcagaagtgtttttcagtgtttgaccctatgtgtaataactttctcttttacatgttaagatatctttaaaataattgaatggtagctgagtatcaattgtctaatgctgtgagctctcatggagtcagaaattactccttacatttttaaagagagaactcttaatgcttttagatgtccttcccagtgtccttatattagttactcgataaatggttgctgtggactaatccaagatgaaaaaatgacaggcgacctttatggctgaatgttgggtattagtgttctgcctggaataatttttcaggcagtggaatagttggctgagttgaaaatataaccgtggattgggtcagcctatcattcaataaattacttcctgaatgaagaatactctgtgagaagtgaaattttgagttacacattgggatatgatatcacttagaaaatagtgctaaactttaaaattctttagtttcagaattttctaaatcagggaggggcttgtcagtataaaattatacattttgttttttgatcttgtcacagttgttcgtgacttctgaaatccaagtgtggtttggagacgactttaccccactcctccccaaacacacattggtagtccgtggcttacttgcgtagacaactgtgattgtggagtttggcactcgaattgagacagtcgtatttaatttatcaatctgtcgtttcaaccctgaacttttctacaatgggttatggtcactggccaaaaagggtttaggtgactcatgtgtaatgttcttcagaacagaagccaatttttaaatccttttgtatttatgttcatttatttttaaatataattcctcttctcattaagtggaatcttgtcataattctatagtttcaagtgataacttggcattgctgtggctttctttattccaaaatgctaatcctttgcagataaatttatacattctgtatagtctgatttggaggacttctgtatcttagcttatcttagatgggagcttccataattcattcagggattagtcagtgctatactgtgcatgcatagtagacagctctgtgtggtggctttaagtcttttgactccccctctttctggtctttgtgtctttctggtttaaaagaaaaaatatccctcagaccttagctttttggattcaatgaattactgttaactttgacatcctcattaaataggagagctgtcggaaactgtcaagaacggctggaattggtactgttatcttgttggcgacgtcagcttctgtgggcatctgtgcaaaaacattgaggtagagcagaatcctcttctatcttgaatgtctgaaaataatgtgactggtgtgtttgaaagagttctatttttccctctttgcccttaattattttggccttaaggattccggaaacctggagtagattgaaaaccataataagcaagggccggggagcatgttatttgattttttaataaactacctctgactagcttacacgccccgtagaacattaaggctactttttgtgtatattgcatgaaataagaaacatcacaaatttgaattctctctcaatacctctgctttatccaaggctcctacaacaaaagcctacctttagcccttgaaaatgaagtagaggattttatctttactggtgaatttgtgtgccacatggtagactagtatagaatgtaatatttactgcttctttaatgttccttaggaagaatatcacacagacatctcccttctccatatgttgcaattatactactttcatgaagtcttgagtgtgcctgttacggttggtgcgctttaaaacattcttttctacttagtctgtattcgtgttaacgttctgccattctgtgttaagttctgccgttctgtgttgtttagtaattaagtgtatggtatctatttagttctaagtttttcctaacttttaagggcattgcaagttaccctcagcccaccttggattgaagtccccttccatggaggactggaggagaagaggtgatggtgtatgaagtgtccatcaaaataagagctgaagagccttcagcttgtggggagggctggaaagttggaagatcaggcctcaagctgttccacccttctcatcctttgaaggtgagggtgcagccttgaggtctagcctgtggtgattaccatagtttgtccctcctgccaaatggggtggcacactccatcccgtaagtgaaggtaaccagataaatacccactccgctggggagtggaaggggccccgagttcaccctgtgactgacctgacatgtggatatcacttaccagaaaatgcttgtggctactgagcattaacctggcaacatattcaatagcaaaatttaaaatagtacccagtgtggtgccttgctcatagcaagcacttagtacctatttgctaagctgattttaatttgaagtggagtctaacaaatgggatgtgggatcaacagtattattatattgaaatgttttaaaccaggacatgccaaactttttctataaaggaccagataataactgttaggctttgtgggccacatggagtctctatggggtatcatcagcctcctccccttcctcttcctcctccttttaaccaccctcttaaaatgtaaaacctgtgtgtctcccaggctacataaaaagaggctactggctgaagtttgctgactcctattttatattaatcttttaactcagtctgaaggaactgaccagacatggatggttatgagttttttcttcttgttttggggaggtgatgtcttgttttcctcaggcagtgtgggatggtggttggaactaaatagataccatcccacactccctgtgtgggatggagtgcctcaggtgctttgggattctgtagggttcagataaatgtgggctctaattctgggtgtttatttgctagcagcatgccctcggggggatcccaaaaccagtctgtgcctcagccacctcagttagttagaaatcacaggctgtaatgaaggagggaaagtgagtgaagatcctaatgcagcatcactagtgcacacctgggcttacttcagcctttgccctaactgatcagtcaccctgactgcagttcccatcctgtagagatggagagtagcaggttaatgggctcaggatatgacttcctgtatgtgaaagcagtttggaagcatgctacccatttttagtcaaacacagtgaacagttactgagaattttatcacaaggtcctaattctgtttttttacatttgctttttccacctggttttggcaccttacactattggttttttttgttttgttttttaaaaaatatttttaacttttgtggatacatagtagatgtatatatttatggggtatgtgatgttttaatataggtatgtgatgcttaataatcacatcgtggagaatgggatatccatcccctcaagcatttatcttttgtgttacaaacaatccaattatactcttagttatctttaaatgtacaattaacttattattgattaattcacactggttcccaccttagctctcatcttagaagaggtagttgtgttgctttgcctcttattttcggagaaagcccccatcataacctcagctccctccagagtcttggcttcttatggattgtgactttatgcggctcaccttgacgtacgactgtgacagaggcaggaccctggtgacagagcctcatttctcagttattgtgggtctcctctcagaagttgtgcctgcagtgccttggtctccacattggcaaactggggttgtgccgctcagaagaaaggccctctggaagctgcaggagggactgcccagcagatgcaacctgtaggtgccaggtcatagagagctcatggtgggttttgtagtcggcccatcagacagttactagcagacaattgcatatttgcttcacatgcatttagagcaaatatttacatgtgttttgtccatgatgcaagttaaacagttaaggaaactattgtaactcaaattctatttttatacaaatcagcaaacatgaatttaaggccttcagactagtccgtcacagggaggacttcagtcaaaagattagtttccttcctgttgctgcctcaagataacagttggattctctgttatcaatacagccagctgcctgtttccggcttcctgctctgtgtattttgcatgttactcatgggaaatgatttatttattttttcaagctaaggcatatagggggactccaccctaccactattcttttgttttgagttaagatccttttttattctttattttaaaacagttcaagaattaaactttaatatataaattgttaaagttgcaacaaattaagtcttgtgacaattgacctgattgggtcatgtttaaataatgttgtaatatgttacaatgatgtcctaatcacaccgttgtgtattttgcaacttcactttaccgtacaggtatgtggtggcaattgcccaaagataaaacaagcaaacaaaaaacagaatttgtcaaacattttagtttggctctggacccattttagtctgaatgacagcaccacaaaattgcatttttatccgtatttcagacattgaggaattgcaagaagcagttcacctgtcatatatttttagtgctatacaatgacaacatttaactgcctagggcctgtctttgtgatatgaaatttccctcctcaacaatttcagtgagaccaccaccaacaataagatttatcgagaacctagttgttggacactggaggtttgctgactcattgaacaaatgtttattgtgcacctcctttatgtcatgtatatgctaaagctctaaacatgaataggattgagcctttgcctctgagccaactgcaagttaattgaagagataggacacaagacgtataataaaagatgagagaccacatcccatcaaatgatgattgctgacatctgataggagagggcctcttggtagaactaatcttggctggatcttaaaggaagggtaagagaaaactgccttctaggttagaagaatgatagaagcaaagatgggaaaaagcagtgtgcaaggtgagagttcagagcatgagagtaagacctgttaggttggaacaaaagacggcatgtcagggaagttcccagatgaagctgatgccttaggagagcccgtttgggacctttaaatgccaggttcagagatttggactgtcttctggatagctggggtccgttgaaggttttggtgcagtgctgcaactttgaaaaaccactgattgaggaacatggctatggtagtgatgtttaaggtggattagaatgcggagagaggcccaaggcaggggagttcagttggggtctgaaaccacccaaattgtggtgagctttgttcaaaacacgcaaaaatagattgtcaaaattattctcttagcaactgatcttgtacttctttgtaatgtctttttgttattttttaactttttattttgtatccccagctagatttctagttcattgagggtaagagactttatcttagacacagagttctaggtaaagtatgcactttgtaatattggagctcactaatactctcaatttcagattagtcagctaacacagtattattgatttaaatagtggggatatgttcatgggatgattgcttcctccccttttgatttcttcttaacttccatccctgtaattcctttctttcttactttgaacccaagactacacctaacttaactatatgtctgtgcaaagcaaaaactacatgattgctgtctcttacttagggggtaggccattatcttagcacaattgaagagcctgatagaaaatattactgggttatacgtgcaggttcagactacttgaaaagtaaaagaaagattccttctcttaagccaggtataaattcagtctttaggggaacaatgaatagggtcttttgacagttcctgattctatgtttccttttttttccatccggagatgttccatgccttcaggctttccttcattcctggctcccatccctttccataaccagaactgtggcatatggtgaatatagttgtgtttagcactctgtgctgagggtattgcagaaagatgccgtacaatcatttccatcatgcagtgcccttctgctcatcaaagctatttctgtatcctaacttgactcacgctaacacagtgttcattttttcagttatagcaaattctctagagtaaataaatatggggctgggtgcagtggcccacacctgtaattcactttgggaggctaaggtgggaggatcactggagaccaggagtttgaggtcagcctgggcaatctaatgagaccctatttctacaaaaaaaaatgaaaaagccaggtgtgatggtgcatgcctgtaatcctagttactctggaggttgaggtgggaagattgcttcagcccaggagtccaaaattacagtgagctgtgatcacaccactacactctagctggggtgacagactccttctctaatatattcattggttaattaatttaaaaatataaattaaaaaattacatagacgcattacagcctttcagtatttatcacagtcattccctaaaaagaaaagaagtagatgttatgcttctagaagaggatgatggtggagaggatattcacagcccttttttttaaccattaagcaaatgtgtttctcagttctaaatatttcatacttttttttttcttttttctttttttttatctgagacagagttttgctcctgttgcccaggctggagtgcaaaggcaccaccttggctcaccgcaacctctgcctcccgggttcaaacgattctcctgcctcagcctcccgagtagctgggattacagacatgcgccaccacgcctggctaattttgtgtttttagtagagatgggggtttctccatgttagtcagactggtctcaaactacttctgacctcaggtattccacctgccttggcctcccaaagtgctgggaattacaggtgtgagccaacgcgcccagctacctcatcctttttttctaatacatcttctaagaatttcaagttgtttatcagaaaccaaacaacaaaagatagtgaatctcagtatatgacaggagaaggtgtagctatgcatcttaatccctcttgcctggctggagtgggagagaaagagccgaggacctcaccactactggctggtgacacttagcagcccttaacctcactgagccttgggctttgctagagataactctagcatcccacctacctaatagtttgctgtgaagatctagtgagcttagagaaagtatgaagtgccattcagatgcatggcaatgttattgcagacacaccatcttataaaattccatctggaggaaggagcaccatactaggatttcccttataatttactccttctgggaatcagaatctgatgtaaatgccactcacttgagggtgggtttcttgtctcagtagttctcattgacagtagttagctaatttacttatctctgagcctgtggaactaaaggctgagctggttgggtcttcacactcagaaccatttctggttcctaggttctcggggctccaaggtcattttggtagaatttgtggtcctgagaagcttattttgagaccattgttaggagcccttctttctgtctcccacccctgtcatgtcacagagacagcctcaccacgttcctcccacggagggctgctggttctttttgtccttttttcactttgttttccactttcctccctggactgccagagctgcagctgcctcgagtcctgggttgtgttggtaggtaagtgatgtccaggctgcctagaggtggggtcctcaggtgtgatcttggatcccacttgtaccacattgtacagcattgcaaagaggggatggtgagaagtgtttgaacctgagggcctttacatggagaagtgaggagacctattctgcatactctgaaggtggtgcaagccatagtgggccacagagacaggtctagtcttgatggagacaccatcccaacagatggagagttacccaataatgcagcagaccctttacaaaataaggacttgcgttagttaggatggtgagatggtgggtaattctaagtcttgtatcatggaaacactttttttttttttttttttttttttttgagacagagtcttaacgctgtcgcccaggctggagtgcggtggcatgatcttggctcactgcaacctccgcctcccaggttcaagtagttctcctgcctcagcctcctgagtagctgggttacaggtgcgtgccaccatgcccggctaatttttgtatttttagtagagacggggtttcaccatgttggtcaggctggtcttgaactcctgacctcatgatccgcccacctcggcctcccaaagctgggattataggtgtgagccactgtgtctggcagaaacacttttttaaatgttgtgcgtgaggcattattgcatagtggatgagaaccagggctctggagccagcctgcctggagagttgctggctcctgcctcatggggcagttgtggggattgattataagtgcagttagccctctgtatctgcaggttcctcatttgtggattcagctgacaacagaacgaaaatatttgaaaaaaaaattaacaatacaatagaatacaaataagatgcaatatagcagctgtttacacaatatttacattgtattagttatgaataatctagagatgatctaaagtatacaggaagatgtatgttggttataggcaaatactatataccatgctatataagggacttgagcataaggagtttggtttctgagggaggtcctggaacaaattccccgtagatactgggattagatacggaaggacgactgtgcctgggacatagtaagtgctcagtgaatgctataattatattttaataaaaaagaaaaaaagtcattttctttccatacaactattaaacaaccttctgccacacacacataatttcctcatattctgggatttttaaatagctggcccaggtgttgaagaagggattttttgaaagagaagtgatttacataacttctaaatcttgttcagtcctgagattttacgattccatgaccctctggtaagtttcttttttttttttttttttgagacagagtttcgctcttgttgccaaggctggagtgcaatggcacaatctcggctcactgcaacctttttctcctgggttcaagtgattctcctgcctcagcctcacaagtagctgggattagaggcatgtgccaccacacctggctaattttgtatttttagtagagacagagtttcaccatgttggtcaggctggtctcaaactcctgacctcaggagatccacctctcagcctcccaaagtgctgggattacaggcatgagccactgcacctggccaatttcttaaatgatttgaattagtgagactatttctttgctggagaaaagacggaactaatttagagcagttacaacactctgggcactttgatgtgcactttacctcctcttgtttggtgctgggcagtctttagatgagtccttataatacgtaagcttagtaaactgcgggagggtgggggcaaatatagctgagagatacccccagagggcaggggcacagaagtgcttgttccttggaggcaccacttaccaagtttggggcagggctggttgggaacctactgaaaggtttagctgcgtcagcttcttggggaggacttgataacagcgatacaaggcccagaaaaggtaaacggagaatggaaatggtgtgaggcacagaagtgcccacctcacatcgcccagacccagcccgccccagctccatgctgctggtgctgctgctcctctgccttgcaaagggcgtgcccttggtggcgtgagtgggcctgaaggccggccatttctgctgccttcgagctgacctgcaggtcatcaaagagaatgatgaaagaatagcaacccaccttggaggggtgctctctggggagtgtcttccaagatttctcaacctagcaccgctgatattttgggccagataattgtttgttatgggagccatcctgtgtaccgcaggatgttaagcagcatcctgggcctctaccctctaaatgccagtagcatctacccatgaatcgtgaccatcaacactgtatgtagacattgccaaactgctaaatgtgccgaggaatcaaaattgcccctgctggagaaccttgggtctaaataaccaaaccagtatggagcttgtaagtgctacctttttgtacctttttgtaccttttgtaccgtggttgtaagaagcaaccacggttgcttcatgctcataggcctggaagtcggctcactgccctctgctgccccaacacctcctcacgcagctagccccagtcacagcagcttgagcttggaagcactcctggattgcctttcatcgtcagtgccaagggcctcctgctcctcctcagactgtctggcccatatccccaagccttgctgggtggggagtgcaggggtgatgtcattgtgccttcccaggataggtggaacaaaggagggagtccccaaggacccgaagcctgatcctctactgagccaccaaatagatttcttttcccctctgtctccctccttccaacttcataagcatttgctgttctccaagtgctccattgtaagaggacacgctagttgactggggctttgtgtgtctctgttgagtccgtttcctgcccctcgtgtgttatgagggtgttgattctggtctggtccccggatggaatcttctgtgtcttttccaacgtgggggtgtgaacctgaggaacttagaccctgcgtgatttttccagcactcttgcacttcgtggggcctgctcctgactgtgaggagagttcgaagggaggggaacaggaagagagggcaggaacacaagagcttgtttttttatttttgacatctcttcctcctcttctttcctcccacctactttgagtttctaagaaccatgatagccctggggagccctcccggcacagatctcagtctgtttcagctctgttctctgcacccacccatgacctctccatttgcctctctgtagggaggagggttgggattgggctgtaactctttaggacagggcactaaggaagtatattgactgttgtttctggcaaatcctcagagtttccttgtgaaagaacctgttaattcaaaacctgaaagaagtctgggtgctcctttagtgagagattcacccaaaagagtgacaattggctgaggaacacattttgtgcttgtttatttagaaatattttaatccaagcaggttttcattttgatcttgctcccttgcttcattaaagacattttctgactccagtataacgcataaaggattttataattcacaaaaaaaattgttaaccctaaatacatataaactatgagttacttgcctccttgataagaggccatctgtgaaatgcaccttacatattctgctctagacctgctctttcagaatggccaagcttagccccagaattacagctcctgagtcactgtagtaaagttgccatccatcacaatgattacgtgatcaataatgcatgtggtcttttctgtgggacctgtcatgatgttattggtgcagctgcttctccactgcagcctgccccttactgtctttttctgcttcctctaatcctgtcctttttgatcctgtgtttctggttggcctttgtccctggggaagggccctccttctgtctggatgggtaggtcctttttgggaaaggcaggacctcaaggagccgctgactgtagcaggtggccggggatcttggcaggtgccccagctgattctcctgccaggtcggcagctgtaaaacctcaaccaatgtcatctctgcctcattccctccctgtggtgggtggtggagtgagtttagcaaagccttcagacagaccttcccagggtgttgggctgtttgctgtccttctggccaacctgagaacccagtactctcaggcgactgggcacatgccttattagcaagggtggctttttagttgttacccccacccagtggttttgaaatacatgccaaattgttgagctatctgctttttttttttttttttttttttgtagattcgtgtgtaattatttttgtcatttgggtttgcactaggagtaggtcttagatttttggcataaattcatgctggtggaactagatatagtgtatgtaacatagagaacagagtcagggagtaagagtggttgggtccagggtacgttctgtggatgtctgttgaaggtcttcagcaacctatgtttagaacattctgcagaggcaagaagtttgaaagcctatttgtatggtatgtgaaggccagttctgggcaaatatgtctagagttttataccttaaattggacagaatttgattactgagctttgaaaaacctttaacactgtttcctggatgacttgaatgtacaacaatcacgctttagaccataaatcagcagttgccttttcagcgaaggatcacagtatggagattatatttttcttctccttttatagaagagaacattgaatcctgtgttgagtcacatttttgttgaaaccttgggcccagaccctgctttcccgatgcctgcaaagacttcccgatgcctgcgatgtctttgcactctaccatgttgcttgccattttcttttgttgttcatggtgtgtgtgactgagcaggtgaagacggtcattgccaaggtcatgagttaatttatcttgtccagtgttgcccaatcctttgtagatgagggaagcagttttctgctgtctcatgagatttcctaccctacaccctttaatatactcaccttttggaggaataatagctgtaacatgtatgtaggaagctttaccagtcaagtattatggtatagggcaggactgcaaaggaccctgttgtcatctgcatcctgctgcctcttcagcagggatgggagaaaagaaaggggagcaaaggatgttctgctggcagtgtgcctgggagctcacatgtttaaggactggacagttcctacacagatgctccttgacttatgagattatatcccagtaaacccatcgtaaagtcaaaaaattgtaagttgaaccatcagtaatcagtgttctttctcaaagacatgaccgcagttaaggggcgctaagtagaggtgtccttggaggtcagttttgctgaccttcctctggctggggtcttgtggccctgctagcatgtgcctgctcctgccagttctgtggtcaatggtaaaacaagttcttctctgcttgcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctggtgagtggagaccttaggaagtgccgtgtgttgtaggtggaaaatatttttgaaaaatcaagtgtgacttgtctcctgttgaattctgcacttaatggttgatagttttgaggagaatcttgagaagtgagttgagcgcttcagggagagccttagtgtcacattctgagcgtggatgatgttcttgagctgtaataaagccactttgttctggtaatttgcaaggttgccacctttggtcagaaagaacttggctggggttcctgccaagaacagggcatggtgctggaatttgaagggccaggcttgggcgctggcttctagatgaacctgtgtcccacatgcgatgatggaatgttttctaaatttgtgtctttctggttgtctagaaaatctgagctgccatcttaaggtggcaagcattgaattcagtggccactgatgttttcttccctgcacgctttttattttgggagtggagggagaagctggtgttttgtcatctccttgggaaaggagcttctgatgaattcaccctgccttttcaggcaggaaagttgtcagcctgcaatgaaaattgtatccccaatctgtttcccagagctgctgcggccctctctgatgtgactcttgtttatgcaccttataccaaagaagcttaaagcagtcactgtgactgatccaacaggttttgtctcaccttggtttgaaaatggttgctgtatcctcccagagcacatgtagtgccataggtggaagtggtgccgagccagaagccaacgcccagaatggagaccacatctgtactgacatcaccaggaaaatatgatgctggcagttggcagggctgccagaaagccttatttttaacttgatctccaccctgtagcttgccagccgcagtaggcctgtgtgcagacctgccccacacctctgaccgcaggcaagggtctaaggttgtcccttgtcctatttgttatcagctcagagacagactgcctctttgagtctgggttgaaatggagccagaaaagtattctcttccctgcccttcagttcaagaacagggctctccagaagatagtgaagccctgtcttctctgtagtgagtttcatccatgccctttgttcctgagcatgtaggtcttgtggcctcattttctgtgagggtttgtcggtcacactagacaaactagacaaataacggagacccctgctcaaaaccatgatggctataagaaggcagttgatttgtggtctgggggtgagggagtggacccacatggggagtttgaacaggccatttattgcattttgatttgattttccaaagtgagtcttgtttgagagcctagactagaattattgtgatatgcagctttaagtataatttttataaccagacttcctttgtctacctctcaacctttttttgtttcttagtgtttaacctagtatgtttatttattgattttttttttttttttgtggagtgggggaatggtgttttgaaagtagctaaaaaaaatcattaaaggtcacatggataggagttagtctgaacatttatttttgtggttttttttttttaatttatttttgttccaatagggtccaatcttctaggctgtagggagtaaactgttcacctttaaagacccataattattttataccaagaagattgtgtccttgataatgtccacatcataaatgggatcaggcccattgccgttttttctgaacagggcaagaaaaatataagtagggagaaaaaccagtaaagcataattcttagatgtgtgtgagtatctcccactcctctccttatttgttagcagtaagtttttttgtggcaacccagagacctaggagagtaaggatgaagaagatggtacagtggctaccatctccaacctcttaggcagtcgatatcagtagttttacagaactttgtaaagcccctagtgccttcatttgtattacccattcttcacagccatcttggattatataggttggccagtctaattttcttattccaaaaataaagataccatagatagagtgctcttaaagctcttgttcatctgggctggagattttaagtctctttggcctcgtagtctgtttggttcatggaacttcctggaaaggaaacacaccacacactgcctttggccgtggaggttgccaggacctcaagttaaagatcctccctgcagaagacctccatgagagcttgccccaaaggttccttgcatattcagattccagaactaatgaggtggttagagcttccaggcctgggtaaatgaatgtcccagctaagtgtgtcatcagataacattagctgggctttctgcaccagtggtccaaaaccctgggtaacataaatgtttgcactctatctggagcccagtctttgtcagccagcattttagccccagcacttaaccaccagcttggcaatagctagcagataaatgtttgagggactaggtgattcaatttacttaattaatagattcttagagccacttcctttacagaggaggaaatctgtgaatgtgtgcatgtgtgttttctgagtaaagttcaaagaaacattaatgacccagacaattccaccctcaccccaccctggattttggctcaataatatttgagttaaatatgagcaagtatcatgtaggcatttgggaacttgattttgaactactcagcaacatcacaaggcagagatctctggtcctggcctggttatgatctgtgtccagaagtgtctgctccctctcggtctcaggtgtatcagctcatagagcagtgagaaggctgagagctgggccaggaagcttctgctagtcaggattagattgattagaaataaaactattcttttctcatttcttattctgagttcactatagtctataactctccataaaggtctcacttgaaaaatgccttagaaatacagacccaccctttactttaacattggattggcagataaaagtgtgagcacagaacctgtgctggccacttagtaattagacctagatctcaggaccagagtagaatgaggcttgaggggtgatggtttgccctgcagcagcgttgacatgtggagagagaggagcccctggcatacgataggcctgcacttcaatggtaatgttctgcccacagctcataatccactttagatgctccccattgcctgccatctcccttcatgggcgtctgcagtgaagattgattctcactatggtggccagttttttgccttgctcctggccagactaagccctcgcctctgaccgagatagagtgaggttttccaaacaactctgccctcccccaaaccccaccaagtcagttatcactggtttttgcttccctgttgtttcctgatctgtattctgtcttcttactccatcagtcattctctgagaaagcaacagaaaagagtgtgtgtgtgcgtgcatgtgtgtgtgtttgtgtatgttgccaccattaatttcaaagcaggctgagctaggtggagaagatagatttaacatgagatttgttaagcctcaaatcccacgttgaactgctctgagttttttcataaagcctttgtttaagagaaccatactggtacatattgtttattgaaatagtgtttgtggactggccatggaacctcgttggggtttcttaaaaacgtcatttgtatgggagaatttacttttgttttaaacaaccagccacagaactcctacattaaatgtgggtctaatcacacaaacttgagaagtgaactaagagtcctaagtgccacatgataaagtgccagatgaatggccccagagccctagagttcagaaggggagatgagccctctggacaggatgtcaagaaaccttagtaggagggtagggtgtgggtagggttccagctgggtccaggagaagagcttcacaggccgggcagccagagtgtgaaagctcatagtttggactaagtgaagagagcatttggaggtagcaggcatcaggaactggcgcagggcaagtttcccagccaaactggaggggttttttttgaaaggagtggtgatggtaacttccctatcacttgtgtttacagagtactctcctactcttttctcattcagttcttacagtctaatgaagtgggcaacctctgctttacagaaaacagttaccagtgacttgccaaggccagtgctgctagtaggcgatatggtgtggactgcagcccaccctgctgactcttcagcgcctcctttcccatggagcccttaggagtgggtcccagctgggaacaagacaggcaggaagtcatgggacacagtgtggtattccccgattaattgtaattgggccaaaataactaatactcctctgaaagctcaaagtttcatgtgttgggaggagtttggggactagtgtgaagtgagtttggctttgtagcatattagaagaaattttggaattagtgcttcccatcctaccctatgtattccgtagaggcctttgtttgtgaatgtgtatagcaaaaatctatgtttaattaaaagaaaaaaacataagcaagtgcctgtcacactgatttgctgagatcagtgtcttctgtatttcctcttcacctgaacaagagattggcagacactgtagacttcagctttggtgctagtgagtcctctgtcctgcaacaccctgtagattgttatcatacagctgtaagtgacttcagtgaccaccaagttaaatcccctcacttggtagatatggtaagtcagggaaaataagtgaccagcaaggccacccagctgggttatggcagatctaggcctcattggcctctctcagtgcccggggctgtgctctgcccagcaccacaacccttgatagttgtcactccaggtagctgcagggtttctttggacacgtatagagaaagaaggggcagggagtacagggtggaacagggcatcgcagcaccccagagacctcccaaaacaccctgccagaaaccttcccttatatcttcctctcctataaaaaaaagaggccaaattagctctcagaagctttttttttctttctttctttcttttcctctccatctctggagtgacaaaacctttgcggttgtaattactccatagttctgcaaatcctgatgccttgcagagtgtaaatgacccaaactcaaggctgggcaggcaggtgggacagagccagtgccccaggagggatcacccagccccctccttcctctctaagggtttttggtccatgcgaaggaattgcccaaggccatactgcttcttaggcagggcctggactggactctaataagcaattagaattatgttgtcagatcctagagatgtttatgtagccccttaagtttcctctcctgttttagagcgagaaagaagatgggcctgggatggagatatggctggtaaaggtttaggactagacgggaccttgggagggggaaacagaaaaagtgcctgtgaaaaaaacacaggaatccacggactgtagtgtgaggggaagggaagcttcttaaaatgatttaaaggaggatcagtaaaaataggcatttcctcagaggaactgctctctgcctgcagagccccgatagtcacaggagtctggtatcgacccttggccccacgttaagggcgtttcagactttcctgtcagaagtgacacagaagtgcacatgttgctgtggggacggaagcatgccgcactagggaatccgatggccaataatggaggcaagacagaggacgcttctttcctttgcagaattagctgctcttggggcaggcttcagaaagtgtttactgctgagaggcgccccctccctctgctccattgtgtttaattctctattgttacctcttcttccttttgagaagatgaagtttggcaatataaaaatagctctttaaaaaaatgaaaaccagccaccagatgggaaccgagtccctcacttcctttcacatggaagcatgtacccctcttccctgtattctgggtttttcctgtactgtaaagaggacgagctttaagtcctggttcaccacatcctaactagctggtagattgcttcatctctctgagccactgtgtcttcatgtataaaatgacaggaatagtaattattataatgcagggttactgtgaggattagatgtgatcacagttgtcaaccacctagcagggagaggtgaacacacagtagttgctcagtaagtggcagctatgaatttttagatcttgggaactttgaagtttgtatgaccaacatgtttctatggatagctctgtgagatcatgatcacctcttgaaattaatttcttgtaattactgcttcctaaacttgcccaggtattgtgctttaaaacatgtgagaagcctactctgaagcagatagaacacacgttgtgggagtgtgtggtgtacttgagttttagtctcaattcccactcctctcgtatagtaccaccaggaggtcatctcaccttgctgtatcttgtttattcttgttattctgtggcttgctggtttttgagttgcatccaggtctggaatgaaccatcccttagttcatctggcacagccagtcgccatcagcatggggtccctgtgatgtggcattgaacttcttcaacctgcgtgaatgtgtttgggccccatcaccaccctccccctcccacaccctggaccccatgttcatgtggaagcacacacacattccattgagatttgtagagagagaatagagttgtggaatgtctcatacatgtttcctgtttgtggggaggagattctgagaggaccactttttctaccgcattcatttgaatgtaagtcagacaagtgattatttgagatcaagctttcaggataaagtctgaaagaacattggttatgtcctgctggttggagcctgggaaggtaccgacagtccccatctattcattattctcttccttaacttctcataataccatccacactgtcgcctccaccctcttggagggagacttatgagaatggctgctgcagttagaagtttctgtcccccttgatctgcagttcccatcatgaagacactttgtttgtgatggaaacagcacatgtagctggaccactcactatctcactgctcaggtgcacgaactgacaagaaatgagaagaaaaggcccctgaacagcaaaaatgtcagaagcccctgcacctttcttagaggcagttaatccccatccctcaaatttgaacagttttgaaccaggagcttcgttcaatccagaaaccacctggatgtgagaagaaaaggggctgctgtgaatagtcacgtttcagcatgagaaatgatagctgatccaggagacaaaaggaaaaacttaaagagcacacatgagagccatatgcagttctgtgactgctggcggggagagctgctccacccacctcttctagggcggcaccgattacacaggcatccctttctcggataggagcgtaatggtgtctgggccagctttaggaggctgacgggtgtaccgtggagagagagcaccagtgttacctcaaacagcacttgcagaatcagagttacagaattttagattaagcccacccgtattttatatctattttttcctacctcgttagattgcttgattttgatgcaacctggcattgcacaaatagcaaattctagcatttcccacataaccgaattaaaatcattttgaagtttctaaaggcaaaatccacctctttctttttttggggtaaggaggatatcacattaatgtgaaaagcttaatgtttaaagacatttctttttccattgctattatggtctggttctgcatctgcagatttaactgactgcaggtagaaaatattcaaggggaagaacaatgaaaaataacaatacagaaataaacagtgatacaattttttaaaaatacagtataacaactatttacataccatttatattgtattagttacaaataatatagccatgatttaaaatatatgggaggccggggggctggctcacgcctgtaatcccagcactttgggaggccaaggtggatggatcatttgagatcaggagttcaagaccagcttggccaacatggtgaaacgccatctctactaaaaatacaaaaattagccaggcgtggtgactggtgcctataaccccgctacttgggaggctgaggcaggagaatctcttgaacccaggaggcagagattgcggtgagatcgtgccattgcactccagcctgggcgacagagcgagactctgtctcaaaaaaaaaattaataaattaatttttaaagtagatgggaggatgtgcataggttatatcaaatactgtgccgttttatataagcgacttgagcatttatggattttggtatcattgggggtcctggaatcaatcccctgtggataccaagggacaaatatatttgaaaataaaatttttctacttgtggtaggcctctgcacataatcttatttcctcaaggtcaaccacattcttctgtttttacttgtccttttttataggagaaaagaaagtgaaaaataataatctgagactggacagacttaaaatggccgcttgttacccaagtaaccttcctttcagacgttttccgtacagcacatagctgaggatcttaactacccaggggaagagcagggaatggacaagatactaaggtagggctggctgctgcccttaattgcgtgtacctgggttgctgcagcctggccccctttcccctgtgaggtccgctcagcacacaccaagcccagtctgtctgctggcattcagttcactgtgcacataactctgtgctcagaactggaccaaaaacccctgagaatatagaagtataaagcctcatccttgctcttaggaagcgaacagtctagttggaagtaataagagcaataaatgaaacaacagcaaaattataatgatgagttcctgggctctgtggtccagcctgttagttgtagagttgtgaggaaaagaagagctgtgagaaccagaatgattggaaatgggaatgtctccgggaaggaaagatgggccttggcctgagccttggaaggtaggtaggtgtgatgaggtgaagagattgggaagtcaagatgatgggtcacaggctgagtgcgttcttctacatgtggatgtgtgcatcctcctggcatctttatgagatggtgacatcagctccaggtgcagcctctactagagggggagtgatgggaaataggaaggagagaaggatggagccagatgggcgagggcatgagcttggtgttggtacaacagataatagaaacccattttgtgtgcgtgtgtgtgcatgcgcgcacgagtgcgcgcatgcacacacacagtggatccttgaacaaagcagggggtttaggggcaccaaccccatgccgctgaaaatcttcctatgcatttgattcccccaaaacttttaatagcctactgttgtcttatcaataatataaacagtcaattaacatattttgcatgttatgtgtattacattactgtagtcttaaagtaagctagggaaaagaaaatgttagaaaaggaagagaaaatatatttgcagattcattaagtggaagtggatcatcataaatgtcttcatccttgtcttcacgttgagtaggctgaggaggaaggtggggggattggtcttgccatcttggtgtagtagaagtggaggaggtagaaggggaggcagaagaggcagggacacttggtgtaactttatggaaataacacaagcagtcttgaataattggaacccttggaacaaattcaatttgttttctggtactgcttttacatcctcttccgcatcatttgtcatctttttggagacactcattttcatcaagtcgtcttccgttaattcttctgatgtggtgtctgatagctcttgaatttctccaagatccgtatcatgaaaaccttcacccctctacctttttgccatatccacaacctctttcataatttccttcattggctctgtcataaattctgtgaagtcctgtgtaacatctggacatcattttcttcagcaggaatgtattgtttcaggctcgatggctttcacagctttttctgtaacaatgatggcatcttcagtggtgtagtcctcccagattttcctgatgttctctctgttggggattctattccatagcatcaacaaatctttccatagagttttgtgtagtaatgagcgttacaagtccttatgaccccttgatctagaggctgaattagggatgttgtgtttaggggccagtagaccatgtcagtgccttcagtgttgaactcatggggttctgggtgggggcattatccaataccaaaagaactttaaaacgcagcctcttactggcaaggtactttgagacttcaggaaccaaaacatcagtagaaccaattcagaaaaccggttgtcattgtccaggccttctttttgtacaaccagaagactggcagctggtatttattttttcccttcaaggctcaaaggttagcagccttatgaataagggcagtcctgattataaacccagctgcatttgcacagaacagtagagttagcctatccctttatgccttaagtcctggtgctcacctctctttctcttactgggcttttgtgaacagggcactttcgtctgcattaaaaacttgttgaggcaagatacacttttccttcattgattttcttaatggtgcctgggaactcatctgctgcctcttggtcagcaaaagctgcttctcccaattccttgacattttttaagccaaacctctttccgaaattatcagactgggagctctgtgaacctttcctggttctgagggctacccaattaaaaattaatagtcatgccatcctttgctggtgttacattctccagccttagatccttcaccttcctatgcctttaaattgtcatatgatgacttcattttttctcaaatcatattagtccttaggtatgcctctcttatggcaatcctgcactcacataaaagatgcatttttaattaattcattatttatttatttattttgtagagacgggtttttgccatgttgtccaggctggtctcaaactcctgggcacaagcagtctgcccgcctcagcctcccaaagtgctgggattacaggcatgagctgctgcacccagccaaacgctgcattttcaatatgagataaaaagatatttcacaaaaaagtgcaaggtctttgcatctgctggtgtagcttcagggatggcttcacaaatttccttttctttttttagtcttcaaatggtgggccaccacaactgtagacctcaatctacaatacatagcaagcagttcatccttttcttgtaatgtcatgacttctctctgcttcttgggagtacttccagcatcactagtggcactttgggtctcatgatattagtcaaggtttacagtattgcactagacactgtgaaaaatacacaagaactgtgagagatggctttttactgtgatacccaatttactagagagaccacgtggagatgattagcatcataggcattttaagtaggcactcaacaatacttgagctcatcacagtaggagttagagatggctctgaaattactatagtagtacagtacataccaagatttaatactgctcaaatggtgccattacaatctgtgtttgtgtgtatgagttttgataatttttaattttatgacagatttgtatatattttgcggtagtaaattataaaatagactaacatctatatatattttatgcattcatgacatacctttttcttaatttttctggtatttctaggctaggccattcatctgaatcttttcaaattgtcaccaatctctaaaaagttttccagtttatttattgaaaaatatccatgtataagtgcatttgaatagttcaggcccaactaaaggtcaactgtgtatatttactatatttttatagtagatgtgtgtgtgcttttacaggagacgtatatatacttctataatagtatattttatagtagatgtatatatacacatatgcattatctactctctctctatatatatattttttgtttgtttgttttatttaaaatgttcaccttccaagggcctcttttacgttttgataaaactgggtagagggaagaaacatttggggtatttaaattgcactacactcatttttttcccttttccccttcttttcagtaagttatacttctttacttaaccttcaccccatccctccacacacaaccaccacttggaaattcttctgatttgatggttgtgttccctgttttcattttgagccaagcttaagggttgccagcaggtggcaaacctaattttacattccaagtaatcagaaaatcctcacaggtgttttgtcatgcacctgcaaaaaaaaaaaattgtatggatggcagcagtagcgctgaaattctccatgaaaattggattctctcttccctgaacttaaacaaatgctcatttgtaaactatatagctccacaactattctctaaagaggaatcagttatcatccccttaagtaaactttttttctgtggccgttaggtaaataccgtccttggacttaatgagtacatgtgtttgttaatgttctgctctgagcgggagagcattgcatgaatgggcacatgtgactaggcagtaactcggggttcatctctactctgttgggtgatgtgtctctacctctgctctcctgtttctagcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccaggtaagggtctctgcccagggttgctcagaacttaggccgacctctcaggtatgagcattgttatagagctggcctccctgtatcagagggatcgggaagaccaggttgaaagcatgtctcagagtcatgtgtgtcatatccagccctcagaattgaatgctgcctcgtaggcacgtggaagctactacatcctcctgcaattgtactagccctggtaatcttagctttcctgtcagacacatctcagcggcccaggggcttctaggctgcatcccagcccgccactttgctggcacctgctctaaacatctggtctctgctgcttggctctcaggagcaaaggtataaggacgtggccaatgctaggttattagcttagactgcctcaacttcactcaactatgacatgtgttacagaacattttttggcaaagctgttgagggttatggcatgtgtgtgggctccattttcaccttctcattctctttggatgtgaggaagcagtttgcaggaggaaagtacaaaactcttgtgtttctttgaattgatgatgctttatgggttttgttatacttgaggaggaaggctctaagtatagaagtattttaagccggaaggtactctcaaggtcattttgtccacttctttcactttatgaagaaatcggggacccacagaaatttgaaaccttgcctctgatgacacagccagccagggctatagtgggtgcctctgaccccttaagagagagcgctcagccttttgggactgtgcaccaccacgagcctgattattggttctttctccaggctcatgcttcgtactcatgcgttccaattaaaattggaaaggcaggaacaactttgtaccatagtgtcaggtttctctgcgaacaaatattctaacagtcctgtctcctcagtgactgtgttctcttgccattccttcctgttctgcccctttaataaagatctgttttgatttttctgggtaaacaaaaacctcacacaaaaaggaaaaacgaaaaatcaaattataacttgctttgttttcttattgaaactctgaaatcagcctgtcaacagtcccttttccttctcacttgccctacgattgggcttcagttagtgtcgtgattatatatgtgggaagaaggggtaggggactagaatgagttacaggaagaaatatcttcctgcctggctggttcccaagctggctgatcatctgatgcctttgggaaacccttttaataattcaggttcccagggcccagccctagtagttctgattaagtaggtctgaagagagaaccactgttgaagatggtacaacatcattaaaggagttaattacagcaatcaaggacatttttccccagatagaactcttacatttctgttatttagttcctgaatgatttgaaaatggagtagccattgaatccactaattactgctcttgtgtcttatggcaacagaggtgaaattattagcagtacactcctctagcttcaccccagttttatggagtaaaatgttgtatttctgttagctttggcctgcaataatcagagcgtggaaggccatcctgactgtgggctatcttgacagcgggtcagcacccaggtcagggagctggcacacacagcccttttcaggattctcagcgtgaattgctttgagtcattgactaattcgcttcctgccagtttgcatattcctataattcaacttgtaaatgctgatgtgtattttctccctttctgttgaggtgagaggcataggctgctgatgttaccgcgtggcctgcagtgttgttgtcttaaatgactcagctttctccagcagctttattaaaacattacctattctacaaaaataatatgattatgaatcagccaaggcccagctgtagatatccagcatatctataaggatactccacatatccttgtagatacatagggtcaagcttccctgtgtacctacaacggtctctccttccaccagctcctgaatatacggttttacaagttcccagtgtgtgtgtatgtgtgtgtgtgcgtgcgtgtgctctcattgctaccaggatatggcctaccctatatgtgcatagaagtgtccattaaatactgatgatgacacagattttatgatgctgcccctttaaaagagagtataagggccaggtgcggtggctcatgcctgtaatcccagcactttgggaggccaaggtgggtggatcacttcagatcaggagttcgggaccaacctggccaacatgacgataccctgcctctactaaaaatacaaaaattagccaggtgtggtggcagacacctatgatcccagttacttgagaagctgaggcaggagaatcgcttgaatatgggaggcggagattgcagtgagccgagatcacaccaccgcactccagcctgggcgacagagactgtctcaaaaaaaaaaaaaagtaaaagatggtgagaaactggagtggaagtctctaagtttgcctagtttaaatagggagctgtcttcatttcagaagggtaggctttgtttccatatgggcaaatctggaaacagatacccttcacacagaagtataagaaagccaatgggttaatgtgtgtaaagttgcagcctgactttcctggtgagcctgtctctcaccccttgagtgagggttgttcttccacattccctttctgcacttgagctaatgatcctaatattagagactggggtttatacagactcaggcttcaccttcttaacacaattaaaaatagagaatttttttttaatgtagttgtttcaattcccaggtgtttttcctagttgaaagtttctaactttttaatcctgtatttatatattttgtcttcattttctctgtttttcaaaaagaattctgggaagtgtttgtagattgaatggagtgaaggtagtggggagcatgacagagcagcgaagcttaaaatggctacagctggaggcaatggatggactcctggccagcaccatccactcctgactccattccacattttactctacaagaggaaactttcatataatagacaaaagtgtatttggagcatttgtctaaaattacgtagctggcagttggcgcctaatctaaaaactaacattcacagacccttattacgagctctgcactttattatatcatttaagtgcataacagtgctgtgagattagccactgtcattatttccattcctcagatggggaagctggggaacctgcccaagggtacatggtaggtgatggagcctggattcacatccaggcagtctgactttggtgccagccgaccaggctttgtgtataatgttgcaaatatgctgcctctgagcggcttatgaaggcacaccatggaagcacagcgtttaagcccacacttgctctaatagtttggaaatggtgcacacagtgccctcatcaatgaaggttgcacgtggtgtgaaaaatgtttacttacaaaaaaaccgaactcagtatttttctgggggtctggtgagattccagatgcactgtatgaacccctgtgctagattctcactggaaagatgggttgtctcaggggtaaaaatgacctctgataggtgctgggaagtcccgtcagccttctgtctgtgtgacatagaaaatgtagttttcgttgtgtttctgaagtgagcccagacttcaggaagcagttttcattgacagggtagatcgtctgcagggcaaggctatgatctacagtttattctttatgtatatgcagacctgttcttcagtggttcttttaggcagctgacccatctatttgtctaatatttctttgtaaatcttagatccaggatatcagtgtggaaactgaagacaacaaagagaagaaatctgccaaggatgcattgctgttgtggtgccagatgaagacagctgggtgagtgtgaatgaagagggtattggggctgcttcttccaggactgaattccactgcagtcatcacttagaaggtgttgacaggtatcttttccactgcttccattgggaagtcttgttaactcgcaagcagttgatatgacttttcaattagctctcagaatgaaaggagctctaatttatattttagacctgtcatgtcttcataatcagtttccttctctttattaaggaagctccagagagcattatattttgaatttgaaaaccctggaagcatgcttaggaatcatatccatgatattttaagaatacagttgtaggttttcttcaccctttaatttctgttttggggagctttctttgcacagtaaacaacagcataaccttttaatattatctgtgtcagtttcccttttattttttcattgaaatttcagtgaagttgtttttagagaaccacatcttttttgttgcttactattgttaggactcaactgatgctaagccttcgagttcttagcaaattggtttaaggtcataggtacttactgagacccaattttaggttaattagatttactgtcagaactactttaggtgtagatgtaactctaatgaacattaattcagaatatgaaaatcagaactccatccattctgagagctagctgaaaagtcatcatgtctataaagagcttatggcctaataaaagggtcaagtcaggtatgaacctttaatcagctactgatataaagttattaatagtcaatatggtatagaatagctgattcattatgggtaagtttcacacataaatttttcagggaggtactacttttacaaacttcatccaattaagtggcgtatggaagaaagaaagctgagtgtcacttgaacagatagtcccaccacttcttgtcccaaagtaacgtgtgacaagggactgcaggtcctggtgtctttgtaggtagagtagaaagccaatggaagcagaggcctcagaggtgtctaggttgtcgtcactttttcctaagtaagagtagtgttttaaatctacgacacagttcacatcttttgtgagactgaattaccaagcaagaaaagccacatggatgcatgttttatttttattttatggcaggctcgagttgacggattatttgttctgacttgattgtccttagtgatattcactgctttaggttttacaatgcttacagactttttattaacaaagcacttggcaaaagtataaacctccatgtggtaattgtgttgcttttcccttctgctttgtccttggcaggtaccccaatgtcaacattcacaatttcaccactagctggagggacggcatggccttcaatgcactgatacacaaacaccggtaagtccatacaaatcatcctagcaatcgtggggtaaaaggttgctgtccttccatagcagatttgggtgacttttccatatccgttggcttaactgtctcaccgtggtggaaatttctgcattccatgtgaggaaaatatgggagaatatataaattcttccaaacagaataaacaggttctcccttaatcttttttttcttaattaactttgaagtgtttattcaaaaatcaggtttcattgtttgatgattccatgatagtatattttagagttttactccactaattggtgattttaacctttttggagtaacagtcatgtttcattagtcatatttcttttcaagccatgatttttgttgtgtcccactgttgttctgcacaggcctgacctgatagattttgacaaactaaagaaatctaacgcacactacaacctgcagaatgcatttaatctggcagaacagcacctcggcctcactaaactgttggaccccgaaggtagggactcaagggattacaggtgggatttttagcatctgtaccatccaggtgttaatgtaaaatctgttttgtgtcagtctgtttcatttgggagttatcaaaggaagagcttaattttggttatgggaattttttgaggatttatggaaaggatgacactcaaaaaggccttgaaagatgaatacgatttaaacagagtctgaaggagagcgtgtgcgggcagagctactagcatgtgcaaaggtgcagaaccaggaaagaagaaggtatgcttgagggctaacaattcaatgggaatggtgtttagggtaatagcagggaataccactattcccttctgttagtggatgggatccccataggggcaacaggcaacagggagtcattgaaggttcttagcagctgtgctcgaagtagaaaagtagaaaacctggcataggctgttaatgaatacttgttggctgacatttatctgaaggtggcaagcaggttggatggggatgggtggagattgcaggcaggggccttgttaggaggctgtgctttgcttatgagcaagtaagagtttaaatgaggaaggcacctttgggaaaggggagtgtaggggtggaaggagcagcagtcatagtcctttcttacagctgcatcccattatctgcacggaactaatccctctttactctgtgagtccctgtgtaacttggagctgacctgtttggagcagttccccaggttgtagttcccttgcttaataaaatcctaattctgggtttcatttcaacatgagctctcataggaactttttctaattttgagaagcatttaaaatatctggatttgtttgaagtgctggagatatatagatcctctcagctgtgaacaaatattagagaggaaaaaaactgtgtgtatgtgagtgaaagtttaaagttcttttaaatatagaacaggaagtttaactccccaaaggcagatcaaggtcatgaggctgccaggcaggcttcttgctattttccaatgcatcagattcactgatatgttggctacaggaagctgagataaaattatctttgtactaacccattaaatggtttctcaatataaacagaaaactaaaattccttgggcttcgataaatcttcatgcttaacccctatcttactatgggaaggaatttttccttagccctagttctttgtgctttgataaagaacctttttttccctatcgcagtgacaacattttttaataacttgctcattagttaatctttcaatcaccgcccagtatgaaaagggggattgatgttccccagatcacaagacgaggagctaaaaatggcagctgatttcacttttatcctgtgggtttgatcttgattattagttgtccagggctccaaagaacatcagttaaaatctacttgtagacaagttaaataaaaagttttaccttctcacttctttgagttttgttgacattttgtgttgattaaattgtatacctacactggcattttttctggctgtcctccagttcactctcctttgtgcacactttgacgggctgagcggacacaggagccctggggtagggaacagtagctgtgattctggccctcacaaccacgggctgccttagtgaccctgggcagggagcatgccagcagtgtgtcctgatgttctcttgtttaaattaagagaaacaattttgctccatacaaggctgtcaggggcggcgataggaatgggggtgtatgtatgaatgtatattgaaaaagagcctgataatatctgttaagagctgtcctttgtgttctcttcacaacctatcccaagttgagtgcttactcaatattgccgaacttcaaagacttgccattttaagttgtttgttccttctctcagtacctatttattgaccacctgctttgcgcaggacagcacagcgggaatgtggtaggtggagtggcataggggcttgcccggacaggcttctgcccttggggactgaattttgtaaggcaaacaaaacatgcataaaaaatcataacctggcaaaaagtggactatgtgtccatacaaagccccaagggaatagaggagggagacaataatgtcagctgtggggatcataaatggttgtattgggtggtaacttttgaaatggaccttgatggatagtaagaaagttatggggtcatgaaggccatttcagacaaagggaagtcataagttaaggaaggcgtattggaaattatgtgtgtatagggaatggtgaggtcaagtttgattcagagatacagtgctaggtacagtggctctcatctgcaatttcacctccttaggaggctgaggtgagaggattgcttgagcccaggagtttgaggctgcagtgagctataatcatgtcacggcattctagcctgggtgacagagtgagaccctgtctcaaaaaatttagtaaggaatacagtgtttgagaggtagtaggctatagaatttagaaatgtctagaccaatgcttgacacttaaaagaagcctggtgaatatttgacaaattgatggaaaaaagggaaggaaagttatagccagattctggaggactgaagcgcttatagtttattcttcagactgagtaattttgagctaggagaaactgtgttcacagctgtgcttctgaaagatcagtctgggtgcactatgtgaaggaaatcgggaaagctggtggagggagccattgtttcagggctggttatgtgacaggatgggtctgaaacatgagtgacaataaggattccataaataagggtcatcccaacttagactcagtgactagctgctggatactggtaacaaagagataaagatatccaaagactgattgacagggggcggtgctggtcctgtaggcagcaatgaggactcaagcagagctaacccagtatggtagtagggcaaggagaggaggaactatgtgtctgtggaaggcgtttcatgaatattcacataatggggaatcagtgagatggtttaaccctcattatccttgtaattaatgcacggatggcagaacactcaggtacaaacatgaagacgctgaactgttccatgttgaccagcagtcgttgcatttgttcctgctacctgggtggggcacagtagcatgcaacacactgaacagagtcttctctgggttacagacatcagcgtggaccatcctgatgagaagtccataatcacttatgtggtgacttattaccactacttctctaagatgaaggccttagctgttgaaggaaaacgaattggaaaggtgagctggtgccaattttgtgagttgtgagacataattaaggttaattgagccctcattctcccatgcactcataaaatttgccaatagcaatttgtagtggactctccggatggtagggaaatcggcagaagcctcttcatcctgaagggtaacaagaggtgggagagatggccaccatatttaggaaaggatctgggggctatctcaaacccagcaacatctttctcctcaactgctccaggaaattgggtattggaaatctgatcgagttgcctaatgtcatgggtgtgacatcctacttaccacagttgaaaaggccccagcatcgtgctttttacttctcatttggctgatgttcacctgccatgttttcaaaacacctcagaccagatgacattgtcctctcaatgcagtgaagtcaaaaattaatgggcatttatgggacaggatcaagctaaattgagccctttttgtttctctagggatttcagatgttaggctacagaaatcattcagaatctctttgcttgggggttggaaagttacagaaccaattacagttaagctgtcattgctcacaaataataatcacagtctgggcccctcttagcagatggttccttgagttaaaatgcttgtgcccaggtacagctgaactgtttcagagctggccaaactgtttcaaagccggtcgttttgtgtgcatgcactcgtatagggttacaatcgtatttaacttatggagtgacatgatcttttcaatttttctatcccttgttgccaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaagtaagatgcatattgtagtgtgatcattaatatggaaagacacatcactgtagccaacagatccctatgttctgatttctgtaatctcatctcttaactgaatgcctttcagtagtgtgtcctactccttttcatctgactctgttttgctgagatttatgatagatcatgctctctctgagcccttcccaatataaatgtgccactgacatacaggatatatgagaattccaagaaatggtacaagtccccaaccccttatccaaaaccattgtacctagtgtgtttcaggattccataatttttggattttaaaaaaacagcacagctcatatgttgtatattataagaccccagatgggactaaggcaatagcccataagcccagtaagtatctgtagcaaaatgtgtaaatattcacattgcattagataaagaaagataatagataatttcataacagttcagaacaggttttgcaacccaaaaaaagtttgattttttttcatatcttttttaagttcataattgttgaataaggattgtagaccttatctattgcttaccatagttccaaagtcgttttttcttttctgaaaactcagttgcatatatcttggtaaggtctctaaaacccattgaaaattatattaggtagacatttgaaataatccgtgttgaatgcattcagctacactgaatgaatgaagtaagtccattgtccaggatttggggtttaaaccttgatttaagtgaatacaaaagagtattgcatgcctttgacaccctcaaatataaatgtcagcaacaacaaagaaattccacggtttggtatgtttcaaggtttgtaatagccaataagcaacctactgatgtctctttgacatgcatttcatgtaagtcagaccagagttaaatggtttttaaaatgcatgacagtgtgaaatttttttttctccagtaccaaatgaatgttttcccctgtgtttagatttactgagaaggggaacttggaagtgctgctcttcaccattcagagcaagatgagggccaacaaccagaaggtctacatgccccgggaggggaagctcatctctgacatcaacaaggtaaagtggatctggactctgcatgggccctgacctcctggaggcttcaggttctatcactaggtctcgactgctaagaggacaagagactggaaggggctgtccccacctgccgaattgacaattggcagctggtgctcaggtgtggcaaaggaccaagcaagcaatggtaccgggttaggctgctggaggcttcagggggcaatgttagattttatcaaaccagctttggcgtaggctatacaccttgctactcagatacatatcactttacttctcatctgaggcaattgtttcaaacatctttaaattacagaaaggagaaattgaaaccttatttcatgtgtttcatagtagttgtggggcttaggatgttggcttcttgcattagagatgctgtcaaataagcaattttaatcatcatgcctattatgcctgcagttatagaaattcacagcaggcattatttccaactagaaagaaatttgaaaaattctagaactttggtcacttgtacagaactacattcctttatgctgctcattaaaattttttttttaatggaggcagggtctcactatatagcccaggctagtcttgaactcctggcctcaaacagtcctcccacctcggctttcaaagtgctggaattataggcgtgagccactgcgtctggccccacttagattccttcgagtggaaggtttgatttttttttttaggtgaagaaatagatttcctaggaatgaatttaatatggacagtaggtcaggattttgaaagaaatttcagatgtgtaaattttttaaaagtggcccagggtggaatgaatgagaaattcatatgaattcttagaagaatcatttatcttttttatatgatcaaagctatttaagataatttatttcctcttaaagtaagagatttataatttacttatattgcttcatagctacagttttgttttccaagtacaacacagaatctttagatttagatgacggaagagtgttcccatgaggatacactgagagaaaaacccgtttttttcctcaaggcttgagagtcagtgagagtgggaatgggatttcccattcaagctgtcaggtccttttgagaaatattagctgttgactgtaaccacggaagtttccttgaacactgcaggaaactgtgtttgtgtgtgtgtgtattttcatttttgtaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggttctgctcttgacattattaaaaagactgttgctagggtaatctagaaacacagaccatccccaggggcatagggccagaggacagctgcttatcgacattcattattctggaggaacgtcaggtcaccttggccccttcccattaagaggatgtttataatttctaatatacatttctatttatctaacttttcatagatttggaagcagctcaagcagagtttgttttagagccattgagtgtgtgtgaactgttcacatttataagttttaacagtttctctcttttctttaatctttgaccaactaatcctacgaggcagttagactggttgtgaaataaacaaaaatggcttgcttttccacctggcttgacataagctatcacctgctctagcttttcagtaaggtactagatacgaactgggcccttctgcaaaatgagcagttactagtttgctttgaggagggcatctaagctcaaggcagagaccagtggggtgggggactcaggagtcagatttggctttaagaccaccagggattaatgtgtgctcaagatttcatgtctgttctttttccttttttggagggggggtggcgcgggaaataggttttttggttttgtttttgttttgtttttgaggcagagtttcactcttgtcattcaggctggagtgcagtggcgcaatctcggctcactgcaacctctgcttcccaggttcaagcgattttcctgccttagcctaccaagtagctggcattacaggcacgtgccaccacgcccggctaatttttgtatttttagtagagacagggtttcacaatgttggccaggctagtctcgaactcctgacctcaagtgatctgcccgcctcggcctcccaaagtgctgggattacaagcatgagctactgtgcccgggtggattttttattttccttcttttcattccgtttctctgtaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtaaaacctgaccgaaaggaaggacgacagagctgatccaaccagggctctcttttctgtgactcattcactaaacccctacgtacagctgtgtgccttgtctaactgcccacatgtacagctagagaggagccacatcacccatgggaagattgctagctcaggaattaaatgagacgtgaagtgtgaaaaagttgtagagaccagttcagtagccagagctctgtttctgtgacttagatatattccagtgtagggaatcaatcacattgtggttttctttatttttaagttttcagggttaaactaacttaccgtttcattgatctgtgagtgagtggtactactttgggcaggggtcccggagaggtggtatggggagaagggaggagtggtaggtgccatggacagaggagaggtcaggaaccaggcagccagagttctgattgtgagtgcctgagttgcctaatcctctttgagccctctttcttggtctttaaatggagattgtacttactatctacctcatccaattattgcaaggatggaatgcggtagtatgtgcacagatcatgggatgggctggatggcagtggctggtcatgccatttattgactgctcttagcatagagttccaacctttcccccttcccaggaagagacctgctatcatgccatggccctgtacctgttcatgtcctccaatgcaggccatggaatgctcagccatgccaagcagttctccagctgggaggcctttagccttgtagacagaagaaaataggacagttttcagacagtcccatgaagcttcctttgtctcagcacgctgtgttcccaagcttgaccttatgcaagagattcccttcccaggatataagctgtcatctgttgcctacctcttggactgttcctgacagaggggcaaagtcatctgataccatcagttttccctcctattgttccagatttacagtgttcttaggtctggtctctcttgacctctcaaaatagaaatgttcgtaaaatgtagcagagagggacttttcattttataaatcatgatgcacattgtaactcagttggtccagagacttcctcagaagtaagagtgaagtagaaatctcatctggcgaggatgtagaatgaggcccccaaatttcgctggttgatggaagaaacaagaaaatatcagtgggttcaaacttaaactctagaagttgcttggggtctactaagcaagacagccacctgaccctgctctccttattggtttaaagatgtggcttgtaagcttttcaagtagattgttttcccattgattgtgtaagtacagtagaggcataccaataagctcctaacagaggaaaaacattcacttacaggctcagcaacttctaaaagatttctttcaactttgaagtgaccaagtctatcacctttatttatttatttttgagtagttgttgcagcggtttcttcttgaagctccagtttatattttggaatctttcatacagcacccccgcccacgctccccactgccccctcccccccaccctggccccgctggccctcaccatctttttcttctattctgcactttttagtgtagatttgacttacttattccaagtttggtgatccttagtttgtgatagctctcctgactcaggccttcaggtatgatttgttttgttctggtttgttggccatcatcttcccctgaaggtgtggggtccatggcagactagagggaaggcatagcttcattgctggctctctgcttgtcgaaagatgatgtgatgctgaagtcaaggctatagtcacagatgtccttttggttgcttcttgtgcacaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggtaaggatggcccattccaagcattacctccgggtcaccagagattcatatttatagaaacacagtggggcttttgaagttactgtgccactatacattcctggtgggtttgtcatgggagcatgaaatacggtggagtggccttctgaacactaactccatcttgtttttctggaattgatacatcctttccttaaatacgcaaatgctgcctttgctttgagtggcttggtgtttggcagtgagactttgtcatacctcagtctctctggccatgcaccgacaccctggtgtggctgttccagcagctcctggctttcacagctggttgcatatacctctctttggaggatgtttagaatgatttggttatgcttcgtgtatttctagaaacaattatatgcagctgcctttttcatatgattcaagtgctttcttgcaggaggatgatcactttgtctgcggtttggccaaaaaaaaataatgtttatcattgccctcactcctgttctagtcaagttgttagaaggtgctccattgccttatcgcatggccctgcatttacatttagcagtgagctggtaatcataagaatatggggtgtagcttactgcctgccagtgagcctgcacccatgctgagctccctcacacagccacgttccttccttgatgttaaacaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacaggtgagcggggcgctggtcagccactggcctgttccttgtgaccaccagtggcccaggaggtgaccaccctgtcaaattgccatttcagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtgagcacgtggccagcagtgtgccagcctcccacgtgtgggactggggagggtgaggtcactcatcgagctttgctgttgggaatttcccacatggggtcatcgacattgcaacactgatgtcatggcattggcacctgccttttgacatgtccttgttttgtaagaagtgtctctcagggcaacatcattggttgcaggaggattatctgagtcagcccagcatctgcccctcgccacaccaaagttagggccttggtttgacctgtgtccagtgtagaaggtattaagatgacacctgtgctatccattttatagtaacttcaggaacaggactctagcatgtttaacacttaatttgccaatgaaagtcctgattgtcagggcagacctttgttccagtcttatctttctgttgagtaaacatgtttgagtaggttatggcacctggccccagttttgaaggttaccatcagtcttagatttggaaaacgttcattaggtagagttcagagatgtgtaaaatgtgtcacagacatgaattaattgactctgggaatggatatcttgtaattgctcacattggagctctgtaacacattcctcttcgtgacaggctttttccagattacattgcatccctgagctatttccattatatttggtgttcacagtttgagtgagatgattttccaaaaaagcatgtagtcaaagcacagatggagaaaacagataagcagcattaacccatcactgttccttttgcaatccagccatggtcagtcttccctttttcacactcgctgtctgcccctgcactcacaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggtaaggtttgttcctgcctttgcttcctttcggtgaaagcagccctggctgccttttgaaatgttttggctggggcagctggtttaaaccacacctgtatggaattatatggataatttagagactgatttttttttccccatactcttaaggcattgaaatccatcacgttgtaggggacaggaattgaaagttgccataagagctgctttgccttacaaagtactgtttgatttcaactgccattgaggatctcttatgtgttcatagtatgtcttcataattgaggtattgatccaatttaaaagatacagtgagggccaggcatgatgactcactcctgtaatcccagctcttggggaggctgggacaggagaatcacttgagcccagcaggtcaagggtgaagttagccgtgatcgtgccactgcactccagcctggtggcagggtgagaccctgtctcttaaaaaaaaaaaaaaaaaaaaagtacggtgaggatttttttttttcttgagaccagtctgtcttcttgctctagaagggtcagggacttcacctgaggacacaaagtagagattagagaaataaaaacagctgaggatagtcaccaacttcagggctgttactgtctcaaagagagagtatgaagggtacattgctgttgccttgataggcacgtgagaggacccttgaggctgatacacaaagctttggttcctttcctcactctctttggaaaaaaaaatttagagcattaacccctgagggaaattcggtcagttacagtgtcccactgggtttttttcctcctaacttttaatttgatgtgatttaattatttcatgtaagtgtaatgaagaaagtgttgtgaactatgttgcacggaaatgtagaacacaggaaaatgagatccttcattgatctgctatgatttgttcctctttttaaataaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacaggtacagttttctgaggttcttaagggagccttgcaccttggggctctcaaacttctgaatcattggccagaagcccttgggagtttaggtataaatttcccagtgggcagaatatgggtgcccagcagaagttcatctacccatacagaaaattagtgagctgtgcatgactgcctgagaatgtgggtctggtgagacatgtacaagtgtccacaaaaggaaagaaagcctgagaagccaagctaattcttaaccgaggacctgtaagagccgtagtgctgcatcgcgatcaggtgtaagccatgccctttgaggattaacacacgcttgtgtcacctgataggacccctggcgccaggtattcccagccaagcccgtgttccccttcatccatgagaaagaagcctgtcaggagagtgggaagggagggtgaagcttgcttgttctgagtacctggcaaagctacaaaggaacattacctggacttttttagaaaattggcttggatagtgctgtaataggatctttttcatgatggagaggtaaataagagcaaaggttattttcctcttctgccagggcatctccaggattggatacactttcttcatttcttgtttaaaattatttttttatttacgtgtgtgtgtgtgtgtgcgtgtgtgtgtctgtctgtctgtctgaaagatttcctccccggctggaggccagtggactctgtttgaccctaactctttgactcactccttactcttgccttgccccggttacttaagttggaggttggggcagatcaggggttggatgcactagcacaggccagtctgggccagccactggatcaatcactagcccctgttccagtttgggttgaatttaagggcttgctgtgagactgatgtaatcaaaaaacaagcccttcctttctgcctctcttctggccttcaagtgtgttggaaaggaaaaatattcctttgcttaccacatctgagagggtttcctgggacccctggtcaggttgacttaaaataagatgggtggagaggggattactctgtttccaataaagattgagctcctgtctttaccacttccaatctttttttctgagctgattcccaggctgaactatatgttctagggtggtattgtggaatagagaataacttatgttaattataattttgtatctgttgcttttaaaacagctgcaaaaaagaaaaataaatccaccaaaccctccttaaatgagcatgagaaacagcaattgggcaaagcattcataacctagggaaaaagaatttcctttttttgtaatattaactctgagtattttgtaaataagatatcctatgtacttccatgttagatgcacacagctggtttcctgcaggcgggcttggctgttagggatgtgtgcattcaggcaggcatgcagctgccttgctgcttcctcggtttctttttatgtccccagtgctgcaactgcacaaagctgttggaagcagatgatgctgtctagactcctggatatgataaaacgtttcagcagcagcagccctcagttgtggcttaaccttcattttgcccttgaccaagagcctgggctactggtgttccagagcttccttaggattcctcagttttaaaaatgaaacgtaaagataaccctgtactatcaataagcataataaagatggaaggagggagctttccgatgacctgccatcaggagaactacattttcttatttttctccattgatgttaactgaattctgatttcactttaatatccccagaggcccacagaattgaaactgaccctagagggtacttgtcagttatgaaaacacacacatctgtgagttccaggtgctgtaggagcacaaactaagtaaacatctaaaccttcagatataatccccgctcctcgaaacatcctgacactgtggtgaagcgattctcctagaatgtaaagtcattataatgtgcttacgttcaggaagtttcctgagttgttgaaagagtaccagaacaaagacactgactctaacagatgtgggtggggcatgagtggccttcaaagtgcctgtgagtgggaagagactgtcctcagcctgccccaggggatgtgaacagggagggagggagctcctgaccaagagggaaattccagccacagcacagttcatggggagcaaggaacagtatccagcttcataaagcaagaccctgtctcacaccggaaaacaggctcagaagttacccagctgtttcactcaggcacctggggttcttgactattcacagaaaccagaacacccgcatctgcttcatgtgatgagggagcttttttgagtcttattacagggagagaaagtgagagatggaaaagcactctttaagactgtggaaactactccctagttttaaaaggtccttctcaggcccttccctgtaattgaatccgtgatccaacatggagagaatttcctgagtttcacttcccacgaatgatgtccgttgcactagtaaaccattaagccacactcacttcttttaagcgtcttctgagtcagcggcagtcccagatgcctgtgtggctgtgtttcacaccacacgaaggccgttgtcacacctgcgcatagatcggtgtcatttggacatgtgactctaaatccttgcctctttcttcccatcttgatggtcccactataggagaaaggctgcctgggccggtaactgccgggcatgcatgagagttgattatataagaaatacattcaggattctgtatggtcatatttctcccttaatgaatctttccagtgtttgaagttactttcatttctgttatttccgtgagaggcgaggatgtgtgtcctgttgttaatttccagtatctgggattcttccctgccactgtaggacttcaatgagatgccatgccaaagggaatggaatcctttatccctttgactactggcaggactcctgcatttgtcactaaactccaactcatattatctcctttctaaagatttgcgttcttgaactcccctagaaatagaactggaatttgagggaagggaatttccttttgacattcctaacccatccacattcttagatgactaattctttttagcccaaattcactaacaatcttttatttttttaaatttaattttggtttctgatgatagatggcaatggcataaaatgtctctggcctttattattttttgttgttgtaaaagcagtaaatgtctgacattttcaaggggaaaactactgcccttaatcccatctgtagcatatgccatttaagtgtttgctttctaacccatgccttggagttttatatcatttaatatgtataaactattttcatttagcattatagtataattatttttctacgtttgcattttgcctatgtggtataagcatattaagatcccttttcctgatgctatggaactcctttcaacttaaaaaaattaaaaaggcattatttgtgtctaacatatgcctaatgatatttttatttacaataattgtatgtaatactgtaatttacataatataaattatatatgatgttataacatgtaaatatgtataatttctactgttctgtagccactggtacctgcaggagctataggggcagagggcttttccctttgattctccaggcagacaatggctatgacactgcattgtcagcagccactgagggcccgtgtggtgcatgcatctctactctaagatctttctttctcctggggaagtttcttcagacaccggtcagcagcacgtgttcaccaagctgctcttactcagcgtgttggagaatccaaggctatgtgttcttcctcatccctgcctcagggtttggtggatagaggagagaccttgtgcaggcacaggcagagagaaattgctctaagaatcgaatgaaaacccagctctcctcagttgcactctgcctttatccatcttaataccctgaatatagactggctttcttgtttaggcaactcaggagtatcaaggaagtgtatgtgtggcagtgcttttgaatcctcagtgggtcctcccctattggaaatgaagctctccgctattgtagtggagccactggaaggcaatcctttgctaggcattcacgctgctatttctcagtttccagtctctaagccactgggtgcatgaaggaagtttgccaaagagtgctggcaccttcacagcagatggggaaggagccaagtagggagcgagcaccccctttaccttagcgtttaccaaattcagcagctctttccagttcttacaagttatttatttaaggttttgtgttttaacttctttgagctttagttacccttatcaattgattaaaagtgggattgagttagtatatagtcttacaggtctaaaaattttcattcctttttgttgtatttttggtgagtttttttcaagatgagaaactctttatcaggaaacatttgtttaaagccagttacatgattatatatattttcttagccttgtatgtgtcacccagttatgagcttcttgaaaataagtttccacttctcccccggtgcctaaaataaggacttgtacaaagcgtgtgctcatatttttttcttaacaccagattaggaagcaacaaatttgtatagatcatttgacagtatgttcggcctgttgtgtggtttgggcagatttttgggtctctctgggaccatggcttactcctttggaggatgctaaaatctctttatcttgtctccttcacattattgagaactgcaagcaaactctttttagcatagttaggaattcaggaaataaattgatttgtattctgtatttcaagattctctacttccttttttaaaaattatttttgttaccattctaatagacataggaagaatcgtgagacagccagtgaacttttgatgaggttgaaggacaacagggatctacagaaattcctgcaagattgtcaagaggtatgttactctttaatccctctattcctgtgttccagtaatagcaattgccagccagcatttagcacaagagccttttgaattataaaattaatgaaaccagaaatccatagcacccatttgactcgcaggcagggatacgtggcacttcatcagttctccagcctacaaggtacagcttaattagatcattataatctagactattatattaatagtatagtactgcactgttcattacagtagacaccagccacaatgtctttatggttggttggctatttcattttaaattaactataattacataaaactaagagcgtggttcttccatcactagctgtattttaagtgctcagtagccaactttgactagtggctaccatgttggacaacacagatatagaacatttctgtcgtcaaaggaagttgtattggatattgatgtcctagaatattgtgcaacctagaagtatttagtgtcatgctttcactctttaaagcaatgtacatttcaatgatatggaaggaaagaactaaagggaactgaaactggctaccaagtaagaagcagagattttcaaaagacaaattagtttcttattcgcttaagaccttcatctatccatctttcaggctgttcccatgtgtatctaacatgcaaagagcagtaatgctgattccaagcaccaagttttaatgtggcattaatctgatgatcattgtactatttcatgctcttctgatacatgcacaaactttgaaaactaaagttggccagaaaaaagtagtttctctgcacgctagttggagaatagtatctagctgatttcacgtgtgagttcgtgagcacaccatatttctctgtctgccggagaataacagactcagccctctctggtttattaaaataaaaatcctcaggcaaaaatggggtgaggaatatccacaaaaagctgcaggaaccttgatggggctaagagtatgggggtagaatcaggtcatacgctgggaatacaacttcaatcatcacagacaccctgcatgcaaatgtgtgactgtgcattaaaagaaatacggctccagtgacagctgcgttagatcacgtatgacagaagcaatcctttgcatccgttaaactgctgtcttactgtaaatcttgtaatatgctcttgcagcaaaaccttaagaaggaaagcccctaaactatgaagcttagggtctgtcaactttaagcaccacattgatgaatctaggtctctgggggatttgcccggagccagacaggctgaagacaggagtgcctcttctaagtgacacgcaagcattagtaacccatttgagtaggatactcacttacagaggcattcatgtgccaagacagggcatagaagagagtaatgggatctaaagttagctatgtggagttgcctagtgtgctgcggtaataccagttgccatttttcactggagggagtaaaagggatgaagaggtgtttgtagcttgggctgggccttccacagattggtagtccctgtttcaccttgagaaaccatctgtgactccctgtaacctcagcccatattcctgggggtagggggttcaatgggatcccacactcctgcttttaaagggcaagttagtaagatgaaattcatttacctaaccatggtaaagctcagtttaaatctaagaaaaagaagaccagggagtgagcaatgagtggccaggggaacccttgagagaaacctatttgtatttgaaatttccagtctcttattttccactgacatatgtcgatttcgttaagtagacatgtatgggaaaagtaagtagataaagttacggttcttcccgatagaatcacaggaaatggtcagtcttaataggtctttagatctttgtttccacttgctctaaatgagcatccctggttatgaggagttctctcctccacacacaccttggctgagttccagtgattatgaggcatgcccaggggctctgtcttctgtgacttctcctcaaaggacacaggaaagtttgggtggggctttttatgtccaggagatgatttgcagatctctgtgtgactgctctgcgaaatcatcctggtttatcctgtcttcccttgtcctgcctgtctctccttgagccacattagaagttagtacagccatagtgtctgtgggaggtgtcgggtgtcccacaccagcatgtatagtctctgcatggttggtggaatttaggtcaagcttgggggctctaaaacacttggtatagtactataatcaaaagggtgatacagtcattggctataaacttttccatcattcagccttattaaaatacaccccttttaagccagaatcttttgagaatggcgtttgtgtgtggaccagccctacatttgataatctacctgtcattctggtagatatttacagagcactcagaggtcaaatttaatactattacaggatgttggtattgttcaaggtatggggaatccaggggtttgtctctttgttcagcttccttccttgttgggtgccttggttagagaaggtgtggattgtaagatccgcccctgttaccacccccataaacaccacctagatgaggacagctattgtaccagcaatacagtatgctggcatatacagtatgctggaatgagcagggaccctcctattcccagttacagtggaaagatagagaccatcatcatctttgtagtggttttgttttgttttgttttgtttgagacagagtctcactctgttgcccaggctggaatacagtggtgggatctcagctcactacagcccccacctcccgggttcaagcaagtctcctacctcagccttccaagtagctgggattccaggcatgcgccaccacacccagctagtttttgtatttttagtagagacgaggtttcaccctgttggacaggctggtcttgaactcctggcctcaagtgacccacccgccttggcctcccaaagtgctgggattacaggtgtgggccaccacgcctggccggtagtgttattttaatgtgatatcctgaaaaacgaatgaatgattttaaaggtattccttttgtgttgtatgtcctcacattacaccacctattctctggaactgatttttatttttccaggaaggcagtatatctacatgtgtctggtacagggatgtgagttagtcctttactgttagcttgattcaacgatcaaagcattttttccttatctttttccagtctgcacagtgttcttttctgcagagaatgagtaaattcttaaatgacctttgtaaatgcccacaaataataactgtagctttggttgcagagtgctgatgaactagcaagttccatagatccatttcattgtgctgtatcgcatgatgctttatctgtaggatgatgtgttcagcaaagagcagatttgtttataagcctctgatttttatgtagcgcgctctctctctctctctttttaatccctcttgggtaagtggttatgaatagcgaaaatatgtgaatgtccttggcactttgaatcaataaatgccttctgttttgtgtgtatgtacagaatactgggaaaaattttgtcattaagttttactttaacttcttttcccctaagattgaatagccatagtctttcagattttagctgcccagataactggaacatagataattttttccaagtaggaagtgcgtgcctttattgtctaatagatccatggtctttgatgacaaaggactttatgagatttgctagtttttccctcaacaaagagtgaaatcaaaaatctcactaccttttgcttttaaccccctcccacccccgccccctgccccattccctgtgtggtgaatagcctgagaatagggacagtgcccaagagttcacccactttcagagccagagggctcctgtgacccacgtcgctctccttgacatcatttccaaaaaacaaatctcggggagcctttcctggcagcagcccacagtgggagtggaagggccttggaagtgttaattctgtaagtacttctactggttttatgtgtcacttctagatctttgttggtagaaccatgaaggatttaaggtgccaatttgttgtgacaataactggtgtaaaagtgggcttctcacggtcactcaggagaagggacatggtcccttcagttggttacttctgattccaggctggctctgcattcttttgtgtatcttcagcctgggcaaacaaaaagctcttcctaggttagcaaagcaaatggggcgggaatcaggactctggcatggcccttacaggcaggcagtaatgagccagggccgattcgggatggaagccagcaaaagtgggtctgggcctggcgtttggctgaccccggtaagagagctcctttctcaggtctgtcagcggccagcagcctttgtgcggctctctagagttcagatccaagcagacatgttgggtctcaaaatcaagtcctgtgaagtgttcttggtgtgaatgaaaggttctttagagaactagaggctatagaaaaagaggtgaaggtgactcaaacttgaaggaaacattgaaagggcatgattgttgccttagccctacagtgagcaagttatttatgcctttttgcattcccttcgatgcacccacaaaaagggggaggtaataaataagtagttttttttttttttttttaataaaaagaactaagagagtaagaaggattgccaaatggagtaaaagtcaatcatgattaacatggtatagctgacacaggtatttggaagagaaaaagagtcatgtcttggagtggttagggtagaattttaaacacgggccttttgtggggaaagccagttatgagtgccaaacagtttgaaaactggcttatagagcttttgtacttctggaatgaatgttagatatagtttggagcagagctcaggtacaagctccatctaatggacacctgtcatgacgggtcagagttgtgaagttaaatatttggttgtctgtcaccatggaaacgtgtgtagtatgcataatatgacataaacacaaccctttccaggcggaaaaaaggctgatgtctaggatcacaatctctgaatccttctgatctttctgtagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggtgagttaaaacatttgatgtggccatggtgagaaaacaaacagggtagtaataaactcctttttatttagcacattttccagcatatctgatcttatctgtacatttacgtaagttacacagccagtaatagctccctttgcacgtacgggttcctgacttcaacccatcaaaagggaaaaaagcagaaacccaaccagttagtagaaaatgcttgatttatcgtagaacgaatactaggcatttagtttctgttgtgcctctcatctgctgttgctgatggactgtgagctctcatgcagggattccactgtcttgatcatattatttgtgttgtactgtgacagattgcacataattttaaatatatacatattttttaaaattgctttttcctatgagactactgtataccaggcgctataataattactatgatgtgttattcttgcacagagagattctgggcagcataactgaagatgaatatggagtcccccccttccccccgacttctctccttttagactttttatagtgtttcagattcttcacggttaaaataatgtgttggcagggcacggtggctcatgcctgtaatcccagcactttgggaggccaaggcagatggatcactggaggccaggagtttcagaccagcttggccaacatggtgaaaccccatctctatgaagcatacaaaaatagccaggcctggtggtatgtgcctgtaatcgcagctattggggaggctgaggcacgagcccaggaggcagaggttgcagtgagctgagatcacgccactgtacttcagcctgggtgatagaacgagactctgtctcaatataataacaataataataataataataataataataatgtgttgtatatcatctttggtcatggaatggaggagataaagtcacgttattagcattcagtattccgttgccccagttgagactatttcagcatgtaacatttattgcttaattcccatgaaacccttgtaatgtacacaacctaggggtcgttgttgattttattgagcagtaacttcatgtggaaagactgtgtgtattgagtgaatggttaaatcacagatcaaatgtcctaggtttgtttttcacagtgacattttttctgtagcaaacttgtttatttacaaccatgttggttttgttttccaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacaggcaagtggacaagccatcatggacttgggtgtatttctgttttacagccatagtccttagagtcttttctcacccactgcattatcaggagtccaccttccatgggaaggcatttttaacccaaaatattacttgctctaacagcatcgtagaacatttccagaatagaaagacacttgtccaaactagaaagacacagtattaggagtattgggtgttggctgtctgtgtatgggattgataattttcttagttaatgggtattatcaccgtttaacagttaaataaatgttcatctcattcaattctgcattttacacgaaagaaatattctcatactttgttgtttaacatcgtgatttgtgacagttatctgagttgttcaaggcactttataggtaataaaaataactgtttatattatatcaccgtagagggctttaagggcaaatgaatttacctcagatttacttgaaaacagttccattgatgttgaaaagcaagtcagtggcaaaatgtttgagtggctcccatggctggctttgcggtgtggccaagtcccaggcccagcagttctgcttagagccagtcactgcaaaagatagtctgtgctgagcgctgaggctgcttctctgccctcagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcgtgagtcgacccctactgcacacatggcttttccacgagcccccttgcctgtgctaaagcccacattctcacttctcagtcatcctcaccttgggccacgttggcaagctgagctgccaaagtccacgctctggatggtctaaagtttctttcccttttcaccctaaatgtaactccattggtcctctcacgttatctagggatactgtaggattttaatggccctaaaacagactttttaaaagtaatgaggactcacagtgagtttgaccttgaggatgaggtagagttggaaagactctccctagccctgtctcggagaacaagggcgtgcttccccagacagccctcccgagggggctgagcactctctgaagctcacccttgctgtccctcactgcccctcactgctcgtttgtgtcgtatatttgttcctctgagtggatctgaccacttatttaaaattcttcccagttgtgggttggagagaggatgcctttggcaacttccacggatcatggccacaacctccagactgtgcagctgttaataaagaaaaatcaggtaagcctttctgctcgagctagttctgtctgataaataattgctctaaattatgagactgggaatggcagagagctttgaagccttgctatttctttctggccctaacagcttgacataagcagcagacggctgccatttagcaagcctttgtgtgtattttccgctccctccagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggtgagaggaggcgggaagcatccctgtcccaggagagcctcagattcaaaccctgggcacactttctgctggcggctctgtctgtataaaaacttcccttgtagcctttgagtgttaaggggacaccatgtgcatgaaggtgtctgaaatccagctgctggtttccctttggtgcagcattttcttatctgaatcctagtgtgccattaagaacaggttcatcctttcatctttgaaatatgccagagtccttcctgctgtctatttataggttccctaaactttacaaaatacaggatggcttggagacaatttgaaagtattgcaaggttccaggaatgctgccatttacatacttgagggaccttgaggaattccagcgaaccaggcacacttggtctgcccaagcttttctctgagaggggccctgctcattctgcgttctccttgtgtttatcttctgcacaggcttctgtggtccagtccatatggaagctcttggaacacttctgtgttccactgtccgtactgcacctctggagtttttctttctactgatccttcctcctaccctgctgagcagctggtctgtcactccttaaggggtagggccagaggggaccgctatggttgtgatgttctcctgtctttgcaggatgagcagagtgctgtctccatgttgaagaagcaccagatcttagaacaagctgtggaggactatgcagagaccgtgcatcagctctccaagaccagccgggccctggtggccgacagccatcctgaaaggtgagcgctgcttcatgagtgtgagacccggctctcgattcctctcagttagggtctcttgctaacccccaccaaaagaaaatgtcagcattcatcatgacttgctggtaaggcaaatctttgagaagcatttttaaaacagacccatcatttaaaacatcctatcatgattaggatgggtgaactgttatattaggaaattgctcttgtgggttaaatatctcccgttggccaaggctctcctgaaagaatattggtgtcgtgagtcaaaagtacaggttgactaggctgggcagtcaacgtaaagtggcttacacttgtaatcccagcactttaccaagccaaggtgggaggattgcttgagcccagggggccaaagaccaatctcggcaatgtggcgaaacctcatctctacaaaaaatacaaaaaatcagctgggtgtggtggcacacgtctgtactactcagctattcaagaggctgaggttgggaggatggtttgagtccaggagtttgagtctacagtgaaccatgttcacactgctgcactccagcctgggtgacagagtgagaccttgtctcaaaaaaataaaaatgatcagaagtacaggttgacttgcatggtggatacagatagtcatagcacttacacttgggttgaaaaagtcatccagtttagtaaagtaattactagttttaagaggagcattagacaagaatgcatagacctgtaaaatgaaggggctcccaggaagaacaaagtgataacacctcctaactcttcgatatcaagtgattagaacaccttcgaggaaaaagaagaggtgagtgtgtggtactcatcaggcccctgtattaacttccaaagcagtcattttaggatttttgtgtaaatgccttttatgacttggaaaggaattggccttgtgcatttaaccagggcaggttaggggagatgaggtcagtggctctgttggtgtaggaggttcttaagatgttcatgatcaggattcccaggaaagtggccttcctagtctccagggataggcaccaacatgtcctttgtctctgatattctggtttgtagaccatcactctggggagaagttggagggagggggattcagtctcctgactgcgcacctgggaatcatgagatggagcagccggtccagccctcctaacaaggatgggcactctgcccagagaaggtagagggccttgcgtgccacactggctgtgtcatttgtccctctggcagcatggtaccagagaatgcaagaccactctggattttgcattaacttattttctcttttgtcaccttcctgactgggaagattttgcattaacttttaacatcaaaggaaatcctgatttgcagagccagaggtgcagagagaattttcccctttccccgctaaattctcctgcccccactattcactgcagcagaatgaggcactacccatccctagtgtaatagtagggataggtgaatgtagtttacatattggctcttttgtttacatattggctcttcacgacttcaaattgtggccaatttcagaattttatttttcatgctaagtgggttaaccagagtttcctttgagaaatatgatgtaatatgctctcccattatctccacctcatttgtttttcccctgaagaaacttgacatttaagatcctttttctccccattgctccttttctttttcagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacggcaagtacttgaggcagtgcatgagttggttgtgcagtaagcgatggtgtggaaggccatttgcattccttgtctgtgagcagataaaatgccctggactccaatcagaggtcttggggtttagttttaaggtggtgtttcttttataagctggtgactcgcatttaggttggctaacctctctgtgcaccccttcctccggtagtaaaaggaggtggaggtagtgcctcactctgctgcagtgagcaagaaaggaaacccagttgctaagaggttctcgagctaagatctattgttctgaagtcatgagtattattggctacatcttgcttagaggcagtttctttccaaagggtattcatgtgatcaagaaatacagagttcacagtgggctctctgatttccttacccatccccgtttcagatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgggtatggcagccacccaggggtgctggggaggctttttctccatagaacatctttgggcatctgtaagtatctccctgttccttggctcttcaaaagaattgccccaattaagcacatacatgtacccactttgtaatagtgctccatttgggagaacttatcagtccataaaggtctacgtttgccacatttgtgaacattagatgagtgcccccatgattaaaataaataaaccagatgcatacacagatgtttgcaagttataggcctcagcaagtgtttttattatgttagcatatccatccagaacaatttccaaaataatattttactatttttcatcaaccaggttctaagttgtatgtctggaaaaagaaaaaaacaggattctgacattttatcatgcctcgtccccagtatgaaatgactggcactaagactttgtttaaaagatgtttgacaaagtagtaacaatataacagaatctagtgtaatcactctctagtttcctttctgatctctgcacagtttcttgtttagtcttatgccttttagttgaaaaacaaattgtattttttttcttctaagtttcatggccctagagaagaagccaattttattaaagatgttatccctgattatgtcaagggttcttgttgttaagagtatattgagtatctaagttatctcagctttttctgttaaaggccaaatagtgtttttcgctttatgagatacatactctgttgcagctctgccctctgtcattgtagaataaagcagccatagacagtgagaagatgaatgagcgtagctgtgttccaataaatctttatttacagaaacaggccacccagatatggccttgggctgacccagtctagtgcctcagcctctaaatagctttggtatactttgggatttgttctatgaagggaccaccttgatagttgttctctctcacttccccttaattcttaattcctgtcactatgatggcaagtttaatttacctctctaagctttggttccctaatagtttaaggattgaggtgcaaaacatatgacatagtgagatctctagaaatgttttctaattattattatataacaaaagtttagggaaacatgggatatctagagatagaattagaaaacaccttgacaacataggtctttcctctgcacctctaaaatcatttacttttagaactgcaagacacttgagagacagtggagttgctctctcattttttcattaaatcccttcacctcattagacttagagatgaggaagccaaagaagggtctcggaacatccagggtgggaatctcgtccctcgagtctgatagtctgcacctcaccatacccactgggctatgatgttatagcagtgaaaaggatgtgtgtcctactgcaggtattgacctgatctgggtttcttttcacagaataacagagcaaaagggaaggctcatggtgcaggctcccaggagtacatggtgcttcttctttggttgtttccttttgtgccaacttgaagtgccactgtctccattctgcacgggagctgtgggaatgacacatagcactgatggaggtcttgagtggttatgcaaagcaatagttcatatttgtggaaattttcacttttgctgtcctcttgtaccttacattttattgcgagcaaattgaaaacagccagagacacagaaacaggtgttttgaaaaatatggttcattgtgtaggaaaattagcttttcagataatttcctaggaatttgctcattgtaatttgagttaaacctgagccataatcaaagaatatttccaaaaatcctttaggatatggaaatcaaatcacactggaaaccaaagcctgttggttcttctttgtatcttttgcagaaactgctttttttcttttttaacctgttatcacctaaagtgcttctgtgcaatcaggggtcagtaatccacctccccacaagccctactgctgtccgtacccccccgccttttaccccacttagcatttctccatattctactctcatagacatctaaaagctctcataatccaggacagttgtctgcggacttctttgatcacgcagctttatcagtacgtgatgattgtgtgtccattcccctatatgtgtatgcctttaattagacattgtacacaagtatggcactactgatgttacatactttatataaggcatgtaagaggagaaaatttaactataaaattagctgcagttattagcttcagttttaaagacatataccgttccccaaaaaaaaggtaagaatgtaatcttatttttgtttttacagaagaaaaatattatgcacgttgtcttccacttcattgtcatcttggtgtgcttttcatgtgactacacagaggcccttcctcattctttttcatggctgcacaggagtctcctgctggatgcaccatcattaatttaaccagtccttcactgatagtcactttattttcagtcttttgcttttacagacactgctgcagtaaataatctatgcatatttcgtatcctaaatatgcaagaatgtatatgtaggatcaattccccaaagtaggatcataaaatcagaaggtaccacatttataattttcatgggtactgcccatttaccttctgtaggagctgtagtctgttacactcctgtctacagagaatgagctcactgacaaatatatcatcacacttggatttttgccaactaatagatgacacattacagtatctccatgaagcatcttttcatgtttaagacccatttgcatttcctgctttctgaatgttttcttcatgccagtttctgtgttggtttgttggtttttttcttttctttctttctttctttctttcttttatttatgactgtcatagctgaaaaagataactcaaccaaaatatgtagatgtaagtagaagtgtaccattggctccatttaccaaatcacaattctcaatgtatatttttagttttgcaaggtttttgttgaaatttggctatttcaagtttcaccttctttaacgttaattagttattttaaccacatagggtgccacgtttttatactttttgagtgtaaatgtcccacggtgagaactcttacaggcgatacatacattgtattcacatagcaatgagaagtcattttcaaaatgtgctcttcatggcagtttcccattcatcataaaaacatttatctttaccccgagatagcagattaggtatttattttttggactgtatctgaatatgtcccactcagatatcccaggctgcctccaggggactttccctgactaaactctcctgcctgtcttcctgtagcatttcatttgttttatcattcataaagaacttaataatgtagttgaacagatttatagaaaacgggtttttgtgacttggatctccccagtgaaattgagggctccttaaggggcatgggccatattttgactctgtgctccctttagtgtatgagcagaacagaatagggcttggggtgatggtgggaaggccgccatgggctgacctggctcatcccctacatggcttcacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaaggtaacgctttcagcccaaaggaaattggacttattggcgcttggttaaaacacaggagtcttccagagagaagcaggagccttgaaagcgttcctgcctgagcgcttcaaggccagagtgggggtggggcggtgcttggagtgcggcaccactgcttgcctcgtgcacttggctcgtgcacaccatcaccagggaatgtgggagcctggggttatcaaagcctgtcccattctccctactcctggctcccttgacccacagtcactcaggccctcttgcccacatatgtgcttgaagtaggaccttgggcttcaagtagccacgtaccttggacatgactaactgccccgtctttgcaatgagatgacttttctgagttatttttctgtgcctgctttttggattaaagaccactctatccctttccatgcacattactaaaggtgtcaccctcaacatctgctttaatatggtgtccttgggttattatttaatatttgtcctatatctttggctttgtttcatgcaaattagtgaagagaagttaatagaggaacacacaggtacatatttaacctccagttcacccctctgccagctccagcccccactgtaattgagaaactatgctgcaataaaagggattttttatgatatatatttttttgaagcagttgtatttcctggatcaggatcagtaggttttgatccatgctggtcactgctgtctaggctagttcccatcctgtgtatctttttgtgtctgaataaggagaccgtattagctgctctttgatatggccatcctgaatctttgacagctaactcatcaaggtgcgattgcggcacctcttgctgcttctctactttctagaagagagtctttctgacttgcatttcaaagtaaaagtttgaacagaaaaccattgctttttctggcacccacctagcaaccattttgaattattcaggcacacacacaaaaacaaaagcagccatattctacagtttggttacctggctggtactgaactgtgctgtcactgtgctttggctccagtggcccagcctaagctcagggagtgattcagacctgaaagaccatcagtttctttcaaggccatcagtttctttcaaattaattgtgtgttttaaaacctacacattttttgaaaagcttgatctcctaacggaggcatcgtttgtctaattttagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggaggtaggttgctactttgctttggagctgcagctggcgtcaagatgtaaaatgactttgttttatatgtttgtgtgtgtcagagatactgtgtttacattcttatacacacacacatatgttttaaaactcctttcctgtgcgtctagaataatgcaattatgcaagactctaggcccaggctggtaaatctctggcacagaagacaatttttgagggctacaaaatggactccgcatcctccccaatcagtactctttctaggtgacgccaatgtccattgactatgccctagatcagtttgctgttgagtgcatggttggtgattctggttaggatggtggtaataaagaggtaaattattaggtgcgtgtgtggccccctgcatgggaatgggcatcctctccaagaggtcagggctttgtccgtcttgctgtccctctcctgaacgtgtttgccgcagggagcctcctcacgacaaaacagctttggcagggcttccgcgccttcctccagccccttctggaaggagcagtgctatgcttttctttcctctcccagtcctcagacagactgagcagtccttagatatctcccagcttaatggtggtctttgcagaaaatgtatttttctagtataaaatgaccccatcaagaggatgtggtgcattccattaagatgtcccggggatcctctttttcatacagatcaaggaaaaattactgcagttgacggaaaagaggaaagaaatgatcgacaagtgggaagaccgatgggaatggttaagactgagtaaggatgtagtttatctttctgctcttttgggtatcaatggaaaacatgcacgtttattttcttgctttaattcattaatgttatcatttaaagattgttcgagttgtagatgcctttttagtgccccgtttcaccatttcatggtaaatactacttttaagaagcttcctatggcgtagtcatttttcacctcttgattgatctcagtgtcataggtgggatttggatgttctttagggatgacagagggcacctccctgggagaatacagatagaagccctctcccccatttgtcttcaagaattcttactacagaatcaagttggaaagttgatctcattaagtcatatttggtgctcttagtggaatgttgataacataataaaaactaacatctattaaaattttgctgtgaatgaggcattgttctaagtggttttttaatgtatttctgtgtttattccccaaagtgaccctgtgaattagattctatttttaattctcattttataagggaatatgtgagctaatacagggtttataatgtacagtattaggaatagcatttcataattggtatgagcactaacagcgcaattctagcattgcttaccatgctttgccattctctgttggagttctgggctctgtccttatgttctaactccatctatgcatgttatgggggtttactagaaaccaaatgcaagggccttttctgagaggtttgacggcacactctgttgggcccagagccctcagaaatcccactttttgaccattctttgcaggaggatttggtctgtatgttttgagaattgtggggcagtttcattcagctcagcaaaacccacattacacactgaaccgggcaccagcttgtacaccagggacacagtgatatgcacagtccctgccttgaaaagccagtaagtccctagtgcagaggtggcatcttcttcatgtagtcatgttgggggctaccgaggtgctgaaagcagatagctagccagctccttgggacaccaacgctgcccacagtccattttttacctcaatgatcccaggctttgctgcatgaaatgaagtgaaaatcagtgttaactatagcagaaagcctggttctaacctaccttctcataactatgttggaactagtgttccatttcctcacaggtggaagaacagaatgaaacagagcaaaagccttggtccccaccatctgtagtgttcccatatccttccctccctctaaaccccccaaaataaaacacacaactaccgcccaaaagagggcgagttaagaatgcctgcccatctggctacgtgtagattgtgaattcctgcaggtctctgaaggcttagctcatgaagtggggccgagtgaacagagcgttcactgtagacctgcgctgagcagtatgatagctgctttcccacgtgtggctcttgagaacttgaaatgtctcaaattgagatgggcagtgaatgtgtgccgtaaaatgcacatcagatttagatttagaagaaaaaagattgtaacagatctcaatagtttttttcatattgattacatgttgtaataattttatacatattatgtgaaatacactattaaagttaatttcacctatttatttttactctttttaatgtggctactggaaaagtcaaagttgcaagtgtggctcacattacatttacattggacagggctaatttagagtagacgatagactggttatgcaggtagccatcaccagagggcagcagtgccaagaggtaaggccatatgactgcccggcacctcctggtcaacgtgtactaactcatggtaccctgtgcagttctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacagtaagtggccgctgggccctttgtctgttggtgccctgggcagccttttcttcctgcttgcctcttagaccagggaattcacacgattgcttgtttttgttttttgggtttttttcaagtagtgaagatcatcttaaaatgggtggctcctgtggagcaggacctagggagagggtcaggactgttacctcctcagtcacatcctgggcacctggatttatgatcccttatagtagcttcctgcctgggggttgattggtggtgtttgcttttttcttcgaatctttcattctcccctatctcataaaagctttgttctcaagggggcatggcctcaaaattttcttcagaatttcagaattagaattcccatcaaatggaagcttaatcctagcctgttgttaagtccccagtcctgatcccctcttctgtcaacataaaggccttagaataggatttgtgcactggtgtttcctctcccaagacttttgcattcctggtagaaagctgatcctttgcagtgtacaaaaatggtgtttctggtttccagttctgggtgtttaaaatgtacctgcatacatttgtgttaaaacagagtacttctggtacatccatatgactcatgaaatggctttgtttcagttagactattctgtggctttttaatgtgttgtttgggttttggctgaacacagatccccaccacagcacaagcggcttccttgagaattattgcagctctgtccctggtgtttgtctgagctctcctggggagtccagcatgaaccctcaggctcaggtacttttctcctcagcagagttgagagttgcatagttactttagaaattaaacccaagctcccaggggtcctacaaacaactcacaggaattttgccagcccatggaatagactatttcctgtagttttaggttgtagctgcagttcctgtgaacctaattccatttggctcaggatgttagagcttcttgtccagtgtggtccagtttagcaaactagacaggaggacttcctgggttcctagaacctttttctgaaaagaggcagagtttgggactctaccaaacatcactctattttctcttagttggagttactggaagtgcgcagacagcaagaggaagaggagaggaagaggcggccgccttctcccgagccgagcacgaaggtttcagaggaagccgagtcccagcagcagtggtgagtcccagcagctccagaggctggacccttagcctcggtggccaatgaggtttatggggcatctttctgaagccttgcattgctaggcctaaccacatgccctgcctactgattgcttccatagactgtttaaaggctgtacagttatccctaaataaccttggagggcactgatttgtccacagtcacataggtatgtaggtggcagaagtagaatgtagacagtgccctttctcatcctgtgtgcacacacacaggatgctcagaacttccatatgattaaatgcatggagtgaactgcccagattttaggccagtgattttgtggtgatgcgttttttgagagttctaagtaacttcacacagagggcagcaattattctctacttccaaagggctaattattttgctatggtaagagttccatggcaacctctaatgctgcctttatgtggtggagcggggcatagggcattcctgtagtcgtatttttctgtctagagtctatttaaaacacttggaagtttcagatttaaaaagaattaaattatgtgaaaaggttgcacgtaataaaattgagtgatgatgttctcccaccctttcttactgtttcctctttctcctcttcttcctttcccttcctccttttcccctcttccctaacagggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggcacacaatctcatacattttgagacccttgggtcatttattactttttacaaactagttcctctctttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagaagcttgcctcacagacttccatgcctctccattcagccgatgacttcagggtgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgtcagtggaatcagaaacctgttttgatatgtgttctctatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcagtgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgctgtctgttggcatgcttaaagcacatgtccattaaaattcattttgttccttttattttccttgttttcttggttagtgattcatttgcataaacattaatgatctctgcatactggtttggggttttctctttccttctaactctaaagaaaaaatttttgctgcagaattatcctcagaagaggcttccctggccttcatctaccttgcagtctgaccaagtatgataaattttagccgttttcaaggaaacatctctctacccaggtcattgctgtcactagcagctttcaagtcaaacctgcagcactaaatttttttttatcctggtttctctacatactaaccccatgtctctctggactcacacctggctcaggccttccagaccaaactcatacttcctcctcaccagaagtttccgaatctcacactagagaagatttgtcacctttaaagtccactcacattattttgactcagggttttgttttttgtctatttcccctcctgcaactctcctttaaaagtgaaaagagagagaatggtttaagtagtctgttgctcataagcacgtgtctgcagtctgtcacttgcaaggccttggtgatcaccatgcagcacttgtgcgcacacacacccccacaagtcttttttcctaataatccattttccacattgccatgagggtaaagggttccaatcaaaaccaccattaaactgcatagtttctagtcttccctcagccctgatgctaattatgatagtttgcatagacataacttaaacttgtgattctccctccttccagagctttttgtagccctttttccccccaaaattagttttgttcaaaatcaagcattgggcccagccattaagataagacctaataagtgagagatacagttcccaagagtttacagatccaggtgttcacatggtggtggccagtctaccgtttatcttgtcaaggttgttactgctaatttggtgtcactttggtcttgggcagcagtggtgggcgacgtatctaatgagcgtgccattgacttctccatgtttgtctgtgtacgaggggtgcaggttgtctgtaatccactaaagtgtcagccacacccagctttagtaactcgctaatcgcacaccctgggtgtatcagccaggggctgctacagttaatggtacacagttgatggtacacaggctgaaaatgataatgaatcaagaccctactacatttccaaagccgaaaagccatgagggttacaatttaaatgagcttgggaaggaacgctcccgaagacgtctccagcctgaagggtcagagccgctggaagcctggctgtctctgggctttctcgtctcagtgcagcaaggcaccgtgatcaaccaacccgtgatggggaaggccctggttctgtctttgtttgggggtaaatagctgtgtggtgttgagtgactgtgattggcttttccagctcctttaacacaaactacaacccactcacgatacaacttcggcagatgtggtcaaattgatgtttgttgacttgcctcatttccttccagctcttaagttccaaagtctaactgggatggtagatgtgaaatgcatgattgtcgtcctaatttctgcatgtgtttatgacaatgtgttgaggggagggggaggagagccagagagcattttcaggaaccgaggtctttccttgtcttactctgggggaatgccatgtagctctgatagagttgtctatcggtctgtttgtgaatgccctttcgcttaaacttccagcccttctggtggcatccttggttgtaaggtggctgctgtataacgtccactctctttcatatttaatatgtgtgattgttactgttgtctttttgttttaaagtaaccataagaggagatgatctgagttatatttattgatcagaggaatagagtgcagtaaaactcatactggcatttcgcttttctcatttccctgtaaatgggcgggtattaatccattcccaccttctaatgtccttgatgtccagctggctttgtgggtgtgcaatggttttactgtactgcctcgatctgtgccaggcatttatacacagccacatgtgcgagtcaggtagagcgtatgtggtcacccccatggctcacggagttagctgaatggcctctccgctgtccctagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtaacagcagcagaggctgccacagtaagatgggaagtcagcctgtgaagggataaggcgggccactcttgaattggaagagaagtatgtgctcatgtagttttattcctttggtagcttcctggacattgcattcttcttgggctgacgctggaaagcaggagtagaatgctggttattcactgagagaagaagagttgagtttggatgggagtagctagaaggggctttagtagttcatctagagaaggaatttgctagattgagactgaagagtcttctttactttaagtgattgatttcatttaggactccttgtgggttttttgtaaaaagccattaaccatttcccctgccctgatctccatatcagcctttatatatattcattgtctctcaacagccccaatttttttatttaacagatggggaacagaggctctgagcggttaacaaagctttctttctgtggaaacctagtaaatggcaaagctggaatatgaaactgcaaagcctatgtgcttaactagtaaacccaaccacctgggaccaccatatcttactgtgcagtttgttgctgtgtgaggggatcagaacatctaagaactgccattcacgttgaggacaacatagggatttatatattaatacatgctggtgtaatacaggccggtgttctgttaaaattagtatattaggacagtttgccataccataggggaaaagccactttattctaattcacccaaaggtactgtaagtgctgatggctctgggtctgtctttctgtcaagttgccaagtcacataagtaatgaatccgcagctggaggagctgctgctggaggacaggcatgttttcagacaggagcatggcctttagctcatgaccataagagggcgctacagcaaagagtactaaataccaatcaaagtgagctcagagtacaagagggtaacttgcttttctccgaagtgaaagagaagacatagtcctcaaacacttgccctgtgccctgtccctgaactctccatggaggaattttttctgttgtttagtgttagcagaatttaggaagggcttgtaataaggaaggttgagggttgggtggggtcacactgtgttgtgtgaggatcattttcatgttaatgaaatgtttagttctttaaggggaatgtggtagagcctttatctccccctgcccttttttttaaactgcacaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaaggtgagagtcgccgtgcttcatggctgccagagtgggtttgcatttacttccactctggggtttggttttcttatacagctgctgtgattagttggttctgtcttctgccattttaaatccccaataaagtgaaaaaccagtttggcacgtgtctcggttaggctgaattctttggcaactgtggccagccaccagcttccctgtggttaacagtacatctgagcattgaaggataaggagcttttgcttttataaccaggcacttactgttccctaagacttaaagagagctagtcacatttcacagtttaagggaggctttgaaaaatagtttccccatcttttcagcttatcccgacccaggagatgctattctttgctcatgaattatctggagatgggtcaagtgagtcatcctggagctggatggagacaaacaggaaatgtttgggtggggcctgggaccctgtcctcccctgactctcccagcagatgctccagctgtctcagaaccatctagttccaaatgtctctaccctgtaggatacatgtatctccctacagagtggagctaagctcagaatttctcctcacacttggaagtaggcagaaaaattattttatcttgtaaaaagtggttagaatgcttgtttactgatttgtgctgttgctttgggatctgaaaagctttggtcttccatttatttgtatgtttcatgccagttggactaggcccagggctccagaggagagagtgtcagatggtttgatttattaagctctgctgctgcgcagtgcaggcaggctctttgggtcctggaacactttacattttgtaggacaatgcaccggcagcctggctccttggctgctttcccctttgtactcccttcatgcagcttcagagagctgggatattagcgaacggcccctaccctgtgttacacaacagtaccctcgtcctctccgcagccacagagtgaacctgtgacccttccaagcctggggacctcccagtgtcacactaatagggcttcttaattctgagacatacagtagaagaaaagttgaaggacattttctgtttgcctattctgaaactctggaacatgtgaatgtaggggatacaagctcagtagcagaatttcaaaagggctcattgtgttcaaaagctttctcctgaactcagtttagaccagtaagtgatcaggcatccacaagtgatttttgccacaataaacccaaatgttatgtttggggctttttaaaatccttccattggattgaagcacaggctccctgtgtgtatcattggcgcgattatatggcttcttgatctccaggggtctgttgctgggcctgggcgggtccccaggcttggtggtgacatatgtaggttgacgcttctgttgtgactcctgtggtctacttctgtcctgcatgggatatgggagttgggggatttttatttctctgtaattaagtggtgactaactttcttccttgaaattacagactaaatgatggcaatgagtacctcttccaagccaaagacgatgtaagtttctaaatgttatttctctccactacttaggagtttgcaagtgtttgtgtgatgatgggctttattcagaaagttcttcatgtaaatgatgatcagtgatggtttctatcactgggctccagtcaccagcactagaaggtgtttggttctgtctctagaaggcagtgaatatgatctcactgtccctttgccgaggcaggatcccttaaagtcgatggaatctttgcctgtcccctcccagggatgaggcatagtgaggtggtcccaggactggttgtggatcatgatgggacccccgctgcacccttcgccagcagccagctgtttaatgggtgtgtacctcacctcaaggaaagagagagtccattgatggaaaaacaacacctgtaatgctttaaatgtgaaaaagcaccttctagggtgggatctgaccacctcacagattgagactggtcttccagctgttacaagtttgtagggccacatactagggtgatgagtagaactgaattctcatgagaagctgaaccaggttccctctcctgtactgataaggcagaggtgcatttggggacagtgcccagaagtgactctgcttacccctcagttggccagatgcgccattcccaagccttggagccagaacccctcatgcctactcttagttgagtctcacctgtgtcccttcctctgtccaggaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggg

SEQ ID NO: 35634 - DNA, 212224 bp, Homo sapiens; identical to SEQ ID NO: 35633

SEQ ID NO: 35635 - DNA, 19033 bp, Homo sapiens
gcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtaaggcgggcaggcgtggcgcgtatgtccggggggcctggggagcggggcctggtgcggagggggtgagactggaaacggggtgttgggtggggcggggacttggaggggcgctgctttttaaggcgcgccaactctggatgaagtccaaggactttgggaaagtaaccttgttcaggaatcggagtcgggggagcggggggcggtggtaagcatggggagattgttctttggcaagaatttgaggagagaagcgggcttgggagagcagaggctttgcaggcgaagggacgagggtggtaggatttggtgggaattcctctgttttggttcttgttgtatttctacgatctgaaaggcagcatctcccttcctcctatccagtgctccctggaattttttcctctaatgaaataattaggagcggaccttggtaaacgcagtctagtttcgacattggtcttcccgttgggaaagcgaaagatccagcggtaacccggttgtccgcgtttcttggactttgttttgtttcatgcctctcttgcatctccagaatcgcttgggggcgatagcttttgcctgagttgacgcctgaccagcttttgtcctggtgcagcctcctccctgcgcagtaggtgcttttcgtagccgaccggctgtttttacagagacctttattgagagccctctccatcctggccacctaccccggtatctcctgggttccaagatctgtgtgattctgtcctaaccaagttgacactgttgttgcctggtgattcactagtaataagtttgtgattttttcttttgtaattcaccatttatagtatccatgcacattaaacctaacttgtctatgacttccaaatatgggattcagtttaggtagttttaggttattatgattttgccgaagccgtgacaaacttcctacatggtcgacttggccactttaatgacttcgcgaatgtggttgtgtgggtgacgttggtgatactgtgcagtttttgatacttaactgcaaaagaggaagagagttatcccagacacaatctgttttctctgtacttgctgcttctccccactcattgacttgaaatcattagtaagcatttggacaaacgccagatgagaatcatcttaaatgaggcagatactgtttcatggcccacccccgggggactacctgactccacatgactgctacctgccctgttgttttttaccgtcttgtttctgatgtacatttaaaaaacaacacgaatgtgtaggtttgcttgtgctgagtttattttcatgtttcctgtacttttatattcggaaataccgccttattgacagaactatatcacattttccctcagagactctttcgttctgtattttaactgatttggaatactaaacatagagttaatgaccatcagctgcattatgtttctaacttccttttatagcttctccattttgctgaggggctgggtctcatttcttttgtttgtccttagctctgtcttctatttccctaaatgaataattcaaaccttgaggatcctcaaggctattactcaattccgtcttcctcacccccagaagatgactttctttcctatttaactaagagaatccatcgacctggctctctcctgcagtcttagtcttcctgtttcttctcagatccttccctccactcacagaacaaaggattcctaactcctcaagaagagaataccaccatttctatttcaaccatccgaatgtaattggctgtatttcttttcagtttttctcaggcagattttttgatgctgtgggctcagctagaaaatgaatagaatagcaggataaagtgggaactacaaacaggaaactcaaaatgcagagagaaaaacttcattacgggcgcttattcttacaaaatagggagtgaggagtttacatctgttccctactttaagcccttgttgtgagaagggttcacatacctctgaagaccatgctttagtttcacaattttaaaaagatgccatagctgttcttactttgcatagacttctcagattagtgtaaaacattttattgtaaacttcttaaatcgtttgacctgtcttaaattgattaagagatttactgaccacctgcagtgtaaaaggctttggtggacaaacaaaaggaataaatcacaggggccatgtgtcatttgccttgttttcctattacctgctaagtgctagactctcaaatgtttcttgtctaacacagcatctgcccttaagatatttatggtatcacaaacttggagcacagatatgaaaaacatatggtacagtgatgaggaggaggagaaggtgatcagtaatatcagattctaatcagaataagtactggaaaaaggccattggttttgtttattatagttttgttgatgactttcaaaagagtagcttgaataccatagcagtgtaaagacagtctctaccaacttggggagacatgtaacacttatgatgcaagaccacctaagccaaactgtagtataatacttcgaagcaaagaaggcttgtccaagtagtgcattttattctcagaagctgctttactaagacagagaaacaatatggggatgagtgagtattaaatgtcacttccctccctacctaccttgtcaaggtactctcttgcttgattcctggtgaggcaataattcagtctgcatgggagaatatttatgtttctttttacattacgtgggacagacttctgagatgatgattccccctgtgtcatttggaacttgggggagcccctctccctcgctatcagtgactgtatctgatacagtctcattgctttctagccacggcttctactggtctagtgttaaagtatcgtaacaccatatactaaaatattcattgtatggtacaaaatagtgctgtgggacatagagaaagccagaaccagttattatatgcaccggaggtaccagccctgaagtgtgagcctttcgtattttagctagaaaagaagcatacctggttaagtaacaggaaatttcagaatgagctcatgtttaaattctggcattcctgaaatggttttctctatcatttattgaagaatttgaagccagttgattttaaacaagtttcttatgaggtataaactcaaatgtttattgaataattgaaaatggacttaaaagtgtgctgtagtagatatactttgtgattaatggtgtgcactacaagactacattttgagcatttgtaataattttatctcttagacttaatatatggctaatttttcatgagtgtctcaaccataaacagtttgaagttctgtatctgggagagaagtaaaaacaggtttccttaagctctattcctttctagccctcacctctgacttcaagtaagcatagcttgtttatatttgttagtttccttccttaaactaaggaagttttgtgcctctgcctttgcatatgctattccttctccctgaaatgttgctgtcctcccaagtcactttctaaaaattttattaaggaaattttcatacatacaaaagtagtgaagtagtacgaaaacctcccatttattcatcacccagcttcaaccattaacaacattttgccaagtccagataatttaatggttagctcacatgttttcgtggtaaaactttcctttttttttttttttgagacggagtctcgctctgtcgcccaggccggactgcggaccgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttttttttttttttcttttttgagacagagtcttgctctgtcaccaggctggagtgcagtggtgcgatctcggctcactgcaacctccgcctcccaggttcaagcgattcctctgccccagcctcccaaatagctgggactacaggcacccgccaccatgtcgggctaattttttgtattttagtagagacggggtttcaccgtgttggccgggattgtctcgatctcctgacctcatgatctgcctgccttggcctcccaaagtgctgggattacaggcgtgagctaccatgcccagccaagctttctttacttcctagccagggggatctgtttttctcacggtgcacctgcaaaagtttctggatccttcttgtatgtacttattaaatagtactcagtacacattggtaggattgtccttttctcttatttttctctctacagcaagatgttctcctggagggaagagggtgatgtctttataagggcagtggctcacgcctgtaatcccagcattttgggaggccaaggcaggtggattgcccaggagttcgagaccagcctgagcaacatgacgaaaccccctctctaccaaaaaaaaatatatattatattatatatatatttatatattatattatatatatatttatataatatatatttatatatagatatataatatataaatatatataaaacatataaaaatatatatacacacacacatacatacatatatatattagcggggcatggtgtggtggtgcatgcctgtagtcccagctacaggggaggctgaagtgggaggatcacttgagccggggaggcagaggttgcagtgagcctagatcgcagtaactactctccatcctgggtgacagaatgagaccctgtctcaaaataaaatgtgtgtgatggctaacttattaattaaaacatttgaggtgttcattacacatttgttgaatgaatgtctcctccaaaaaatattgtgaatactcagttgtatctgcatgtaacagtaaacaacaacaaaaaactttttttttttaaattatactgtaagttctagggtacatgtccacagcgtgcaggtttgttgcataggtatacatgtgccatgttggtttgctgcacccatcaactcatcatttacattagttatttctcctaatgctatccctcccccagcccgccacccgctgacaggccctggtgtaggtgtgtgatgttccccaccctgtgtccaagtgttctcattgttcagttcccacctatgagtgagaacatgcggtgtttggttttctgtccttgtaatagtttgctgagaatgatggtttccagcttcatccatgtccctgcaaaggacatgaactaatccttttttatggctaaaaaacgttttaaagatagtcaattttgatctttatcagataacaggctttgcttagttctgtagattgaccctcctgtgggtgctttctctgcatgggaagcccttatctggatgcctccttaaaccagacacactgttttaattattatctcagtagatactggctctgggcaaattactgtgggaaaactgaaaaatgattttttttttaaagtctccagagaatcttctggaataggtgtggcagtgaaagaagaaaacaaagaattcctctcttcaggccctgtgcttccatggatctgatacagttattttgtaacaagtcaaatctaacagatttcttattgtacacacttacataagatgtagaagctttcaaaaacaatgcacaccacctgatttgactgattaaatttacagtactgttaacacattgagtggtgaatccgcagcccatgctgctaaaatattgctgcattctatacctctccatattgccaagtttagaagttaataatttaatcttttttttttttttttaaagagatggggtcttgctatgttgcctgtgctggtgtgcaatggcatgattatagcacactgcagccttgaactgggctcaaacaatcctcccacctcaggcacctgaccagctgggactacaggcacacaccactgtccccagcttaatcattctttttaaattacatttttattaactttctttcctgaatacagtgaaaggaaaaagtgaatcaggaataaatatttgtaatagttagtacatagttggatattttcagagaaattttgtattgtaagattacagttaattttatgtattttttgaaaagctaaacatgtaatttagaaatatcaactttaatcagagataagttgccagggcttacatgtgagcacaaggtaggcgttcgttggtgaatatctttaagatcaaaggatgccaggagcggtggctcgtgcctgtcatcctagcactttaggaggccaatgcagtaggatcacttgaggccaggagttcaagaccagactggacaacatagtgagactccatctctacaaaaaaaatttttttaagtcacaaggatgggttttccagtgtaatactttaagatgtaagttggggttctaatgaaatgatgtgatctaatggaatataattaactcaaagaagatttggaaaaagcttttaatgaagtagcattgaaatttatttcactgtttcttggtccttctgattggccctacgatttattttgtttaatatttagtggtatgacccacagtgaaattaaacttgaagtgtctctagtactaaaagaagataatagtggatgagcgtgtgacttatccatggaagagaagaaaagtgaagagttcttttgttttttaagagacagacttagtattgttgcctaggctggtctccagagctcaggcgatccttcccacctcagcctcccaagtagctgggactataggtgtgagatttttagaaatccttcatgtaataaaaatatttaagaagggaaaatagaactcctaaatgtttttggcatgtcattcccttcatttagtaattgggtttgcatgcttttcttgacaaaggaatttctgtaccgcagagagctttttcactgtgactatgctgtgtttagcaaagaagagtttgcctaattgatttcaaactgatttccatacacagaacatataacgttttagtagatatatctgatagttcagtaattaattcacctagttgtattagctcatactcatacaccacacacgctggccaaaacccattgcagcaaatgtgggcaacaaaaaaaatcagctttcaactggggagagccaccttgcaaaagtgattgttcctggtaagtcctctcaagaattgaaagatatcatgccttgcctctgaacaatgcaaggaaagaggcttgctgctgaacatagacagtaaagtctaaacattttatagccttagataatggtttctttgggaaagaccttaaaataggagttactggggaatgtttattaataatcacgtagtgctgagaaggaggatgtcttaaaaaccagacttgtgtcctgattctcccatctgtcagctcagcaagcttaacacaagttatatagctttactgaatcttaagtttccccatctacacataggctttggtaatacttacttcacgggttgttgtgaggaataagtgaagtaatacacgtaaatacacatgtcataaagcatatcctcaataaatattggttgattccaaatttcatattgtggcattgtttagatcacctaccctaaaataaaacttgatctgcttatctagcggatgttagtgaaatgacttcagctgataaaaggaaaatgcatttcctgtgtgtttatcattcaaggtgaaacaggagagaagtatataatagtttgtttaaaatactatcgatagctggccgacacagtggctcacacctgtaatcccagcactttgggaggccaaggctggtggatcacttgaggtcaggagtttgagaccagcctggccaacgtggcgaaaccccacctctactaaaaatacaaaaattagccaggcttgaatggtgcacgcctgtagtcccagctactcgggaggctgaggtgtgagaatggcctgaacccaagaggtggaagctgcagtaagccgagatcgtgccactgcactccagcctgggtgacagagcgaggcttggtctcaaaaaaaaaaaaaaaaaaaaaggtcccagctacttgggaggctgaggtgtgagaattgcttgaacccaagaggtggaagctgcagtgagctgagattgcgccactgcactccagcttgggtgacagagcaaggcttggtctcaaaaaaaaaaaaagtcccagctaccccggggactgaggcaggagaatcgcttgaacccaggaggtggaggctgcagtgagccgagattgcgctactgcactccagcctgggcgacagagcgagactccatctcaaaaactaaataaattaaaatactactgataggaacttaacccttgaaaattccagatgttcacattttcacaaagggaaggagggcaaattctgtgaactttactatgctagataaggaagcctaactccaatcctacgtgagatttctgtcttgagtcgttaacaatactctttctgagtacttaaatgcagtgaagcctcctgggataccacagggattggccaacaactacaggcacaactcatttccttttaaaatggatttacaaccctgggagactaggaaaattcagatattataatgggatttcagcaggctgttcctctaaagagctaaacaattttattcagaagttgctagttaatgggaaggggcagcctctggcagctttgtcctcacctctgttctcttttgttagtaacttagatggaaatactgattacatgctgatcctaaattcaggaagttgagacagtaaatctgtagtgtgtcagaatccacatccagaaaatcttcataggcaagaatgtaataagatgaaactcaattacaggtatattaaggcctatgcttgggcctctgaatccaactgtacaggtgggagcttagcacaatcaagtgtgaaaaagaacttggtgttttagggagttactctcatgtgatattcagaaaatttgtaaagccaatgcaggctgggtgcggtggctcatgcctgtaatcacagcatgttgggaggctaaagcaggaggatcacttgaggccaagagttcaagaccagcctaggcaatatggtgagaccttgtttctaacaaaaacaaaaaacctcagtacaacttcaggttgcattaattgaaattcgttagccagaatatgagaactgagatcccattatgttctgaccagggtgactttacctcattttaatatatgtccatcaaactggagcatgtgtaaagaggaagacaaaagggaaataggtagctaggaaacatgctagtcagaggaatggcttaaagatctgcatgtctattctagagaacacagtatttggaggctgttttcaggtattggagcacttatttagaagggagagcacattatctcaaaaggtagatttaaggccgggcgtggtggctcacgcctgtaataccaacactttgggaggctagggctgggtgtatcacttgaggtcaggaattagagaccagcctggccaacatagtgaaaccccgtctctactaaaaatacaaaaatcacccgcgtatggtcgtgggcacctgtaatcccagctaccaggtggctgaggtgggaggatcacatgagcctaggaaggggaggcttcagtgagctgagattgcaccactgcactccaccctgggcaatagagtgagactccatatcacacacacgcacacatacacatacacacacacacacaaaagtaagactagtagataagtgactttcagtatcttggtaagtctcttaagcatttgagtctagctctagaggaaatagtgagttctctgtcacctgatgagagatgctgtggaggggtttcgggcatctgatgaataaatataacagatgaacagtaacttcttcaaatccagaaattctgagattggtatatgaataaataggtagcttcgaacatgaaccatttgtaatgattctttagttttaatttttttctggtgtattggttaagcatcttatctctcaaatggttaatattacttatactttataaaatatttatttttaaattattctcatagtggtaattgcgtattgttttatctcacaggtagtctcccactattttatatctttgttacttcaagtaagacaatcttaaatatgagaggacatctagagattgtgctaagattgcgtcgtgatggtaattaatgtaactgatagaatgttatcttttccaggtagtaaacctattgatggcaattttgctgactgtggaagtgactcatccaaactccatgccagctgtcaacattcagtatgaagtcatcggtaattactattcgtctgagagaatggctggtatgtgtttaatagaaaaacaaaaaaatctcccctgctaatttttatatacagtcctgtgttgtttaatgatggggacacattctgagaaatgtcactgggtgatattgttgtgtgaacatcatagggtgtacttacacaaacctagatagcgtagcctactatacacctaggcgatgtggtagagactcctaggctaaaacctgtacagcaggttactgtaccgaatactgtaggcagttatcatacagtggcaaataggtgtgtatctaaagatggaaaaatatagtaatactgtaaatacactattacagtgttatggaaccctcatgatatatgcagtccattgttgaccaaaatgttgttggcccatgtctgtctgtctccacacacactggttatttaggggattgattagattatgcttaagttacatttcagaaagttaaaatggttacataataagggtaacaagttaaattatatttaagtcattcttgctgaggcaggaaagtattttgatgggtttttcagagagattcagtgaggattacaatagagcatttctagccagaaaatgtaatggactattaagtttttgagaaatgtgtaaaatgtaccttgaaatcaaaataagcatgcaggcttcataagactttttttttaatgtagctactagtagaaaggagaagttgctatggttacaatatatgtgtccctccaaaattcacatgctggagcttaacctccaaggtgatgatattaagaggtaggacccttgggtggtgattaggccatgagggctctacccttatgaatgggataaatgcctttctttttttttgagacagagttttgcgcttgttgcccaggctggagtgcagtggtgcgatctcggctcagggcaacctctgcctcctgggttcaagcgattctcctgcctcagcctcctgagtagctgggattacaggcacacaccaccacacccggctaattttttgtatttttagagttactccatgttggtcaggttggtctcgaactcccgaccttaggtgatccacccgcctcagcctcccaaagtgctgggattacaggcgtgccacagcgcccagccagcgcccttcatttttaaaatcacatttatattatttatttgtttaaaaaaagttttttagagaaaaggtcttactttgttgtcccaactggagtgcagtggtacagtaatagctcactgtaacccagaattcctgagctcaagtgatcctcccacctcagctgcctgagtagctaaatttttgtggagatcgggtctccctgtctttaccaggctggtcttgagctcccggcttcaagggaccctcccacttcagcctcccaaagtgctgagattacaggcatgagccactgtgcccagcccatagcagactcttgaaagccgattatttgaattacaaattttgctttcaagtttgataatacctgtttaatttcatattttgtttttacctgaattcttctaagtggaagtttgcatgttgtagcagggaagtcctttaaattcttaacatttatcaatcctgtatcctctaagaaaaaagtaaagaggactattcctagtttagtgccaaatattgatgaggttttactgcccagtgataaattatatatacatgctgtgcatggtggctcatgcctgtaatcccatcactttgggaggccgaggcaggtgaatcacttgaggtcaggagtttgagactagcctggctaacatggtgaaatcctgtctctattaaaaatacaaaaattagctgggcttggtggcgcaggcctgcaatcctagctactctggaggctgaggcaaaagaatctcatgaacctgggaggcagaggttgcagtgagctgagattgtgccactgcactccagcctgggtgacagtgagattgtctcaaagaaaaaaaaaaagttgtatatacatttacccaatagggaatattcagcagttgttctagtcattcatcattattagtgccctcagtattttttttcttttttcatttttaaaacatcttttgtgcatacagggtcttgctatattgcccaggttggtcttgaactcctggcctcaagtaattttcccaccttagtctctcagagtactgagattacaggtgtgggttgccgtgcccatcccccccagtttcttaatctctgcccagacggatcacctgatgttgggagtttagaccagcctggccaacatggtgaaacctcgtctctactagaaatacagaaattagctggatgtggtggtgcttgcctataattccagctacttgggaggctgaggcaagagaatcacatgaacctgggaggttgaggttgcagtgagccgagatcgcgccactgcactctagcctgggcgacagagcaagactctgtctcaggaaaagaaagaaaaaactgtccagagtcacagaatcaactacagatttgtgctaagaaattcagtaagtcaggcacggtttagaattgcttgagattacttggctgttttgtgaaaaaattagtgaacatggattaatggagagttggaacaacctgaggaagagttgagaaacgaagaagaaagtagtgtgtgttaacatagataccagggtgcaggaagcaatgaattttggtgtttgggaggttgggtggggaagtgaggttaatggcgaaatttgaatttcaggttatatttatctagagcaaagggtaatgtatgtagcattctgagtttaatacacttgtcttttaagcaattgccagccattccttccagctaaaccctactcataagacccatcttgtgtcatttcttcatattttttcctgatgcttcaggcaaagcaaattgtttctgcctctgttgtagcacttgacacattggattataatgatctgtttgcacatcttcagattcctgggctcataagggcacagggacctgtttctctagcagagaatgtggttcatgtgccatcctacacccatgtcagtgagtcgttggagcgatttaacaaataagtgctttgtgtgaatgtctcaaggttccttacttcatgctgagactttgattttttttttttttttttaccctcttggccttagatctttttatagccaattttgaaaatatttaaatttaatattttaaagctagctttaagtgaagttttgttctttttgttgtgtaagtagcttaattagatttttgtttttgttttcttagataatgcctgtgttctttttgccgtctctgttcttatgtttataatcagttcaatgctggtttatggagcaatttctgtaagtatactgtattttcatcttttagagtttgaccttaggggagcttagtaatttcctatatgtgatacaatgttatggttgttattttttctccagtatcaagtgggttggctgattccattcttctgttaccgactttttgacttcgtcctcagttgcctggttgctattagttctctcacctatttgccaagaatcaaagaatatctggatcaactagtaagtgtgtatgctcattaaacttatttttttttcattttgagtaaaatgtttacatttaaattctgaatcagccttaggtattatttttaactactccgcttgcttttgaaagtgtcttaaaataattatttctgctctcttagctactgtgacaaaactggcaagatgaaagtagagtaatttcttaccatccatttggataatgcagtattaagagttcctagaaatggatattatggaactagtagttcagcttttgtttttgagcatccaaaggtacagtaatttgactgtgtatggcactctttaagtgactagcttattgtctttacagacatctgtagcaagtattccagtgcctactatgtttttagccctttgctaggcactgttggtgaatggtgtggatataaagataactgcgaatattacagtttagcgagcaaactgtaatatttggggagtcaagatacatgaagatgttacctgtgataacaagcgggagctgtcacagcagcagcaaataaggaacttcgattaatgtcatatggaggggggcagggaaaactctgggctgggtggccaaggagggcgtcgtggaggtggtcagaaggagatatgggatctaggtagatgaaaattggcaggagtatcctcagttcatttccaaagtgctgtctttcagaacttttcttcccactaccagatttcctgcctagcccattttccacaccaccaaattcatcattcatttattcagaaaacattcgctggttgctcttatgtgcaaggcactctgctaggtcatagagatgcatcagtggagcttacttcctggtgaaggaatcaggaagttgacagttaactgatacaccattgtaggttactgtgggagtggatatcacatgggtactaaacctgggctgggaagtgagatttgaattgtactcaggagtttgaacaggaattaagatagagaaagtatagaagacaatgttccagataaaagagagaccttgaggcaagaagcagcatagtgagggcactagaagctggccatggtggctggcacacagagggagggtggggaagcctggagaaaggtggccaggggcagggctgttggcctggtcagccacggtcagcggcttctgtgtggctctctgctcatgtcatctccgggggagaaatttcaagtggtgcctccctgccttctgagtaaaacccttagcatagcattccctcatgagctccaccttctgtgtttttctttttgtttatagatgaagatcaaaaaaacagcttttttcccaaggagacaacctggctggggtttggggagtagtgtgttcttaaaattttttttttctatttttttcagtcctttgggatttctgtttatgttgctttttaaatgaaaatgtaattaggccttcttgttgacatttccattaaaaacaagcataacttaaaaaaattaaatcagctttatagaaaagaagataaaaatttattattccttttagagaccctggtgttttctctcctctgttttgttcacttagtgcctcagactggaaggtatttcctctgttggttagtttttaaatctgaaattcttcttttataacacctttctccctgaacttagctcattgccttgtacacagtcagggctgattaagtatttaaatgaatatagctgatgcttttcagtagaacagagtatgtctgcagtaaaacttatgtcttgcctgacattgtaaccagtgggtgtatttttgcccctgtctgatgagagttgagacaaacgattgacatttagaaaaataattttccccttgtagcattaaaatggcccagtttatctgtagaacttacacagaactgagcatctcctgagttaatgatgcaagtgacacagggactgatctccagtgccatataggcgatagtgtttttccaaaggccagaaagatggaaaatagtgaaaagtaaagagaaaacgagctaaatttagactttttggagcattgtgggttatcaaatgtactctaagtgattgttagcatgcattaatggtgataaggcttaaaatttaaaagcactttgaattaaattctgcttatacatttttattaaatatcacttttgactttggtgcctttgtattcttcagatgctcttcaggttatcagcaagtgctagtgcgatggctgacttgtaaatgtgtgtgtgtttctttaatagcctgattttccctacaaagatgacctcctggccttggactccagctgcctcctgttcattgttcttgtgttctttgccttattcatcatttttaaggtacgttgctgactaaatctttaggggtgactgagattgacactgtgaatctaaacctttttgctgcctttcaccttacaagtcacaggagattgaggatttgtggggacagtgtttattctggcacatgagcagagatagcttctagggaatggtttctgttgtgtttccaaggaatggttgtaactgtcaggatccttctctgagtgaaaggacctactttttatgtttttgaaaaggggttcatgatttgtattgaaaatctgttaaaattcccaaggttcacaaacccagaatttcttctgcagcacagtgggttgacctgaattgaagctccatctctggtttctctctgaaatgttggcgatgaaactcatgacacttaaatgagagcaagtagggaaagggcctggcctgtgctgggtccacacagaggtcagctcccttctacacagaggatgtgtggggaaagcattctaagtcactggcattttagagcaggtagtctgttgagtttctagcagatgtcaactttgtttttattcttccaggcttatctaattaactgtgtttggaactgctataaatacatcaacaaccgaaacgtgccggagattgctgtgtaccctgcctttgaagcacctcctcaggttagctactgttggatagagtaaaaggtcaccagtcactattgactgttccaggagaagaacctggagcttgactttctctttcatgctgtaacctatggtttgggcatgaaccctgggtacttttatgaacagcttaaaatccacaggattcaacattttccacttggaatcctgagtacctgggtcgcttgtctcatccagtttggctgttagatttactcattagaggtcctcattagtgtcatgtttgtaggggagatgacaggaaacagctgtgttaggcccatgtagcctggggcttctaaggatggggagttccattgactgaaacttgtgttgttttcagaaaacatccatatgatccaacgggggagctgacctgtctggggagatgaatacagtggtttcatgggtcttttggggaagcctacctttcacagccctctaattgctgctgtgctaccttcccaggttttcagcatataaaatatatgtggcccatctagggccaggctttcagacttggagtcacttcgattagaatgtcactcctccactgcataggtgtgcctgttaccctcgaagacatgatataagttcatgatcttctgactacaaactgattctgatgaaagtcaggatccaggagctagcgtcttattgggtgtttcctattgcatggtttaacccaactcctcaacacctgaagtgtaattggcactggcacttcatcggtcacactggaatgagggcagagcaatggcacccactgcctgcctgtctaggaatccttgtccagaagcaggactctctctccccacctccctctctccaccctccccttcgctagcaatcttggtaaaattccaggttattgaggcatctacttgggaacattttagctaacagtttcttcagctcttctttatggttttgtataaccctatttagggcataaagtctgaaagctgaattatctcacaaaggattttaaaggagaattaaatctgatacaattttttttctctctttagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatact

SEQ ID NO: 35636 - DNA, 6637 bp, Homo sapiens
aggggttacgacccatcagcccttgcgcgccaccgtcccttctctcttcctcggcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaaggtatgtggtcctgggatggaaatgggtgtggggtgaagaaaagagtttccaacagtttctgacatcacctagtcaggattatctttgaccgatgaactggcttgtggaagagctttctgtagaaatacaggtctcccccagtgtgccctagtgctggtacttatgtctcttgatgtgtgaagcgaaactttaatgaaaagggacatttggccgttttgatgtgttcagagggctttgcatttgtgtcctgtattttgggttgccttgtgacagcaggatccctattttatagacaagaaaactcaggtgctgagagcagtgtctgcagctgtgcttgccatctcagtatctacacagtcccctcgcatcccattggtgcctcctccattgcttgggagtggcaatggtgggggtgccttcatccctagtggctaaagccacgagctcctggtttttcccaccaaaaaagtaaggaaatagtgaagtcctgttaccaaaggcaactactgtgtggcatacttccttttcatttggtcctttttttccctccccaaaaggaagagttcgcactctgcacagacgctaacccacctgtgtattatttccttcagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaagtgagttgggtcccacctctagttttcagtgatcagaagtttgcatctgtgtgagcacttctggcaggaactctacaaactcttgggatgcattttggcggggggtgttgtacattctctgagggaatcagaagttgttccttgcaggattttagagaatgcttgttggggaattcaaggtgtttcctttgctgaaggaggtgacttggtcttctaagtgtagagacccaagaccaggaaaagactgctttgtgaacactgcaataatagccactttccactactacaatatcctttggctgttgtttccaaaatgttgctttctttatgaaggtgtcaagcaaaagagttgaactctgaaatattcgaagagatttattctgagccaaatatgagttgaccatggcccgtgacacagcccttgggagaccctaagaatatgtgtccaaggtgggcggggagcagcttggttttacatattttagggagacatgagacatcaatcaaatacacataaggcatacattggtttggtccagaaaggcggcacttcgaggttttggatagattttctgtttctcgtcgagaattggttatcactagaaaggaatgtcttggctacagtaagaggttgtggaaaccaagagtgccctattcaaggagggagtgcattcagatggttgctgggggcctttgaattttatttttggcttacaagcgggagaaggtcaaacatggacctcagaccttaaggggctcttaagtctgtgctgtggtaaggggtatcttcaggggcaggagggctctggaaagtttgcattagatggagaacaggaggaaacttggcaggcagagagtgcttacacaaaggtgtagaggtgaaagcacatggagggtttgcagggcattggttccaggtgggttttattggtttttgttttttaagatgaagtcttgctctcttgccggggctggagtgcagtggcatgacttcggctcactgcaacctccaccgcccagtttcaggcgtttcttctgcctcaccctcccaagagctgggattacaggcgtgcaccaccattcctggctaatttttgtatttttagtacagatgaggtttcaccatgttggccaggctggttttgaactcatgaccttaagcggtctgcctgccttagcctcccaaaatgctgggattacaggcatgagctactatgcctggcctggtttgattttagagatagacaggctctgtgttgccctggctacagtgcagtggctgttcacagctgtgatcatggcacaccgcagccccaaactcaaggtgggctcaagctgtcttcctatctcagccttcctggtagctaggaccacaggcacactccaccacacccagctagttctaggtgttttgagtaagttagacacttggtgagctttgtgtataaaagactcagtgacctgcttagattaaaactagggcagtggaatgaaaaattctcatgggaagtgacagtttattttcttcacttactggtaaatgaaagccaaaaagctgaattttcctaagtaaactagaaagaacatggagtgtgtgtgactaactaggatgtttgtgtttacgtttacaaagataactttcacctacagtggttgtagatacaagtaataaaaatgaacaagaccagtattctaacgtggttaccttccaagattggaaatttaaccaggcgttgaaatgctgaaaatttctgttagaaaagatgggcgaaggaattaatggtggatactgaaaccacagttggctgtatgagttgaactgtaacaggcaatacctgttgtatggccaacatgattactcagttgcagtgcacatgttggctggttggcatatgctctgtaagcgcagcttggcagtctttaagatccatagaaatactctttgacgtttgatctctaagttccatttctgggcatttgtccttaaggaatggaaaagcaggcaaactaaagctagtcattgcagcaataacccactggaaacaactgaaaatataatgagagaattgtagagtgctggataaaatgttgtgggtccactcaaaatgattcgagtgttgtagtgtggaaaatgcccaagccaggggggacacatttaaaatggtgggtacactctgattgtgattatcaaatatatagatggacaaggacaggagggttttttgaaaagtaaagacagatgagaagtgtaatataacctaagtctttaaaacgtagaaacatttaaaaatacaattgctttgaatttgagtggactcatataaaacaagaattgtctggatttgctgtcttgctgttaaggcagggttcttgaaaagagctgtgtgtccactgcctcaatcactcctcacagtcctgctgcttctctctttgctgaaaatgctttaggggtggaatgtctgttcttaaccactgtgggtggcttcataaatcacctccttactgaagtgtgcttgttaggcctattggttatcaaatggggcacagtgtagctgcctcttaaaaagttgtgaggaatgagttagaactggatctgaagtcctcaggtaataggcatggctatgactgggtgactttaagcattgttgcttctcaacttgctttgtatcctcagcagtcaaaccaggtgctcttggctccattcagactcttgggttctgctcttgaccattttgcaaagagttctgaaccttcatgggcaaggtcaagcaccctgtgactgggggagaacctttgaacctggagtgtgggcctgggttcgccccggatccctgtccattgcttgctgtgggccttggtttctttatctgtaaaatggaggtaatgcctggattacaaggctgctataaggatgagaggggacaatgagggtactttttaatgaaagcattcttgtcaccaccagggaaccatagtcaggatttgggggcatgtaggtgtcattccacagccacttaccaagcagccctctcttagcttggtgctgggactcattgcctctccaatggaattttccaagtgtgttgagggctgtcttgctccttacctacttgattctcttgcagatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtc

SEQ ID NO: 35637 - DNA, 27198 bp, Homo sapiens
ctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggtgggcacaggaccgaagggaacggctcccccagctccgctgggccgggaccgggccgcattctatccaaccccatcccgccgccgctgcaggtccgccggcctcgggcggacgggagtgtgatgggaagagggataatggtgtttgatggggcgatcgtggggcccgcgaagtgtggaggggatctgttgcctcagctagtttcaaagactgcgaccctgttttgaattggcttgtttatgttgcgacggtggctggaagccaggccaacccagggtcagctttcccaaatcagtcgccaaggcccacgagaacagtagtttcagaactcccagaaataggttcaaagatgcctgtcctgtaccagtcctgcccagcctcgtttttccttaccaccctgactgcagtcttaactcctgcaaactaatttgatcgctctaagtttaaccgcgcccagaatttcacttttgcttgcttggcctttgctgtgggtcacaacagcccttcttgccttcctcatcttcgtggggcccaggagagattacagaatcatagagtttggatctgaaaggaatcttagaaattccttctcttaccctctcgttttacagtaatgacccagtaagagaaatgacctgttgcatacaaaggctttcacttaccgaacatgtctttactgggtaagaatcagtgtaactcactcaggtgtggtgtttcggttgccttgttaagatcagacacagttggcgggcgcggtggctcacgcctgtaatcccagcactttgggaggccaaggcgggcggatcacgaggtcaagaggtagagaccatcctaacacggtgaaaccccgtctctactaaaaatacaaaaaaatgagctgggcgtggtggcgggtgcctgtagtcccagctactcgggaggctgaggcaggagaatggcatgaacccgggaggcggagcttgcagtgagctgagatcgtgccactgcactccagcctgggcgacagagtgagactctgtctaaaaaaaaaaaaaaaaaaaaattcaggcacagtaaccgctgtttattccagtgaagtcatcagtgtctgtaaacacctttgtatttatttatttgactacatcatttgtaaattccttgaagattgaatatgtgcttcgtgcagacctttaaaaggggtagataagtggtccatgactctggtccctgcttgttctttaccttcagggcaaagagtcagacacatctcattgctaaaacttttgactagcacctggtacttggcttaggaaaaatgttagtcattgcaaaattaagggggaaggtaaaaaaattccgtcatgcccatctcacttgtatatcccttaatattaatacctggttttttcatataatgtaaattgagtcactcagtgtaaagtattttcccagataactaggggttttatgtaatggggttttcaaataaaaaggattccagggatatctttataaaatatactaagtaaatgtccttgcagcttaatttacattccacagtatctaaatttctcttgatgattcggagtaattaattttgagatcagtaatttttggccatgggagacataaaatggaatacataataatagctggtatatattgagtgtgccaggccctggcttggtattttaagtacattgtttaatttaatcctaacaacaaccctatgaagaaggcataattatgatcttcattttacaaataaggacactcaggcacatagaggtgttgagtgatttgcccagggaggaccccacacttccaacctccaccctgttctgcttctggggtgctgactccagcagtaattttggaatttgccataaaggaaaataaaaaacctcaatgaaggctgggtgcagtggctcatgcctgtaatcccagcactttgggagagcgaggtgggcagatcacctgaggttagcagttcgagaccagcctggccaacatggcaaaactctgctctactaaaaatacaaaaattagctgggcatggtggcgggcacctgtaatcccagctacttgggaggctgaggcaggaaaatcacttgaacccatgaggtggaggttgcagggagccgagatcatgccactgcattccagcttgggtgacagagtgagactttgtccaaaaaaaaaaaaaaaccctcaatgaattaaattcagtttgatcacttgatacatttatgctatatgtaaagaagatggtaagtactttggggatactgggataaacaagatgaggttccctcccttcaccaacttatatcaactctaatatacaatggacctggggttagtgtgctattgaaatataaatcaccctgagagcaccctgggaggtagaggtttttaaaggtagcattagtggaatggggtatgcacagggtatttggagcctgaagacctgcatttgaatccccacttctgttgttggctgcagtgaccttgccagggcacttgggctcagtttgtagaaggagcataaagatatctcagagagctgctatgaggataaaatgacatgtattatgttctctaaactatgaagagtgatacaattcaaggttgtatttcagctgtggggatcagggcacacatcaaaaagatggtggtgatgggcctatgccttgatagattgggtaggattccagcagagtacatgggaaggcattctgatgaaggaaacatcttagcaaaaatgtgttttgatacggggggaacccaccccaatatttcaacgtaggttctttctattttccataagtattggccagctgagaaataaagagtacaaagagaggaattttacagctgggctgccggggggtgacatcacatatcagtaggactgtgatgcccacctgagtcttagaccagcaagtttttattaagggtttcaaaaggggagggggtgtaagaacagggagtaggtacaaagatcacatgcttcaaagggcaaaaagcagaactactaataagggtctaacaaagatcacaaggcaaagggcaaaagcagaactactgataagggtccaacaaagatcacaaggcaaagggcaaaagcagaactactgataagggtctatgttcagcagtgcacgtattgtcttgataaacatcttaaacaacagaaaacagggttcgagagcagagaagcggtctgaccacaaatttactagggtgaagttttttccccaccctagtaagcctgagggtactgcaggagacgagggcgtatctcagtccttatctcaacctcataagacagacattcccagagcgggcgtttatagacctccccccaggaatgcgttcctttcccagggtattaatattaatattccttgctaggaaaataatttagcaatatctctcctacttgcacgtccgtttataggctctctgcaagaagaaaaatatggctctttttgtccgacccctcaggcagtcagaccttatggttgtcttcccttgttccctaaaatcgctgtttttctgttgtttttcaaggtgcgccgatttcatattgttcaaacacagttttacaatcaatttgtacagttaacacaattatctcagtggtcctgaggtgatgtacatcctcagcttacgaagataacaggattaagagattaaagacaggcataagaaattataaaagtattatttgggaactgataaatgtccatattaaaatgaaatcttcacaatttatgttcctctgccacagctccagctggtccctccattcggggtccctgacttcccacaacagttttaggatggtagaattgcaatgcagggcaggtactggagagttagttaaatgttattggttgcagttcaggttatctaagcagtggtggaagaggctaacatggtaggttggggccagattgtggagacagctttgagtgtcacatctaaggaagttagattttatatacatagtggggaatgagtcagggttttgaagtattctataaagtagattggagggatccaagtctggaggtgattaggccacttaaaaagctcttccagaaggtgagataagtgatatgagggtctcgtttgtaaagaagacagcagcaatggcacaaagtcgacttgttttttgatcatttgcatcttcattataaaggaagtccagagaatgtatggctatgtcacattttgggcaatctctctgggctaactttctttaaaaggtcagattctcctggcaacagagagagactccgtctcaaaaaaaaaaaaaaaaaaaaggtcaggttctccttccaagtagtgatctggagatcttttcttttttactatctgtatctgtctccactaatacagtagacaatgtcctcagtgttgccattatttctaccaccactgccaatgtccattttcacatcgttccatatataaatatatgaatatataaaaatataaaaaattaatatatattaatatataaatatatctataaatatatgaatatatatatatatgatggggtccctctccaatcaggtagattggtggaattgaatgcagtagaaaggagaatagggaatggaaaggaggaaggaagaaggacaatggccagataaatggctgactattcaaggcatagagaatcataatatatataaaggcataatgacatcagagaactgaggcagggacctacgggtaacacagtgaatgaagttataagcagtgggacttgagggaagggtgaccaaaacaatcattagggtactcaaagaaaagatgagaattcccattatattcatttgtttttctcaccctgtaatggttgctatttaagtgataagggtatgaaatagaaaatgtttgagatgaccggtttaggggagtggtgataaccgttggtgttagagaagtatgcagctacatatgtggttgcttttgggactgtctctcaaatgtgttgaggaaccactgaagtattgatttttaagccaaaaatgacatgacagggttttctttatggaaagatcactccaaattgcatgtagataagcctatgaaaagcaaagagataattgtctaggcaggaagtagtgaggacttcttgctttcctcaagatacactgaaggcagttgaaaagctcatttttaaaagtctggtgaaaaccactttgttcacttttgttttgtgggagatgtgacacctagtaataaagagttaacaaaccctttccccttttatgaaaatttgacttttcgttaactccctagtttcccagaaaacaatgaaaaattgtgtttgttgcttatggtaaaaataacccaattggtaaattgcatctggagagggagaattgtaaatacttgaaaggaagccatagctttggacttccctgattgtagtgactcttataactgtcccttgtggaaattctagaagttctgcctatggagttgctactagagatactggctcctgtggtacatggggccttctgccctagggtgattctcattcatatccagtgtgaatcttctccctgtacctgatctgtgtcgactcctgtaaggactcccactgaagaggaacacctgatacttctttgttggcaatctgtgttttcctaacagataccgttttgagtaaactggcaccatgtatggcctatggctatggttgtcttataagtctggatgtttagttgagccttaagaagactttctgggccaggcccggtggctcacgtctgtaatcccagcactttgggagaccaaggtgggtggatcatgaggtcaggagttcgagaccagcctaaccaacatggtgaaaccctgtgtctactaaaaatacaaaaaaattagccagacatggtggcgcgtgcctgtaatcccagctactcagggggctgaggcaggagaatagcctgggaggcagaggttgcagtgagccgagatcgtgccattgcactccagcctgggcaacagagtgagactccatctcaaaaaaaaaaaaaaaagaagaaggctttctgttgggggcaatataacacttttgaaagttatttgagagacaaagtagatagtctctaaagggaattggtctcagtcttattaaggtcgaaagacaacattttttaaaccagagaaattttttaatttctgaaaatatggctaatgcaagtgtggaacttctcctttctgcagactgagggtaataaaggtgctatggtctgaatgtttgtgtcccctcaaaattcatgtgttgaaatcctaatccctgaggcaggtattaggaggtggggcctttcagaaagtgattaggtaggtcatgaggacaaagtcttcatgattaggattagcatcctataaaagagactgtaaagaatgatcaagcccttctgccatgtgaggtcacagtgcaaaggtaccatctatgaggacagacactaaatctccaagtgccttgatcttggacttcctagcctccaaacctgtgagaaataaatgtctgttgtttataagccacccagtttatggaatttttgttacagcagcctaaatggactaagataagaggcaatggagattttaactttaagatgtaacctcttacaaagctctctagtaatacttctagagaaataagtatcttcatcactagaagcaaatttgagattttgtagggagaaaacacaaagtcaaacaacgtttttatcattgttgtagctttttgaccagttttgattcatcctgaaaatagacatattgtaaccaaatacactcatatcccattgtgggaggcagttgtataaaattcatttagagactctgcttctgacaagatgaagtagacatacttttccttattcctcctgctaagtacaactaaaaactctggacatgatatataagacaaacattggaagactctgaaaggtggtgagaagaaggtagactggctagggaccttgagaccctaggaacaacaaggcaatgagtttcctaagttttctttttgcctcatattgcccagacttgaagctgaagaagctagtaacctggaaatgctgatggacacagaccaaaaaaaagcctaatgaaagcctgctctctagccacaggacctggaaatgggcagcatttcctggcaagaaagaaaacttttagacaataactgctctactccaactaaactccatagagaaaactgtggcctcagtcccacccatgccagcaaaagctgagtggggagcctagattttcacccaaccagatgtaatgagctgcccagccttcccctgccaaggtgatgtgggggaaggctgggtagggagccaggactttcatcctgccaggctttcccctcttgccatatcaatggagacacatgaggaacctaaaattccaccccaacccagcagtggaaatatttaagataattataagcgggagaaggtacaggaatgtaaagagaggtgaggtttctgtaccttgttcaaactaataaaatgatgtcaccaaatgactgataagttatgtgtgtgtgtgtatacatatacatgggtatatgtatatacatatatacatgtatgtctgtatatatgtgtatgcgtatatgtatatatatgccatatgtatatacatatatagtaacacctagagccaccatttaaaaagctatacaaagagatacatgcaaaaacactacagataaatgaaaattgaattttaaaaagttccagtgacccagagaaaggcaaaaagaagacagaaaacattaaaaaaggaagaacaaacagaaaacaaacatgaataaaatggccaacttaagccctaacatttcagtacttacattagatacaaatacattaagagacaatgattgatagaatggattaaaaaacatgccccagctgtatgctgtctacatgaaactcacttccaatatgatagagacaaggtaaaagtaaaagggtagaaaagataattcatgcagatattcatcaaaagaaagcaggagtggctatcttgatatcagataaagtagactttggggcaaagaaaattaccagacataagaagtacattatacagtgataaaagagttgtgattgaccaagatgacacagtaatcataaatatatgttactaaacagcagagctagggaacacatgaagcaaaactgatataactgaaaggagaaatagaaaaatctaaaattatagttggagacctcaacactgctctttttttttttgagatagggtgtcactcctgtcacccaggctggagtgcagtggtgccgtctcagctcactacaatctctgcttcccgggttcaagggctcctcctacctcagcctcccaaggagctggggctacatgtgtacactaccacacccagctaatttttctattttttgtagaaatggggtctcactatcttgcctaggctggtcttgaactctggggctcaagcaatccagccacctcggcctcccaaagtgctgggattacaagcatgagccaccaagcccagccaacgctcctctttcaacaattgatagaactagacagaaaattaacaaggaaacagaagaactcagcaataccatcaacaaataagatctaattagtatttatagaatgttctaccgaacaacaacagaattcccctttttttttccaagtgtctgtagaaaatataccaaagtagaccatgccctgggtcctaaagccaacttcagcaaatttaaaagaatggaatgatgtattcttcagcaacagtggaattaaactagaaatcagtagcagaaacataataagaacatcttcaagcactgggaaaataaacagcacacttctaaataaataatccatggattacaaaggaagtcttgggaactttttaaaaatattttgagctgaggccgggtgcagtggctcacgcctgtaatcccagcactttgggaggctgaggcaggcggatcacgaggtcaggagatcgagaccatcctggctaacatggtgaaaccccgtctctactaaaaacacaaaaaattagccaggcgtggtggcgggcacctgtagtcccagctactcgggaggctgaagcaggagaatggcgtgaacccgggaggcggagcttgcagtgagccgagatcgctccactgcactccagcctgggtgacagagctagactctgtctcaaaacaaaacaaaacaaaacaaatatatatatatatatatatagagagagagagagagagagagagagagctgaatgaaaatgaaaaagggatcatagctaaacagtgcaaagggggaaatgtatagcactgactgcatacattataaaagaggaaaagtctcaaattaataacgtaagcttcctcctaagaaactagaaaatgaaaagcaaagtaaacccaaaggaagcagaaggaaggaattagagaagcagaaattaatgaaattaagaacagaaaatcagtaaaacagagctggttctttgaaaagaccagtagaatagacaaacctgtagcaagactgacaatgaaaacaaagaagcacaaactaccaatatcaggaatgaaataggggatacactacagacctttctgacataagaaagataagggaatactaaaaacaactttgtatacataaatttgacaacttgaattggaccaattcctcatccaatatgaactaatatgatgagtcctataacttaaggcaattgaatttatgattaacaaacttccaaagaagatttgtccagacccaggtgatttcactggagaattctgccaaatgtaaaagaagaattaacatcaattatacacaaccccttccagaaaactgaagacgggagaacacttcccaattcatttgataaagctaatattaccctgataccaaaaacaaatgaagacagtacaagaaaactacagaccaatatctccaatgaatataaatgtaaaaacccttgacaaaatgttagtaaacagaattcaacagtatatatagaaagaattatacaccttaaccaagtgaggtttatatctaggatgcaagcctggttcagtatacaaaaatcagtcagtataatccaccatattaagagggtaaagaagaatcacatgatcatatcagttggtacagaaaaggcatttgacaaaattcaacactcattcattattttttttaagttcagaaaaaaataggaatgggggcatttctttaacttgataaagagcttctcttgaaaagttagagctaatattacactcagtggtgatgctttctccctaattttggtaataagacaaggatgtctgctgttaccactcttatttgacaaagtgctgaaagttctagacagtgcagtaaagcaagaaaaggaaataagagacatataggttggaaaggaagaaatcaaactgtccttatttgaagatgacatgattgtctacatagggaataataagtaatttacagaaaactcccagaattcataaatgagttcagcaaggttgcagggtacaaaataaacatacagaaatcaatcgcgtttctatatactagcaaagaacacacaggcaccaaaaattaaaaaatacattaccatttacaattgcccaataaaatgaaatacttagatataaatctaataaacatttacaggacacatatgctgaaaacagcaatggcgatgcaaaaagtcatagatctaaataaatggagagatttattgtgttcatgattggaagactcagcacagtaaggatatcaattctccccaaatcaatatacatgtttaacacactccttatcaaacttttttagacagagacagggttattctagattgaaaggcaaaaaaactagaataacaaaccattttggaaaagaataaagtgggaagaatttttctacctgattttaagacttacatagctacagtaatcactactctgtggtattggcagagagatagaacattgaaacaaaatagagaaccccaaaatatacccacactagtatgcccaacagctttttgacaaagatgaaaaagcagttcaccagagggaggatagcctcaacaaatggtgctgaagcaattggacatccttaggttaaaaatgaagctctactcaattctcatcccttataccaaaaaaaaaaaaatccatttactggtgcttaaaggggccttaatcctttggttcacatccttgcctcacttttacagttttgtaaggattgtattgtaggcaggtaggacatgcactagaaacatccttgattgtacctttaaagttttcttggcggttgcggtggctcacacctgtaatcccagcactttgggaggtcaaggcgggtggaccacaagttcaggagtttgagatcagcctggccaatgtggtgaaaccctttctctactaaaaatataaaaattagctgggcgtggtggctggtgcctgtagtcccagctactcaggaggctgaggcaggagaatcgcttgaagctcgggaggcggagcttgcagtgagccaagattgcgccactgcactccagcctgggtgacagagcgagactccatcttaaaaaaaaaaaaagttttcttacagtagttttcttaattaaatttggagaatgacacttcccctccccccgaaaaaaaccttattatttctattgtccaccttttgataaggcacaggagcaaatctttgtcacccagtagccatccctgtaaaaccaaagatagtttaggcataaaagacaccttatttttattgttctaaatttaaagcatgataagggaaagacaaaattaaggactatcaggtgagacaagacatgagcatagcataagtcttactttttaaaacaggagatacatgtattttaaacgatattttagaaccataccaataaagcaataatttttaggaacttaactttttaaaacaggaactttttctcaagatcatgcaagtgttcacaagaggcacatggagttaacagactattttggtgataaaaataaaactgttatctgagcatagaataacttgatcattttcttaaaaataagcccttcttgtttttatatccatttaacaatttgtagcaaaggatttataagcctctattttatcaataaattcactaacgttgaatatatcttactttttttgccacgtatagactttttaaagtgaattttaatattctttatgtgtatgtgtttaggcagatacagtacatagttctcttaataataaagttaaagtctgtaacattaattttaagatataattaatctcaatagcatattaagtggtatttgttttcatatgcatgtgtgtgtgtatatatatataatgtttttaaaagctaatataccattttatatattcccatgccattagacttagtataccatctgtatatatctccatgccatttaatatacctcgacgcagcattttaaatgtttttcataatattcttttatgcctgtgtcatactatctaactattcctttgttagaggcagttagtggtttaaaagcaaggactttggaatcagattgcttgggccagaattttttctctgccacttactttctcagcagtaaaatggggatgataataatatgtatctcatgggcttgttgtgaagattacatgtattagtttctttgaatctcttagaacagcatctggcacatagttattgtgtaagtgttgtgatggatgcctttgtacataaatctttgtcagagtaattatttccttagaattttagaaagagaacatcttggtcaaagaatatgaattcttaggccaaggcaggcggatcacgaggtcaagagatcgagaccatcctggccaacatggtgaaactctgtctctactaaaaatacaaaaattagccgggctgggtggcgggcgcctgtagtcccagctactcgggaggctgaggcaggagaatcgcttgaacccgggaggcgggttgcagtgagccaagatctcactgctgcactctagcctggaaacagagggagactctatctcaaaaaaaaagaaaagaatattaattcgtgcaccaccactactggctgattttttgtatttttagtagagacggggtttcaccatgttgatcagtctgtttctcgagctcctgacctcgtgatccgcccgtctcagccccccaaagtgctgggattacaggcgtgagccactgcacctggccaagaatatgaattcttgaggactcttgatattccagttgttttccagaaagattgtaagataaggatatgatagactatgggatagaatagttaaggttgtctaactttggcaagtacttggcatggcatctacaacaaaaaatacatgctgtgcctaagatatatggatttgagtatagcctgtatagtgtgaacagaagtaatgataaagtcgttggtaaagtaccaatactaatgttggtactagaaagatgttgaagaaacaaaacataaacagggtcactacaaagcagattttaaaagatagtttttagattttatccttttttaaaaaaactgagcaacaaataatgttgggtgcagcttggttggaaatatattatctcataattccataggctagaggtccgacttgggtctgtcccactgtattgacaggactgtgttccttactcagaggctctggggaagaatctgcatctaaatccatttagattgttccctgaattcagtttctttccactgtcggacaggggtcccagcttccttgctggctgtcaggcgtggatgggtatggtggggtgggagcagagggcagctgcctttaactcctggcacatgtgccccatgtctcagagccagcacctgcaggttggccccttctcacacttggaatctgtcccacttccctttatgccacactcctcttctactttctttgcgcgcgcacgctcgctctctctctctcctgcttttaaggtcttgtgtgattacattgaatccacctcagtaatccaggctaatcccattttaaagtccactgatgagtgaccttaatttcctctcagagtctctcacagcagcacctaggttagtgtttgagagaataaggaaggacatctttagaatttagtccttgcttgcacctccctccagggactgcagtgctccctcctgagactgagaaccagtgctgggaggacagatctcccccatgaggcctgccagctaaagtctgtgtgattgtgtgtggtcgggcctgacagatcatacataagactttgtcctgcaggtggcttcctcaagcaaacattgtaatcaatagagaagcagctaccactcatattagctgggaaagaaggatgtttgttattttggtagtgttcatagtgccttgttttaatgtatacttagaccggaatatgaagtggacatggtcttgctgctttaaattttttttttttattttggtatcacatcatggcagccacagagtgactttatatatgttcaacaggagaaaaccaaggcccagctgtgagtaccaggccagcacttggatgtgcagagctacttttctctttctcagctgcttgataaaatcgagacctttaggactgtagcatctgactgagaaaagcaacccaaatgttctagaaacatgtaacctgcctggcatgtgattataagctgcgaataaagaatttaattattatatttattaagatcagttttaataagataaagtagtttttaggctagttttgttttaaatgagaattttaatgcctaaaagagtatgtttcatttacttaaaatttagcaaaagagaaaaatataatttcctaatgaggctgaatgaactatatttgtattttatatgatgtgagttatataggagaaagatggcatgtggctccaaagtaagtggtcagaattttcaggcctgttttgtcaagccatgggtttaacagaaaaaaaaaaaaaatctgttaggaagcaccagtgaggttcacagacttatggtctggaaggtacataccaatggtaaagggagaccaaaacttagaggccttaaacagttaattactcagtgtcagcttctcatctacaacatggggtatgaatatcgacagtaataccatatagagttattacacctagttaagtcctaagtagaattattaatgctattaataatcttaactccatgaatttacataccttctacccttttctcagtcaagccttctgtttcctgataagtaagttgaatttcccaaaggtgttagcaacagtaactttttacccttttagttatttaggagtctaggatcttgtgagtaactctttgctaatttgcgtggtcaccagtaaatggttctagaagggcatttatgccttcattcaacaaatattgtagtgatcaacctctttatgtgtaaaatcagtgtcttagtttgggtagccccaaagcagactagagagaatggtgtggttttaagtttttgagaagtggtcacagagagctctgcagagttagggagagagggtgatcataggtgtatacgagtggattaccactgtgggcaactgaggttcaatcctgctggggattctttgagggactttgtggtacctgcctctgaattgtcccaccaagggacagggatgccaggttttttatcgaccattggttgaaggtcattcctgcagtggaaactttctgacactttggacttgcatcacacaggggcctgcaaccagaagataccactgagcagagagcccttgcaagttgtaggtggtaggttaacaattgtgtttgtatcttgttacagaaagcacaattaatgttggtaataaatggtaaaagtgaaagatgtttaatataaatatttttccataggattttctattgcagcagaccatgctacgagtgaaggatcctaagaagtcactggatttttatactagagttcttggaatgacgtaagtcaagtacttattggcaccttaatgtttaaatatatagctttgcaaatctagagagtgttttcagacccatcttaaagtttgtttcagaagtaacagaagttcttttggccaggagtctgtgattaggcctggctggacagggcttctctcgtaagttctttttcttctctatcccagccagcctgaaagggcaaaacaagacacaaatagttgcattttctccagtctgccttctctgagcgctcccagctaaatccttaatgtgttcagaccccttttgatgttctggccacttttagcctcttgtttacttcagaaaagttatagataataagaacttactactcagaaaaccaatgggtttacttaaaactgaccatctgttctatttttctaggctgtgttttcttttgctcaacaggtcatatccactgatcttgcaatcctaaagcatacttatttttctaaagcatgtttatttttctttttttctccagctttactgaggtatattgagaaataattttgtcatattgttgatttgtttccctaagttatgtgagcattttgcttttgagcatatagatacatgaataataaaataatctttaaatttagtgcctagataacttccattcacattgagagaaaaatttaagtaatatatgtctatatttagaaaatttgaccagttcagaaaaatacaaaatgaaaagtaatagcttccctccccaagttcttctccccagagataactgctgtccagtttcttgtgatttttttctagaaaaaggtattatgaatatatttatgacatatttaaaggacaaaatgaaaacagatttattgaacacttttgccaggcacttcaaatgttattttgttcagtcttcacaccagtcttaggaggtagcttttatccccatttcacagacggagaaaccaaagcttaatgagatgaagttactagctccaaatcccacagttggcatatggcagggctggaacctgtatccattgtctgatgggctctaatgtagacttcctgtgcagagcccccaaatagggtacaagttgacagtaagctggaagatttgaacagctgagaaaagcaagttgcaacagtttcatttccttcagtcccaactgattggtccatgagggttgtgtagtctgctttagtaggtgcagagattgtttttcatgattggagtatttgaggtgtttgatactttattataaacatgttagagtaaatcttatttgtgataagtcaatgcaaggatctaagtgggccaaggtctattatatagcagtgataatgaaataaaagattggaagcagaactctagaaactttccatttgctatatggcaataacagccatttgctcttattgattatgaacaaagtcatctttgaataatctaaagaaaatcatatatgcattctcatgccaccttactccttgccaaataatcctataccatttaaagtcatttaaggttcaggacttcagttatctttcttaaaacctcaggattcataattcattcactctctctcccatcagtctcttctactgtctctttcccctcagagaagcgtaagtcttctttgttccagaatatttcttgccctctgctccttcgcctacctccccattgtcactgccatgcttgctactgttttacctgctcacctgccattctctctccccagtacagtgtaatccagctgatgcttccccactctgctgacattgctctcatgggacctttccatatctcatgaccttttcttagtcttaatactgtttgacctttctacagtatctgatactgttagccaccttactgttgacattcacgtcttctgtgatactagtctgtccttcctccttctttcttaccacctatccttaatttcctttcctagatgttttggcatagtaagaactcaataaatgtgtttatttaactgaatgacatatttatatatgtgtttgtatgtgtgtatatatatgaaatagcaacaaggttctttatatttttcagtacaaataaacacagttctcttttggagatagccgtttctatttattaacaagtaccataatttcagctaaatgttactatatttacagaattgatgaattacagaagttttcatttttgtatttcaaatatttacagatgcatttttcatgatattttttcactgatttttcctcctgcttattccattaaaataggcttactacatatagctcttctttttagtaaaacttgaatattaagttatgttgattatagtatgaattagcctttcctgttgttaatgattcaggcttgttgttttttcattgcaggctaatccaaaaatgtgattttcccattatgaagttttcactctacttcttggcttatgaggataaaaatgacatccctaaagaaaaagatgaaaaaatagcctgggcgctctccagaaaagctacacttgagctgacacagtgagtatgagtttctatatttatatatattatagattttttaaggtagtttttaaaaatcttttttgttttgtttactgaccagtataattcaaaccagatctgcctatgacttcacatttttaataatatattgaagtgtttttcatgcatcttttgatctttgtattgttcttgggcaaatgagatgtgttttttttagagacaggctctctgaagcctctaacttctaggtagtcttcctgcctcagcctcctgagcaccttggactacacatgtgtgccaccacacccagctagtttttgtttgtttgtttttggtagaggcatagaggcaaggtctcactatgttgcccaggctggtctcaaactcctggcctcaagtgatccgcccgcctcggcctcccagactgctgggattataagcatgagccaccacgcctggcccatttgtcttttatttttatttatttatttatttattttttgagacagagtcttgctctgttgcccaggctggagtgcagtggcgcgatctcggctcactgcaagctctgcctcccggattcactccattctcctgcctcagcctcccaagtagctgggactacaggcgcccgccactacgcccagctaattttttgtattttttgtagagacggggtttcaccatgttagccaggatggtctcgatctcctgacctcgtgatctgtctgcctcggccgcccaaagtgctgggattacaggcgtgacccaccacgcccggcctccatttgtcttttagataagagaatataagaccctgaaattgtaagatatttgcctgtttgtctctaactaatttttaggtactataattagtctttcagcatccaaaattttgttcttttattattttgctacattttggatccagaaatgtgatatcatgtgttcctttaaaaattcttcaaaccattttgtaataattaacattcaaatttggtatttttataacttgagcacttaaaaatgtaggcaatttctttacattgtttatctgcatactttaaaagagattgatttcagagtgtgtgatttcgtgtgtcccttgattcaaaataaagctttggaatcaggcaggcttagatatgagtctgtgactctaaacaagtaagtggcagtttcatcaatagaatggagatgttcacacctagcccatggagctgttttaagggtttaaatgaaatataaagtacttagcacaataaatgagcattattattattcttattattgttcttgtccagtacctgtatttactgtctctttagtctcgttaaaatcatactttggccatttgtcctttctatagttgaaaacttaatatttttgtagcaggggttaggccaattatgtaaagtagcatataaacgtggtaagatttcaaagatgttacttgcttttcagaatatctattccctaggacattgtagctatgttttccttccttttgtagcaattggggcactgaagatgatgagacccagagttaccacaatggcaattcagaccctcgaggattcggtaagtttgcctgtttttatgtgatatatgtagatttgtgtgattttgtattatgtatataattatgattttaataaacctaaaacattaatgtcctaattaagtatgatcaatttattagagatatgattatttttattttccacaaataatcttatttaggagttgtttaatttcagagtctcgatctaaaattacacttaccatctcaccatgatttacttttaagtctcagaattaatttccagtagacttttttttttaaaaaagctgtagttaatactaatcccagtttctgctagcacatacacttctgccttgatctccagtctctcaatcaagatgacagtattgcaggcttcagctggctgctatagtcaatgccaaccacaaacctattaagtattagtaaatgattactgttttttggtgtcgattattcttaactgattagactgtatatgagctgatattgattaattttaaataatttataattcaaggcaactaattaactacttatacccagcccattagatctatatttgttctttaatgtattatagattttgaacctacctaagtctgttcccaagtgccttatgttttgaaataaacaagttttggaatctacttgtggtacttggacaccctgttataattatttcttccttctctctgcttttttcggggggtatcacgtaaggtcatattggaattgctgttcctgatgtatacagtgcttgtaaaaggtttgaagaactgggagtcaaatttgtgaagaaacctgatgatggtgagtctactacttactgtgttcaggcctgtctttagttgatatttactaaccacctacagaggccactgttgtagtaaaacccttttggctacaagtaacagaagtctccacttcaaccagagttttaaaaaagagaaatgattggaagaatatctgggtattttagggaactgaaagacagcaactagggtggctttccaaggcactagacacaggacctggacagccatcaaaaccctacgcttcctctcccactgcccgaccccaccactttctttcattggccaccagctttcactatttcagtgtatatctttccgcccaaaaataagttccttaaagtccattttatctgatgctcatataatgacaccagctctctttagtttataatcacatggtatttctttttcatcttttataacctttgtatgtccttaagttttaggtaggttttttgaaatagcctacgtatggattttgctgggtttacatgtattgttattattttacttagatctctttctgaactatttcaaattaaaattgaaatattaaatatttcagagtctcaatctaaacatttgaaatatttcactgtttaatttcaatccttttttaaaaaaattaaaatacttaatatccagtgctgggcgtggtggctcacacctgtcatcccaacactttgggaggccaaggcgggcggatcacgaggtcaggagatccagaccatctgggctaacatggtgaaaccctgtctctaccaaaaatagaaaaaattagccaggcatggtggtgggcgcctatagtccgcctactcaggaggctgaggcaggagaattgcttgaacctgggaggtggaggttgcagtgagccaagatcgcaccactgcactccagcctgggcgacagagtgagactccgtcacaaaaatatatatatatttaatatccaaatcttctccccaataagaaaggaatttgcttcactctgtcctcattgtgtcactattacctagagtgggatagtattgattttattttttaaagataataataaatatatcacggtgtttgatcactttttcttcatatatctcttgtagtgtctcctttgagacaggatctcactctcatccaggctggggtgctgcaatggcactgtcatagctcactatagccttgaaactcctgggctcaaacaatcctctgcctcagcctcctcctaagtagctaggaccacaggcacatgccaccacacccagctaattgttttatttttttgtagagatgagttcctgctatgttgcccaggtttgtctcaaactcctgagctcaagcgattctttcaccttggcctcccaaagcactgggattacaggcgtgagccactatgcccagcctttttagcatcttttggatttttctgttcttttatttaaatacctcaaccaaaatggtctttaaaggggttttgtttttgttttttgagacggagtttcgctcttgttgcccaggttggagtgcaatggcacggtcttggctcaccgcaacctctgcctcctgggttcaagtgattctcttgcctcagcctcccgagtagctgggattacaggcatgcaccaccgtgcctggctaattttgtatttttagtagagacggggtttctccatgttggtcaggctggtctcaaaatcccaacctcaggtgatccgcctgcctcagcctcccaaagtgctgggattacagctatgagccaccgcacccagccctttaaagggtttttaaggcaaaacttttgagattctgtgtaactgaggatgatgcctttatgtctgaaggacagttttatggaaaagcctaggtttaatttccttcagtcttgaaaatactcttctattttctttttgcatatgatgttgctgttgaaaaatctgtcaattcatgttcctttgtatattcttctgttttattctagaagctttttatattatttctttgtcactgcctgcattctgggagatttcctcaaactggaataccaattagctaattttctcccaaatgtatctgttctgatatttaattcatctattttgttcttaaacacctgttataattttgatctctaattttcgcttagtttgcttaatatgttcttgttctttttttcatattggtaatatttcatattgtttattacttttttttttttttgagacagagtcttgctctgttgcccaggctagagtgcagtggtgtgatcatagctcactgcaacctcaaactcctgggatcaaacaataatccacctcagcctcctgagtagctgggactacaggcaaatgccaccatgtatggctaattttttattttttgtagagacagggtcttactatgtatctcaggctggtctcaaactcctggcctcaagtgatccttctgcctcagcctcccaaagtattgggattacagatgtgaaccaccacacccggccggtcattacttttacatgtctaaatagtccttgggtctgggcatggtggctcatgcctgtaattgcagcactttgggaggccgaggcagaggattgggaggttcgggaggatcacttgaggccagcagttcaaggctgcagtgagctatgattgtgccattgcattccagcctgggtgacataggaagaccttgtttctacaaaaaggtttttttttaaattatctgggcatggtggcacatgcctgtagtctgtatgcctagctactcgggaggctgaggtgggaggattgcttgggcccaggagttggaggctgcagtgagctatgatccactgtacttcatttcagtataaacgacagagcaagaccctgtctccagaaaaaaaacaaaaatagctcttggtccattattctaatatttcttctgtttgaatctacagtccattgctttgggggtgttttatggttatgtttctcaaattattattttttgcctctgagcttttttcccctgcaactgttcgctattctaacacatcaagcagtgtgaataggagaatggccagatccctgtccttaacaacccacatgatctcaggacaatgggctggataagcctaggccagagattcctaggcacctagaaatgagacttaaatttatttcaccttccacaaaacacctcttcaggttggatcttcccacttcatccctcagggaagagtattagtaggagacacttccgatagtgttattccctagccctgggcgtggagagagggctggggagatcattcggccctaccagtttttctcagtttctcacaagcacaaggctcctgcactgcccttgtttactggtaaggacatctgaacaagcgagagggcaggtgccgatgcacacagcagtgagggaggagcaagagcaaaactctgttctctcgcagccattatgcactgccttctggtccaggccagaactaccacctcccacacagcccaagttaaaacagtcacccggccccatcctcacccattctccccagctgtcaccagccgggtttctttctttctttccttttcttttcttttcttttcttttccttttcttttccttccttccttccttcctctctctccctccctccttccttccttctctctttctctctttctctttctctttctctttctctctttctttctttttcctgcattttccatctatgttcctctaggattgatcttggagaaaggaggcagagataagagtcaaaccaattcaacataatggtccccaaataaatttctgaggtcatatttttccatttaagcaaacagctctgacatactagactctcaatctcagttttgaattcctgggagaaagactctcgcagagcttgggttgcctaggatagtatttaaaagggtttgtatgacccaagcatctgggtcttttggttgtgggggtaagccatgctaccagctcccttcagcacctccctattttctttttcttctttaaaataagacaatttctgtaactactgaactggtagtgtggtatcatgaaggtgaggcaaatgcctgatacctaaaagatgcagccagtcccacagtttatttcaggagggctggtatttgcaatgtgtgcaagataacattttagtcattatgaaaagtatgacttttcatacttttctgacaataagaatttttaaaatttaaaactgtaaacaaaataatgtacttcattaaaatgcaaagtaaatctttaattaataaaagtttttaaggccaggtgcagtggtttgtgcttgtaatcccaccactttgggaggcaaggcaggaggattgcttgaggccaggagtttgatagcagcctgggcagtacattgagatcccgcctctacaaaatcaaaaaattagccaggcaaggtggtgcgtgcctgtcgccccagctacttggcaggctgagctcaggaggtcaagcctgccttgggccatgatcatcccatgcactccagcctgacattcagagcaagaccttgtctcaaagaaagaaaaacatttttatggtgttttcttttttagtcttttcaataatgaaaattttcattttacaggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataag

SEQ ID NO: 35638 - DNA, 46320 bp, Homo sapiens
gcagtccagatgtcgtcagcaccagcgcctgggctggaggacagagaagccttttccgttgccggtgccggcctagcgtcctggaattacttcaatcaagtaagtgcgtttaacgggcttaagaggggctttcgggtttattgtttgcactgttactgcgactccaaccttctcctctgtgcttccaccgtggcgagggtgtggggaaagagaaccctctcttctcccctctcctagtctgaacgtgggccttgactaaaacttgagatctgggcgcggtcggcagcgtttctggaccccagcctgtgtttgtcgcttgtggtggtggcgccagacctctggcgtacggagtaaaagaaattttctgttcttaaggcttgtactctgacaccattctcgttgtattgagggtatatagcttacccagcaaaggaggtaatgtgaaatggaaggactggcaacatagaagacaaaaacaaaaatccttaaaatttaataaatgttctgtgtatcagacagtttagggagacaagtagtggtacatgctttagtgaagctcagacagcttggatttttgagccctaaaaagcaagttcaaatctcagctgcttctttactttagaaactgttaactttaggcagtttactcaaccgcttttaaagctcattcctttttttcattactttggggataattcctaccgcataaggtttttgaaataagtgaagataaaaactagaatcttgagctctcggtgagtccagaataatagcaaatgaaaattttgttcaatgtaagtcggtgtttcctaggaaattaaaattttcatctgaaatgtacaacttcttgattcaacaagtaattattaagattaatcctgcctagtatgtgtactatcctgggtgctagacttttcttttgcctgaaatgattttgttttaaaagcatatgccagggaataccattctaacccccatcaagtctactgaggattggtagaatagttgaaagctaggatgaaggccctttgatcaattcttcatcacgcacttttacctgagtccaggttattgctacctgtaaaattcggtttttaactctaccctttttgttcttatttctgtggagtcctttacactaatatcgaacaagagaaagttaccaatagttgttaccctactaaaaaagcaaagagtggatttttgtcttttttttttttttttttttgagacaaagtctggtctgtcgcctaggctggaatgcagtggcgtgatcccggctcactgcaacctccgcctcccaggttcaagtgattctcctgcctcagcctctccagtagctgggattatagccgcgcaccaccacacctggctaatttttatattttttagtagagacggagtttcgccatgttggtcaggctggtctcgaactcccagcctcaagcgatccgcccagttcggcctcccaaagtgctgggattacaggtgtcagtcgccgtgcccagcctgagttttaaaggaaaacgaccgtagcagcttttgcaacgttattaatgaggtccctggtcagcttgtcttcacagtaatggtaatagctgccttattgggcccataccaggctcagtgctaataatacctctgtttgctatttcttatttaacacagtgactaattttgcagataaggaaattgaggctaaaaggggtgaagaaacttacccaacctcacaagtttctctgaatagcacgaccaggaatttgaacctagatctgtctccaaaacctttctttttaatcaccatgacttccctagtggcttttcataattcccaacttgcttttttttttaatcctgtaatcattgtaagagacacttcagttgtttttaagaagatttctttattaaagaaccacctttttctctttatagtaacaacctacctttggggaagaaacaacccacctttggagaattgaattgctcgagtacaaaattttacagtaaccacccctccccctacaatagattcttctttcgttctttttttttttttttttaagagaccaggtctcactctgtcacccatgatgaagtacagtggtgcgatcacagctcactgcaacctcgaaatcctgggctcaaacagtcctcccacctcagcttcctgagtagccatcacaccaccatgcccagctaattgtttttattttttgtagaaacgagtctgtgttgccaaggctggtcttgaactcctggcctcaagctatccttccatctagggccttccatagcactgggattacaggcatgagccacctcaagcaatccttctatctggggccttccaaagcactgggattataggcatgagccaccacaccctgcctagttcaatttattaaaaaataacagcaaggtataatttttaaatttgttgttcttgaagttaaatatttcattattgacatttaatgatactgtattaaaacattgtttcatcttgtataaggaaagtatcttctgtttaatggcaaagagtaattctgaaaaaaaatcccagtggccatatgcttgtggtaaactccaatagatataaactgacatatataagaatgtactagttactgtaatacagtgtatggtgtgtgtgtgtgtgtgtgtgtgagtgagatggagtctcgcactgtcacccagcctagagtgcaatggctcaaccttggtcactgcaacctccacctcccagcttcaagtgatttctcctgcctcagcctcccaagaagctggcattacaggtacgcaccaccacacccagctaatttttttgtatttttttagcagaggcagggtttcgccatgttggccagattggtctcaaactcctggcctcatgtgatccacctgcctcggcccccgaaattgcgggaattacaggtgtgagccaccgcacccagctgctgtattgtatttatgtagtaagtgcagattgagcaagttacagtaaaaattattacctaatgcaatagagaaaataacatgttttgtctcaaatggatggaaactgaaagctaatcaacttcaactgagcttctttatgaaaagatagttatatatacttatgtgagaattagctccatttccattgttttaaggagaatacattgaaagcaaaaattctaactctttttcaacactggcatttaagtcaaagtatttgcttttttagaaaaattgactttatatacattactaaaataatgtgaaatgaatgtctcctgtgtcaaggctggagactactgcatagctaccttttgtaatggaattgtctagccagaatttattatattcattttatttaagtgatgaaaggcttccctcttcaagcttctttgctaaatgagaaaagaaaatgaagaaaccaaatttatgttaaacctaaaaatcacattggccaaagggtacagttttgtttcataacagaaagtaagactgttatcaaagtatagagcagcttgtctctaccattaaaatttattaagacatagatgaaaggtacaattgatgagatggattattgaagtctgaaattgtagtaagggtaaattgagttaatttggcagatttgcaagcacacttgtttataaaatggagtcaagtaagagcaaagtgtatttgttttgcagacattctaggaagtttctttttgtgtaaagtaacaaatttagcctattttgaattgtattgtgtttatctttcagaatattgccttatgtatgagagctgctatcttatggtaaaagttgtttattgagagaacattttagttttctttaaaaatttagacttacaatttcacatttgttttcccttcagggctatcattgccaactttaagagtagctgggagaggacattcttttttgtttgtttgtttttcctttttttctgagacagagtctcagtctgttgcccaggctcactgcagccttgacctccctggctcaagagatcctcgcatctcagcctcacaactagctgggactaaaagcacctcgcttctttttttttttttttttttttttttttttttttttttttgtagagatgaagttttgccatattgcccaggctgttctcaaactcctgggctcaagcagcccacctgccctggcctcccaacgtgttggaattacaggcatgagccacgatgcctggccaagaagacattcttttcttttcagtgaagacagtacatattttgcattttactgatagtttcaaatgtggctttgaaatttgtattatgttgttactggagttgtatatggtaattttttctaatggagagagtgcattgtctttggaataatgcatttgtatattctttgttttctctgcttctcttatatacttttgaatcgtgaaacagcttgctctaggaggtttaatatttgattctaatattttctgctcccgcccccctttttttttccaagacagagtttccctttctcacccaggctggagtgcagagctcactgcagcctcaaactcatgggttcaagtgatccttctgcctcaacctcctccccatgccccccagtagctgcgactgtaggctcatgccaccacattcagctaattttttaatgttttatagagacagggtctccccatattgcccagactggtctcaaactcccaggctcaagcagtcctaccacctcagccttccaaagtgctgggattggccaggtacggtggctcatgcctataattccagcagtttgggaggccaaggcaggcagatcccatgagttcaggagttagagaccagcctggacaatatcttgaaactctgtctctacaaaaaatacaaaaattacctgggtgtggtgtggcatgcacctgtgatcccagctactcaggagactgaggtaggaggatggcttgaccccggaaggccgaggttgcaatgagctaaaattgtgccactgtactccagcctggacaacagagcgagaccctgtagggaattacagggatgagccaccatgcccagctctctccactttcaacacaaaaaaattttagtccccagatttaggaaaaatttttttccctcttatatgagggctttttttaaatgttagttttatttacttgaaggtggaagaactagtaaaaaaaaaaattatcaaaaatgcttttaatttgggggttttctggtttatttcattatattataaaaagaaactgaaacaagggtggtggtaaaccaatcctgcttatgtcattttcaaaaaagcagtataatattgagatttgtttatcggttcttaaatcagctggaagtgtttcctattattcacagtgattattactcataacctttaaaagctagtgcagtattcttgctcttttttccaagactaatatgttctctgacttaaagtctcagattttgtattaattgtatggattttatgattttttttttttggctttaaactagtaaagtaatacagaagtaaagttagggcaccaaaccctatgtttatgttaacacatacactactgagtaagtctgttttaaaaacaatttcaatcaaaatccactattttaaaatttgacttcatatccaccccctcccacccacaattttgttcaattggattctgcttgcaatttcatttactttaaaaagggagacacagtaaatgtttaaaaatggcaaatactgtttatgtagcaaagctcgcctacagttttaataagacatgatatggtccctgagactttatccttaacatcaacttaaggagaaaaatctgaataatttggtagtttgttaacagtcacaatcagtagattgttaatttaaaatttgatacttagatttctaggccacatatttatactcacaatttggtaagtgctagtttagctttcagaataccttcaagactgctcacaatttttttttctacttgaggttggtttttttccatcctttgcaatatcacagttacatatacttaaatattttaaaggtatgcatcatcagagtgttgaaatactagtggacatttaaatacttggtacctatgatgcaaatctgtgaacccagccatcatcattctagaggtacatgtttttcactcaacattacatttatcagccatcaatacaactttatggccatcttagaggtgctgacatttttgcttttctttttaactcatttcctagaaatactacatctctaccatctcatccctcccctaaaataattacttgatcaatatctccaagtgctttagacttcagcctgagctaattgtggcttgaaactaacaacagtttattgtttcaagtgactggggtggcaattggtggagagaaacatggcccttaaaaactacttactgtactttatttttaagaactaaaattgtttaattttagtaaagttgtgagtagtattttacttttaaaatttatgctttggttatttgatagtttttttgttctgacccatgtcatggtacttttaattaattaattaattaatacttatttttttatttttgagatgcagtctcactctgtcgcccaggctggagtgcagcgacgagatcttggctcactgcaacctccacctcctgggttcaagcgattctcctccctcagcctccccaatagctgggattataggcacgcaccaccacacccggctaatttttgtatttttagtagagatggggttttgccactttggccaggctgatcttgaattcctgacctcaggtgatccacccaccttggcctcccaaagtgctgggattacaggtgtgagccattatgcctggttttaatttaatattaatcaaagataggtacagttgtttgtgtcttttcatgttggtgtcatgtttgtattgcagtagcctcttaaaggagaaggggcatctaataatggtataattcatatctttaacttaactgtttatagggtaggttcttatcaatttaatttttacaataatgctataaagtaagacaagtattactattgttagtcatcaattgaaaagatgaggaaagccaagtgtcgtggctgatgcctgtaatcccagcactttgggatgccctggtgggaattcaagaccagcctgggcaacatagggagatgctgtctgtacaaaaagtttaaaatattagctgggtgtggcggcgtgagcctatagtcccagctactgggggggtgggggtaaggggctgaggcaggaggatcacttgaacccatgagtttgaggttgctgtgaactctgcacttcagcctgggtgacagaacaagaccctgcctcaaaaaaaaatttaaaaagaaaagatgaggaaattggagagttttttccgactttcttgtaatgacatgtaacatttgttgggtgcctacgtgttgggcactctgctaagtgctttgtattcatatttttaatcttagaaacttcaaatggcatcattatccccatttttcacataagggacacattagctcatgtggctaattagaagaagtatttattacagtagatgagaacacacataggggagtagaatcagggaatagaatagaagccacttatgttttttacatttatatagtttgaatatttagcattaaacttattgctttataatttttaacattccacaaaaaacctgtgttaaaatatgaaatctaaataagctgttctcactgtgtaaactaactcttctgagatatatctttcatgtgagtttaaatttttgtggatttattatgacaagacatggtaggagacagtacaacatagtggaaatacaggctttggagtgagatgtagtacctggtttggtttttttaatccctgctctactattacctgctttatatgatagacaagttgcttaacttttctaagccttagtttctttatttatagaatagtcattataatagtaatttattctaagcatttgtattagtattctcacgtattatcctcataacaaccccaatgaggtgggcattattattaccctcagtttaaataaggaaattgaagcaccaagtaatgagctgaagttcacacaattatcttaattggtagagtcccttcaggttgactctagggcctgcattattaatcactctagcaccttttaagtgttatgaggattgaaggtcgttttaaaagcattcaattaatgtaattcagtcttattaatgaaatgtactgatttgagtacactttcactttttttccagttttaagtaagtctttaaaaataattttccttcatgaagagaaagttaatttactgcatgggggaaaaaaacataaaaggtcaaatggtgcatatgtttaattccttgattacgaaaaacgtattaaaatgcatgaaactattagaggtaaagatacatataactctactggatattttcttgcattgaacttttttttattttttaagatcgtgaagcattccctccaatggctttttgtcagttaagactccaaaagaatcttttataacatagaagatagtattgagaaatcagtgtctggagcttccccagccaaatgtttcttttgagccgattaaacaaaaaagccaagcaaatctgtacaaataaattgattctgattttccaagcaatacatgtgcactatagctgagaatactgtgtatacgatgcaagcaccagaatcttaatgctctgactactacttttttcctctatttaatcataaaacaaagttgaaaaaaatggtcacagatagatttttgcctataattttagggtgttcacagaccctgctctgtcaatttaaaaacatacatataaaatccttgctattgaaagacaatatatattaaacgatatgaaagaagtatttgaaaataaacacaggtagactttttttctgtcctggtatgtgtgtccatgtgttcttttgtctgtcagtcagtcccctagtgctaactcatccttatcctctccccttcatttaggtgaagaataggagcgtgggatttacaatctgatttttaaatagatattaatatttataaaattgtgtaaatttatagaattagaaatacagtagaaatattatctaatttatagaactagaaatcaaaatacatctgcagataagttttttttttttttttttttttgagacagagtcttgccctgtcgcctaggctggaatgcaatggcacaatctcagcttactgcagcctccgcctcctgggttcaagtgattctcctgcctcagcctccgaatagctgagactacagttgcacgccaccacgcccagctagtttttgtatttttagtagaggcggggtttcgtcattttggccacgctagtcttgaactcctggcgtgaagtgatccactcaccttggcctcccaaagtgctgggattataagcatgagccaccactcctggccgtaagttttttaaaacttacggatttgtaaccagcaatttatttcctaggttcttctcatggctctgtatagctaaaggggaaaaaaaatatagccaaatactttgagagtttgctcaaccaaatttccctctaaatggaacaaatacataccatcttcattcacaaagcctttgctgcatgcattcccttagtatactttattgataagccatctgccttacaagaattgagcagattgtatgaggcatttgtaaagtttctagcacataggtgatggtagatttttgtctaatgctggacttgttccagtatgatattgttaggtatcagaaacccaaagactgataaattgccttttctagcctcaaaaaaatgtatttgcttgggggtggagggaagagctatttaacaactaatttcataaaaggcctgttgcttgtgccgatttgcaaaattgtgttaattgggaggactccactgtcttttccgttagtgtgaacaaaagtggctaaaagggacttgatttatccaactgcaaacagggttcccagtgggtagcgggattatgcatacctgtgtctgctcttttttttccttttgagatggaatttcgctcttgttaccccaggctggagtgcagtggcacaatcttgagtcaccacaacctccacctcccaggttcaagcaattcttcctcctcgaggagcctcccaagtagctgggattacaggcatgcgccaccacgcgcggctgattttgtatttttagtagagacggggtttctccgtattggtcaggctcatctcgaacccccgacctcaggtgatccacccacctcggcctcccaaagtgatgggattacaggcgtgagccaccgtgcgtggcctgtctgctctcctttatctaaaagaccttccatctaaatacaaagatctttttagaagcttgagatggaaaagaactaaagcttgttcattaggactaagaggattagtattgttttacggatgtgtataaagcctcattgtctaatattatttgacatgctttcctgccaatatcacgcaccagttaatttttttttttcaatgtagtggttccctacgtgtcctacctgtgaatcttcagagtattatggggaacctgtaagttatttcttgtgtttcaaaagcctatcagaaatcatgcacttttctataatgtgactttataggccaaatgataggttatttaacttttttttttttttttgagataaggtctcactctgtcacccagactagagtacagtgtcacgatctcagctcactgcagctttgacctcccaggctcaggtgatcctccacttcagcctcccaagtaattgggaccacaggtgcacaccactacacccagctaacttttttgtattttttgtagagatggggtttctttgcgttgccaggctggtctcaaacaactgggctcaagcaatccacccacctctgcctcccaaactgctgggattacagggatgagccaccatacccagttgcattaactcataataaaattgataataatgatcatttatatataactagaagctttcccttacttacatccaaagatgagccaattgaaccttctctgtgcatacttccttcactttgctttccacatgacaagatttctaagtctctctctgaagtataaactggaatgcattcacttcacaaagagtggacttcttttcttgaaagcttcaaacttgttcttatccttagggtctttctaatttgttatttcctctgtctggaatactcttcctccagaaattcaaatgtcttgcttcttccttttagtaaggtctcagcagataacactttttccgccatcccctgtcctatttcatttcatcacaacacattagtcctttcatctttgtggggttttttgtgttttttttgttgttgttttttgttttttgtttttttgagatggcgtttcgctcttgttgcccaggctggagtgcagtggtgcaatctcagctcactgcaacctccgcctcccaggttcaagcaattctcctgcctcagccttccaagtagctgggattacaggcatgtgccaccatgctcggctaattttgtatttttagtagaggcagggtttctccatgttggtcaggttggtctcaactcccgacctcaggtgttccgcctgccttggcctgccgaagtacttggattacagacatgagccaccgcgcctggctgtgttgtttttttattgaaagtctgccatactagacctgaagttttatgttatcagggacattcacttccttttccctactctatttccagcagctgggaaaatccttggaacagatttacgtacataatatttgaagaaatttgtgagttttttgactgcctctcaatgatattgtagatacagtgaataaaacaggcatgaatcctgtctccagattctatattttctatagtcttgtttaattgtgagcctaaataaatctgaagtgatttaaaactgtcatagattggttatatttatttgctttaatatatctgtcattcgtcttcaggtatatgtcttattcctatgtaaaacagacattaacataattatttaatctattagacctacaagaatcttcaaaattatgattcaactcttcatttgactgaaaaactgacacaggttcttagaagtgaagtgaaattttctcaaatcacatgcttgatgacaggggtgggttttttttgtttgttttttgtgtgtgttttttgttttttgttttttgagacggagtcttgctctgttgcccaggctggagtgcagggacgcgatctcggttcacgccattctcccgcctcagcctcccgagtagctggcactacaggcgtctgctaccacacccagctaattttgtttttgtattttcagtagagatggggtttcaccatgttagccaggatggtcttgatctcctgacctcgtgatccgcccgccttggcctcccaaagtgctgggattacaggcatgagccactgtacctggccaacagggctggtattttaagccagccttctaactttaaattcagtaattttttgttgttgttgttagctgctaaatgatgtgaaaataaaatattttaaaatcctcttcagttgcataaactttttgccacttagtttctctatagcaaagtatcatctatttgttcagtaagttattgtacataaattggcttctggtggtttaaaggattttattacaactacctttttctttggtttgaatttgtagttttaattatgaaatgtgtcaaacatacagaaaaatgtagagtcatataaaagatttatgtgtacccatcacagagaataaataagtgttaacatttcaggaaaaaaagaaaaaggcatgaaccctgaccttctgttatttgtccttttatcatcaaatattttagcatgcgtggcatatagtaggcactcacaataaatgttaaactattaagtatctgtaactggcagttacatatgtctgattcaaaatgagaaaattaattaccattctttgtattcacagatacttatttatgagtgacgtgcagttagttatacaatcagcctccataaccatgtgttccacatacttgggtttaaccaacccccatcaaaaatattcaaaaaataaaaaataatgacattaaaaataaaaggttttagaaatacagtataaaagctatttacatagcatttacattgtattcagtattaaagttgagtatccctaatccaaaccaaaatccaaaatgctccaaaatctgaaactttctgagcactaactggcacaaggtaaatgctcattggagcatttcagattttaaatgttaggattagggatgctaaatcagtgaatataatgcagatattccaaaatcttttttaaaaatccaaaatccaaaacacttatggtcccaagcattttagataagggttactcaagagtatgagggtatgtgcttacattatatgcaaatacagttgtaccagtcctgaggtgagtattcatggggaattgataccaggaccccagaggatatcaaaatacacagatgctcaaattctttatgtaaaataggatagcgtttgtatataatctgtgcacatcctcccaaatattttaaatcatctctatactaataataatacaatgtaaatgctgtgtaaatagttgttagacaagaaataaaaagtctgtacatgtttagaccatcaatttttttccaaatattttcagtcccaggttggttgaatccacatacatggaacccatggatacagatcaaatgctttattacacaacaccattttacataggggatttgagcatcctctggttctggtatttgtgggagggtcctggaaccaatcccccacagatactgagggacagctatatgcttttctttaaaattctgaaaagtcttggctctagctaatgttagttgatttctatgaaggccataatttgtaattttgctgaggctcacattcagtcaacccatccattttctgtataagcactagtgaaagtcacttagccagttggctctacacccaaatctcaataaccttgtgctctaatctctcacatattgcatcttgactgcattgtgccaagaggtattcactaatgtagatactctgtaaggcttcaagtttgtttgtttgtttttacctccaaaacatctaaaacttttacctctaaaaacattcaaggtcaagtgaattatttagtgaactgtcttaaatgccattgtcattaaggtatatttgtgcgtgtgtccagcacattcattgggactgactgtgtgacagacattgtgccaggttctggactgacccaggaagctcacaactttgagtgatacatgtcaataataaatacatgtatcttctgttacttagcagaaaagaggaagccctaacagcttgcagaagtcatagcagtgagggaaggaatgctctacagaagatgacagataagatgagtgatgttattaataacttgtgtatcggcacagagacattatggtttttgtcatgtttggggcactacaagtcactggactacacactggatgcagttgagagaatagttcagatgaggttgaaaacaaaagcaaggatttttttaatagtcaaaagcttcaaaattattttaagcaagaatatgtatgtgaaacaagtttttcttgagaaattgcagtattttctttagaaatatatacttgaatatatttaagtactataaactgtgtttccaaagtcagctattgtggaattggctgggtgcagtggctcacgcgcctgtaatcccagaactttgggaggccaaggcgggtggatcaccagaggtcaggagttggagaccagcctggccaacatggtgaaaccccatgtctactaaaaatacaaaacttagcctggcgtcgtggcaggcgcctgtaatcccagctactcccgaggcctaggtaggagaatggcttgaacaggggaagtggaggttgcagcgagccaagatggtgccactgcactccagcctgggcgacagggcgactctgtctcaaaaaaaaaagtcatccattgtgaatgaatgtacaaaacgcttattaataagtgtaatattaaaatatatcttttctgaaagttttagtgacaaaacaaattagttacagatttaatgttaccaaaattcatgtacattgaaaatttcgggacattttatactggtggtggtggggtggcatcttagcttgggtttaaatatcattagtaatcggatagctctgtagatgattatcagtatataaagacatcgtgagcagtatttaataagaagagttgctgaagtgacttttgcaggaggatgaatgctttttttaaaaaaaaagtttatacgtgcctcttcgctcttccaaaaaaaaaagagagaagaaaaagaagaataaaacgagagacgaaggtggataacacctttctctagaccccggtgcctctcatttctcgggctgcaggcgacggctgctgggcctgcgcggggtggagccgacgctgacgcgccctgcgccgcaaagcattgtgggagctcgggcccgctagtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggagtgagtatcgtccaccatcactgttcctgctaacgccgcctcagcctgggcctaacacacacaatttccttaggcccctgtcgctgcttccccgggccaggctgcttgagtggctggtggctggtggatttacttaagacggttgtgttccaggcctacaaaaaaatgcagagaggcagggccagggctttttggaattaggaaacactggctgttattctcgggaaattttttttttccgccttaaattgtgccaacgtggtcgtttggctttggggacttaacgcaagactaaccgcagtctgtacgtcgtatataggttaaatcccttttttaaaaaactgagtatttgttctttgcgttcttggaagaaaggtaacaaaattattcatgcctgtgttaatttggtgttaaactttgtaggttgttcacttattgttattgctgttatgtggttctggcccagcaatataattcaaagatcatattctttttgacagacgcttagtttagtgtgagcctgattacttaatttgtataatgtcaaaaaacgggttataaaccagagattttcctttgtttgaataatatacagatttgtgatatttcacagttgttcttgagaaggatttttataaatgttgaaatttgaattagagtgtatgactttttatcctttttgtctcacttttattttgaaaattatttctatcgcaagaatattaagtggatgaattgtaaagaaaaaatagttcaaagaagctaagaagtaagataaagtgtactactaaaacagacaattggaataataataatagtcttgtgctttttggaagacttattggtggagaagtgacaattcaaatgtcattatcagtaaatatcatatattgagaattttatgatgtcacttaaatactaaacaggaaattggaatcctctaagaatctactgttatggtacgtgtaaccattaactttctgctcaataaaataattgacaaaagtttatcataatgagatatttgttaagtattagcatatttcatcactttccacttaaaatactttcacaagattattggtgttttcaaattggtatgtttctaatttttagggaaatgtacatgtggagagaggatttacttagtttgcatgacgtggagttctgggaacaaacacgtaaatctttattcctgttattttgacagatacttgatttggtaatgaaagacaaatagctttcataacatgaacatacaaaaatagatgctttgctgttgttcagttttctcaagacttactgttttaagcttgtaaaattaatgaacagtaaaatagcagaaaatagtgatacattggatgattttaatagttttattagtgagatatttgaggtattcgaattactacaattctttccaatcctacaagttaaaaattttgttatggttgctgacttttaaatgctgtttattctctgaaggcagttttatgatgcatttagaaaaaaggtaagagagatgtaggcattatactggttcatcttttacctaatgcatgaccagtatactagaggaagttgtgatggaccagagtctttttgttttgtaatcaaatgaatagttccttcataaccaggacagctagtgtgtgcttgagaatgtctccctcaactatatgatctgggatattctgcattaaaaggactcccttcccagtattgggagaaagagagataaattgacacatttttactctgactccttcatttatcttcccacatacaagatcattttgtcttttaaaatgtacaaggttacaataagttaaatgttattagtggccttctacatttgatcagtaatgtagatggctacttttatttacttgatgttgcattttgtttttttaactataagtttcaatacactaatctgactggcacaagttgcatatagttcccagtggtccacagggttcatcattccaaaaatatttattcataacattgaatggctcagattacataaaattctatctgttgtgaacaggtcacctgattgtaactattatctacacagttggccttcttcatctctgggttccacatccatggattcagcccactgtgaattgaaaatataaggagagaacgtctgtactgaacatgtacagacttttttcttgtcattccctaaacagtacagtatagcaactatttacattgtattaggtattataagtaatcacgagatttaaagtatgcaagaggatgtgcacaggtaatatgccatgattttatttttcctccacctcttccccctccctgcatcatgttatataagagacttgagcatctgtggattttgttatctgcagggagtcctgaaaccatggatactgagggaaaactatatgatttcccccaagaaggcagtgacatgcacctgtaactctttttcccctagacatatctgtgacatgcttaactacttttatttttccgatgtcaccttaatcagagaaaacttcccagaccaccctatgtaaaataaagcacctctgctgctgctttattctccttaacactactttttttctatagcacctgtcaccagttgacaggttaagtttaacaacttctctcctgtagaatatgaggtgctttaaaatacatgtatgactgaacctcacccacacctactgaagctcttcatttcggttctgaatgcctattttggggaaacatttctgggattatgacagacatttcaatgacaacctgctctaggaggtttcctgcattgtcattgttaagtccatctatttattccttcttttaaaccagaatttctggcctgtaattttactgagaaatagaaatactatctttacaataggtgatattctaactgtctctacagcatgatggctttgcaggtatttgaaagttgaaccccacatatactctttgttaaactgttattttgattctggttgtttctgaaatgcgtactggaaatgcagcattgtttgaatatctattgtgtgtgagttgctttctaaatgtaccttaatccttacaaacctggaggaaaaaaatgtttttgaccctgttttacaagttcgtgaactgaaatttacataggtattttttgtatgcccaagccatactgccaatgtcagaactagaacttgaacccaagttgtgactctcctttaccacttgatcaggagtttgctgatttagccaagtaacttgtaagatcttcacatgctttcttttagtgggattgcccagcaaagtgcttatcaggtgatgatcccagtgaagtatgtcacagttatgcagtaacttaaggctgctgtaatacggagatacattgaagttcattagtaacttttcagtgacccaaaatggatactttaatggttatataagtataaattagtatattaggtaagggaaagagtttagtgcacctttaaagaaaaaatggttttaattgatgcaccattttattgtatatttctttacatagtgagaagggggcacatgaggtcagcagtcaagttttcaggttaatgtcgtctttgtcacacacctccttttgtgggttggcgatacttttatttatgagctcgaaattctccacttagcacactattaaggtggaaattggaaggctgatatcagtggcctaaacctgaagttctcgtacgttagtaggcatgaataccttgttaagaatctgggccttcatgtaaaaaagattctctacagacccttaggtgaacaacggaaatctcaggttttctctctgtagtctagaagattctgaaatagccctcagaggacacgtaagaactgttaaaaactacaccaccgctcttagttggaggacagaagtggcatgcaggactcactttaccctatcttgttcctcatttctccctactttatattaattctaaagagatacggagtaaaatatgtgtcgtatttggaagcagtacttccacagaattttagagcacaaaaattaatttcaggcatcagtcctctatcttatattaacatattatcttattaagataaattttattaggaggctgaggcgggtggatcacctgaggtcaggagttcaagaccagcctgactaacatggtgaaaccccatctctgctaaaaatagaaaaattagccggacgtggtggcgtgtgcgtgtaatcccagctacttgggaggctgaggcaggagaatcgcttgaacctgggaggtggaggttgcggtgagccgagatcgtgccattgcgctccagcctgagcaacaagagtgaaactccatctcaaaaaaaaaaaaattttaatcgaaaaaatgttaagaatgtaattgtgggcccagataccatcaaaaacttgttttaaacccatctaaaggaggccatttgaagtggagagagatgaaattatatttcttattcacagtattcaaattcatatttaatctgtaccctaccatcacttaacaggttttgatatagccaaaataattggagcattcctatgccattaatgagtaggaaaaaaaatatgagtcactttaaggttgccaagtataaagaatacaatttgagcacgggggcagtactttttttcctaaagaactatttattaaaaatatcatatttgggagtcatttcttttaataagataacaataaaaagtgttaaaagaattggtagaggtcagttttaagaagtgttaagtgcttgctatttcccagggcattgtgttgggtgttaataatataagatgatagcattaaaagagctttgtaatttattgatggaaacatggatgtcagcaaagaaatgtgaagtgccatagcttactaaacctgctaaagtacttgacagtgaggcacacctgcagccccatctattggggaagctggagtgggaggctgggtaacatagtaagacccctcccatttctttaaggagaaattgcttaaacattctttttactactgcgggtgcaacattgttaaattttatagcagcagtgtttcacatctaaaaaccactgtattctttaagaaacattcaacagtaagcctgtataacaaggtggcttaacttgcttgtggatatcctgttaattttgctttgaacttgggttagggtctgtgtttagcctgagaggtccttgtagggaagcttgtatcagaagttctaatgggtttgagttctcaggccatatatagcatcatgttagtgtttgagttgtgataaaaattatggggttttttgttaggcctaaattaaaagaaattatttttcttttcaacaatgaatctgaaattcttagtataaccaaatctgatgcatttacaattttatgtacacattggtgtgtttcattttttagaaactgtgaagcctcattcagatagtattaaaatacaggattttccttttcattaatgagtcctatgatgtaagtgttatattgatgttaaaatgaagtagttttgtaccctgggtgcataaaattgtcagagagaattaaaggagaaagaactcaaacttcatcagagatcttgatttaattcatgtgaagagtgtggattacccccaacccccaaccccatgactctaatacacattagagtgtattaactagggatggtgtgtttatttctgccttagggcactagctttccaaataacttttggtatgggcttgagccatccctgtattcatgcacagagtttcaaggcagaaatttgagctaccctgtaacttaacagttgaaaaaaaccctgcttcctgtgttatctgtcttacttacactgccatagcttgcagtttagcacttgtctttcttttacctaaggaagtaatttgttgagggaactagcccttttgcttattgaaactttgcagggtggcactagtggaacgtagtactactcccatgtgtgcctacattttttcttttatctgaaagtgctccaagccagaaatccttgattatttacagtgcataagagttcttacatgctgtgggtaaaagagtgcagggcatggaacctgtttattttatgcagttcaagaaaactcattgattattgagtacatgttcgttctcatgatattcatttgtccctgatataaaaattgttcatctttcttactctgagaaagccattaggaagtttctaagccccaaactactgttacctgtatctaaaaatagctggtattggtattataaagaaactgttgacaattttgtggtcccctcagtctctgagacttcagtaccaaattgtttttaacctgatacactgtaaatataagttatgattataagtttttatctgaactgcaattcactacattatttcagtgaacagtatatgattgagaatgttttcttttgaatttaactacattagtatacagttaggtttttttaatctgttttacttttgaaatgtgttggtttgtgaattagcatttgttttaactgctattctgtttctcttttatgttatttgtttattttttagtgattcgcctttgccagtctcatctcgtgtctgctttgttaagttccatgatccagactcagcagttgtggcacagcatctgacaaacactgtattcgttgacagagctttgatagtcgtaccatatgcagaaggtttgtgctttgtttaactacctatgtgggcatcctaagatgaccatctacctcagtagatgtagagtgagcattagtagcatgttaaatctaagctattaacatttttaaacccttgttatactgcagtccgtaatttttgcttgcagattttttttaattctaaaaattagaaattaggtctgttattataaggtatttaccttttgttttcttttaaaacatttttaagttgtttaaaaccatgtcccttattgtaactccctgagatacatctacttagttaatttaatgttaagttttatgaaaaagccctgaaggtaaatgattcactccatgtatgcttacagagccttcaaataaatgcatgatgttatttctgttttaaataaatgagtaggttgattttattttcttaaagcttcctcacattgataatctggaaaaaaaaaaaacacattgaatttcagtataccaagggttgcagtgattttggttttcgtgaaagttcaagatttcctgtagcttaggtgccaaatgggcactgggtgttttattttatgccagattttcttgttcattcttgctatatttctagaatatctctaaataataaattcttctctctgttatttgtgtgtgtgatttttatagtggagaaggcaaatgcaaaacccttccagatgcctgaaaaacagtgggtcctctgcagctacaggggattctagacattaactaaaggccagcaagcactcaagtgccccaagtgttttcctggtgtaaccatttgttaactacattttctctctttttacattttaggctgttaaagtaatttgacagaaaaaaatgagcaggttttttggatctaaaaagccactgtgacaagaaattttaataccattttgtaaaattttctaaggcgtattttataattagtttgttcccaatgtactgctacttgatttgcattttggtaactataaattttactcgaatcactgaaatatgataaaactgctggattttaagttaataatttaatatgctgaccaggatttaaatgctttcccctttccttaataaactggtcagtggaagtggaatcttaatattgttcattttagatgctatctgaaatctttgaaaacaaatgtgagcatttacaccataccttgtaaaagttgtgaaatgtctagtccttaacagagaagttgcctctggttttctaaagaaattaacttatatttataaatgggttaagacatgttatgtaatagtacctctgtctccatgatattaaagtgtatgagcccagttttaaggttttgtaatgtatagatagataaatttttgagttagtgtgttttggttaagcaatttcttttatgtcagtgtgcctgttgtaggataagaccatcaacagaaaatttacagaattcaaattcaggatgaataaaatagagtataggtcttggaacaagggtcaaatcatgtgagtaatatgtaaaacattttggttagcctgtaaatttaaattttttattggctaagtattatagttcccaatccctgaacataatacagtatatcatataaatgactttcataaatattttcaggccatagtaatttttctagacctatttttggaagtgaagtatttaggaatatacagtatatagaattaggggaatatttcattcagaattctattgttggtgaatttaattctggtatgatatgctgtattaatgttacctccagtaaatacaattccctccagatttagctattacacttcggtgttagctcttggtcagtgttttagaacagtagacatagtctacggtaaggaatagtcttaattggtaaaactaagatagctgaatttggaaggaactcttaatagtaatggatttggggattttttaggttccttggttaatgtttgtttcttttgtctgtttctttttctttcatttctacacattcatgcagtatttcatggttctatcaaagcagcagtaaaaaaaatactcttgacgcatgaaaattaactggtgaggggcctcattgctatttttaaattgtagttttatttttaaatagtctttttttaatcagaggatcagatgcatgacttttttttttttaatggatgcagatcttctatcaggtgtctcacaataaattcaagaggattttagtttgccagaaatgttgcaaatgcactaatttgagtaagatgttgatactgaatatatcctcttgagacataattttgcatgcaaaattatcccataatctttgtaggtttgttaatattgatgcattactgccctatatctaaatgatcttctcccccttcccctccataactcttggtatctaaattgatgacagctctgacacaagcaagataacagtgctgtgtagtatacatttgtttatattatcggcacttctcagtataggtggaaggaaccattacctttatttaacagtggtttttcttttttgttgttgtgttttacagttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagattttatctgaatacacagattaggctttaaaaacagatatatatgtcatttttggcttaaggagtttggctaagttagcttttcaactggcactgtatggcagcattttttggtatggttagcatggcacatggcgaaacataaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccaggtactagttctattgaattcttaaagggtggggaaaaaaacagaattgtgcataaagctaaacatatttgaactttgtaagtactcataagattctagttcagatagcattatcacatgtctatatcaaaatcacaaatagtatagaagatctcttagacttttgtattttaagaacattctgaaaaatcataaaatatctgttctgtcacttttaccattggctctcaaaataacccatgagtagttttggaacagtctcctgaggcatgaacacttctctgaacacactgttaaaaatatattcatttggaccaggaaagaaaactgaagttaaaatttcacaagtgagcccttcatttttttttccttcccctttatcttttcctgttatttggggggttttgaattacataggtggcttgaaaacaaaggcaattcttgatggagatgtttgatatgggaatgtgaaagaaaattggttgcaatagtgtttctaacactgacagtgctgtacgaagcttattttagaactaaaaggcactttaaatactgtgtattctaattactgagattgtaactggtcagtagtttcaaagattgtagtgaatgagcctcaactggaaatttataaaagcattctttctagtgtatcattttgcctgtctaaataattgactaattgactcttaactgtgaagtgcactatagaatgaaagattaggagttcctaagctttttaggtgtgacttttatcacttaactcctaggttatttcttttaacctataaaatgaggatctgagtaattttctttattctttgttctgttttgttttgtttttttttgtttgttttttgttttgtttgtttttgtttttttgagatggacagagtctcgccctgtcacccaggccggagtgcaatagcacagtctcggctcaccgcagtctccacctccctggttcaagcgattctgccccagcctcccgaatagctaggactacaggcatgccaccatgcctgactaatttttgtatttttagtagggatggggtttcaccatgttggccaggctggtcttgaactcttggcctcaagtgatctgcccaccttggcctcccaaagtgctgggattacaggcgtgagccaccgcgcccagtccagatctgggtaattttctaaattcctttaatgtataaagctatgcaatagctatgttggacagtaagttaaaatagtattaacacagcattttgcctgttacgaataaacagttaaattatagaaagtttgatagtttgtgtttactaaataaattgaaacaaggagaacttgtagcacaggtggagaaagtgaggctgtttcaaaagctacagatggttttaaagtagcctcactttcatggtttgtgtctattacattatggattaatcagaattggtgtcaagcaggtggcagaaccctgcagtgatttgaacagggaacatttaaggaattactaactagttataggagattactaggggaactctaatgaatacaggaatcacaagtataagaaacaaccactacctctgaggctgaagcagaaggaacacccatttagttcaggggactcctctttccccatctatgctgaaacttagatttgtttttggaagggtgactagtaaataagttctcttgggtgccctggggagctgcataaggagttggtattaaaacttactgagaggcgagggctactgggtgtttgacatggtgctgcaggaataatcagaaaggggacacagcaaccaggaagagcccctttcttagtcagtgtccttccagcactctttccaaatgaagtcttatatcatggcaactgtcaaaggagaaatgctttgtaaaggtcctgcctccggtagcacaaaacagcagggcaaagaatagtagatttggatcctgagaagcaataaataattaaaatcagcacaagaatatgttgaaatattttgtctttttttcttaatctaggatttaggggggaaatgtgttgtaatgggtggaacatgggtgtcatatagagcaagactcctatttctgttaatagattgttattggaccacagccatttgtttaggtatcgtctctggctgctttcaagctatgatggcagtagttatatggtttgtgtacaactgaggagttgtacggagaccatgtagcctgaaaactcaagttgttatctgaccctttacattaaaaaagtattaacccctggtataaggaactgaaatgaagttttaaataaataaaatttgccatttcacagattggcgctgttccactggctgctttgggggctcctactcttgatcctgcccttgctgcacttgggcttcctggagcaaacttgaactctcaggtataccttagtaacttcaaatttttcacccatttttacagaagatctgtttcattaactgttggtttgcatttcaagagcagaagctaatggctatgttgtagtaattttttttcttgtttaaacttgtcagagctttaaacagtcactgaatgactaactcctttatccattaatggatttcttttatatagttcaaaatagaaaatagattcacaagaagccagtacattatcagtgtgtcatagagtcagagtaaatagtcatgaaaagataagaatgtggtttataatttttctatcatggaaatttttcttttattttaatttagctaacctttttttctgaagttctttgtagaggtcttttgcattatattggctaaggtgttttgagttttacatgtttctttatgtcaaaaagtcttaaaggagacataattctataatacctagactgttcagcctcataatctttagataacttgctaaagctgctctatccaatactgtagctactgatgtcaccggtttttgttttgttttgttttgttttttgtttttgttttttcttttttaatgtggctactaaaaaatttatgtttcatggcatgtagtctgcatggatttctgttgttcagttttctgcctagaaaatatcggtcatttattgttttatgtattctcattattcttatgttttatttttacagtctcttgctgcagatcagttgctgaagcttatgagtactgttgatcccaagtaagcgttttttctttgttttcattggtgatgtggtatctgaatgtctacagaattagagtttttttgatagcttataagaaagttatcaagttatcttttctcaagacaagcaatatgtattgttacctagaaacaaggagagaaatacagaagtaagtaaggtcctctaaactattttgtttcagtgtcatttgagtcttgaatagtaattgtaaatgacttatacctggatgatagcaaaagagctaataagggacaacttcgtttgaagatcagaggctgagtcctgaggatagtaggagttagaggcaaagctgagggaatcactatcccagagcaaagtagtattacatattatataattaatagccaacattttattttaggtgcttttgataagtgctcttcatgctgtcacagaaattgtttccgacttgatgatgtgacagattcatcagtttttttcactggttatttgttggcataataaatttgaactttataccttttccccttaacttggtgaaagtcactatcagtaagtgagagagcatgaaaaggacagaatcgttggacttcagtagttagtggacttttttcttagaaattatctaaaaataaaaccaagcatgtacccatcacccagcttataaaataaaataataccaatacagttgaagcttcctatatacccattatttattacatttcctgttctgcccacaaataactactaaatttgttgtctataatttttttttctttcttctttctttttctttttttttttttttttgagacgagtctcactctgttgcccaacctggagtgcagtggcgcaaactcagctcactgcaacctccgcctcccagattcaagcaattcttttgccttagcctcccaagtagctgggactatgggcacaagccaccacatccggctaattttttgtacttttagtagagacggggtttcaccgtgttagccaggatggcctcaatctcctgacctcatgatccacccgccaaggcttcccaaagtgctgggcttacaggcatgagccaccatgcccggcctacaattttttttttacatgtgtaaacctgtaaggggcatctttagcctttccactcaagacttcatgtgtaattttggtaggcctttggcctctgcctcagttcctccccacctacaaagtaaaaggtaatgctcttccccaaaaaattactatgtcataaatttttttttttttttttttttttttttttgagacgaaatctcactctgtcgcccaggctggagtgcagtggcgcgatgtctgcctcccgggttcaagcaattctgctgtctcagcctcccgaatagctgggactacaggcgcctgccaccatgcctggctagttttttgtattttgagtagagatgggatttcaccgtgttagccagtatgatctcgatctcctgacctcgtgatccacctgccttggcctcccaaggggctgggattacaggcgtgagccaccacaccggcccaaaaatttttaatttatatgaataaaagttcttagcatcagcatattttcttgtactggcatttctaaaaatgtgtttgtttatggaaagttaatggatgttcagcaaaataggtatttttctaattccagatgactcttagtcattaaaacaaatacttgtaaatattcaaaacagtgctatgctatatgttgtttaccaaagttatcatggagtcctcccctccctttttttgaaggaatattttgctaaaataatgttatatacttaagtatttatttgaaatgctcgtgtgcattttaaaatatttcagatcccatttcttggttctgtttcaggttgaatcatgtagctgctggtctcgtttcaccaagtctgaaatcggatacctctagtaaagaaatagaggaagctatgaaaagagtacgagaagcacagtccctaatttctgctgctatagaaccaggtaaacaatgtttatgcaattttgttgtgtgattcttagcaaaaatgattttgacataaatgtggaattgtgttgagtgacaccctagtcgtttaaaatgttgtaaactctgataaaagattgtatagtggagtgccactcagacgtatttggagacaattctggtggtcacaggagtaccaactgcatctagagggcaaaggaccaacatgttgctagatatcctgcaacaaacagcacagccttccacagcagtggttaatctagtccaaaatgtcagtaggattatctaatacttgaaacgatattttgtttttcttattatttatgtttttctaagttgggatagcctaattttaatttttttcattgatcaagagaacctagtgaaaatgcttctgtttaaaatgatatttctttaaagaaaattagttgtcttctttgcagattgtctttttgagagtaaatgaatagatatcatattatctgcccatatatatttagatctatggccctggattttctttcttataaatatcttgttcattaataaatgggaatgttttttaatgtgcctattgttaggaaaataattttaaagtataatagtggataaactgataccaaatgctttatatgtattatgttatttaaccaggaaaatgtcaaataattagccacagttacatggcaagcagtaggaacttttagatagcacagccgggtgtatgtaaagtttatgacacaccgtgttctaactgctgtttatattgaaaatatatgattaaagtgactgaatgtagtttctttatgaactgatgtttttaccaatatttttatgaatttattataatgacattcacaataaattgaaccctattaatgaaatgacttaaatgtaaaagaaactcaatctcactttgatgatagtcagtgaatgtagaatacaatgactttatttctcttgttatgtccccagttaaggaatttcttatgtgtagttctagatttcctttctatatttacacaattgaaaattggtagggaagaggagtgatgagcagataataggaagcgagctagcttactaaaatctgattctgtcacagaagtggactaaaatcagtgagtgaatcatgactttctgcatttgggggccaaatattgagtctgtgaagaatcaaggaaaggaaaggggacccctcatttagaaccttgtcaagagtaaatcagagccagagaatgagaaatttaccctctttatagactgctttacagaaaacacttcacagcctcttaagtctggcaagtaaaataggcaaaggaacctttagctagctgagaattagaagtctaatttggatctaccaaaagcttggatgatttgcaatttatagtatttcagtaagcttcaaaatcgtgattataaaatggttacttgtgacattcaagggttgtatgtaaaagctgaaaactaaggtgaaaaattattagaataacttctgaaagggaataatcttcctatttgatgtgtttttttgtttgcttgtttttgtttttgaggggtctcactctgttgccgaggctggagtgcagtggtgcaatcacagctcactgcaccgtccatctccaggctcaagcaatcctcccagctcagcctccccaagtacctgggaccacaggcacacaccgccatgcccagctaatttttgtattttttgtagagatgaggcctcactatattgcccaggctggtcttgaactcctggactgaagtgttgctcccacttcagcctctcatagtgctgtgattacaggcatgagccactgcgtctggcccctatttaataacttctaaatgcaggttccttttcttttaaatatagataagaaagaagaaaaaagaaggcattcaagatcaagatcacgttctaggaggaggaggactccctcatcttctagacacaggttagattgctttttagtcaattataccttagacaaagataatttatatatgtcacatcttttttaatttgctgttaatctgttatcctctggttaaagtgttttagtaacctctgctgttagaatgtgtgaatgactgttcacacatgtaaaaagtaagaaaagcgacagacgaaatagatgatttatgctttaaaacccccaaaaattcagaggtggtaggaaagcattggaactagagcaacaaaatgaaaaataattgattcattgaattatacaagtttccaaatactgacttgtatttgttatctagtgtcaaaaagtgacatctggtaatatcaccttagatcagatcagtaaaatgcaagtactaggaatctggcatgctcacaacaatggagtcattttccaaaatttaattttctcagatttttatcattggcaacagattcatctattttccttatataatagacttcatttatttttcaaaaaattgtctgccaaatacccaagtctaattaatcatagtttctagattctcaaaggtgataatgaaaaagcagttagttcagctcataactcaacacaggtgtcttccttaatacagccattatacttcataagcatcagaagtgatttatgcatactttccatttcatcacacagaatattactcaagagactagatttaattctgctactatattaatagtactgaagggggatttaataaaattaactttactgcttcatcaaagacatctttataaaagtggcattatttttttcttttactgcaagtgcatacagaaatgccagtgaagaagatagtgagtgactcctagggcagttcaatagcccctaccttgatttgtgttgaagagtcagtatttttacccactatggcttttgtgacattggtgcaaacgtcaacacagtggaaaaggcaataatttgttattactttgaaaataattttgaccttatggaccccataaaagggtcttagagcatccacagttgtgcaaacgacaatataaaagccattgctctaggttattcaccaactatttcagccattcttcgattttcttaatttccaaactcaatcctaattggcctagttgcatcctagttcttctagtcagaaccctttaggattgacattcagaactaggatattccagttgtggttatttacttcagccagtttcagcttcactttacatacccctccatcactggacttttttttttttttttttttttgagacggagtctcactcttgttgcccagcctggagtgcaatggcacgatcttggctcaccacaacttccgcctcctgagttcaagcaattctgcctcagcctcccgaatagctgggattacaggtgtgtgccaccatgcctggctgattttgtatttttagtagagactgggtttttccatgttggtcaggctcatctcaaacccgcgacctcaggtgatccacccaccttggcctcccaaagtgctgggattacaggtgtgagccaccatgcccggccattcaccacttgactcttaaaccttcactcctggcttcatctcttctggaacctagttctgtcagttgtctgccttttcttagtgtccgttaccccttagtttttaccaagggttagataaaaccatttctcctatttattgtcaggatttttgaaagagcagtgtgacttgaatcctagactttgtcacgtctctattaaaagcacttatatcataaaatatctaaaaagtcacatttctgtctcagagatgatcttttcactctgtttttatcttttaatatcattttcttattttaagtcatttcttgaagtattacaggggttatcctgtatgctatgtctgtttattccctgtcacccaccttatcccactgtcttattcttagagttgtctttcagaaacccaaatacagatcatgtcacagatactgagaagttccttattgccttgataaggtgatacataaaaccttagaatggctttcagggttctttactattccgtctggtttatctttttacacgtgtcatttgccactccaaaagttacaggactaattgcctcaacataccattttctttatgtcttcatgtttctgctcatgatcctttctgcctaatgcttttccacatcttccatttccgctttgaggaactcctttttctttcttcaagatacaatgcttgcagtcttaatcttccatgacagtgctctcatagtttagtttaacctctgcaataggatatacctcatgattactacaatttatatgtgtttccttttaccaaactcttaggaaaaaggagagcctgggccgggtggggtggctcacgcctgtagtcccagcacttggggaggccgaggcggaggatcacaaggtcaggagattgagaccagcctggccaacatagtgaaaccccgtctctcctaaaaacacaaaaatcagctgggtgtggtggcgcgcgcagctgtaatcccagctactcaggaggctgaagcaggagaatcgcttgaaccccggaggcggggattgcagtgagccaggatggcgccactgcactccagcttggtgacagcgagactccgtcttaaaaaaaaaaaaaaaagggagagcctgtgtctttttctttatattaaatcttactgggactctctcattttaatattaattactttactatgaccagtgaaaagtagaagtgaaatatgtccctgaatccagatacttgtaatacatcgtaacagaaatcattgttgtgggttgtggtaaccctcaccacacacacacaccccccacaccccacacccccaccaggctcaagccatcctcccacctcagcctcctgagcagctgggactacaggcatgcaccaccacacctggctaatttttgcaccttttttttttatgtagagacagggttttgccatgttgcccaggctggtctcgaactcctgagctcgagctgtttgcccacctcggcctcccaaagtgctggggtgacagatacaagccactgagtccagcccagttgtagtatcaagcatcacatagtgtgttaaatgaccatgactttcacaagctttttgactttattaaaaatatgttacactaatctcttttgctggttaaaagctcatatgaactagtaagtgtagaaaagtgacggtagtacattcccctttgaaaacaactgtttaatctcttaaggttatgattctgatattttatatgcctatatttcattcaaagtatattattggtgccttttatttaaatcaggcagtgtagtaattgctcaagaatacagtcatgaaaagacttacttcccatgtctttgtggagcctatggtagggtagttaagtagataaaaacatcttaggatgtggagatgttattgcaaggaattgtttagtaaatagtttcaaatatggctgaaaataagagattaaaattaaagttaattgagttcaataactcaaatagtttattgaggcattactatgggttttgaggcagttgttttagggagttatggcaacagaagctatattagtacatcagtaagaggaaagaaggacatcaatatttaatgtacagtcccctccgtatatgcaggggattggttacaaatccatctataccagaatccatgcatactcaagtcctctggaatccacatataggaaaactcagtcctgactatacatgggttcctcatccttcaaatactgtttttaatccacatttggttggtggcaaaaaaaaaaaaaaaaaaaaaaaaaaaaaaaaaaaaacacagtgtgtaggtggaaccatgccgttaaagctcatgttattcaagggtcacttgtgtgtgcctacactaaggcaccgagctagactctatatactgcatttaatctttgtcattatttggtgatagaggtgttactatccttgactgctgaagtaacaaggtcagagaggttagataatactcttaagttacctggcttataaatgagagtttaacacaagtctttaagatgtccatactctttcttgtaccttgaaaagaaaagtaggcagaaaatttagactatatttgaaatgttgcacagagagaagttgaatggtcactaaaagttaagtgatcaagactaagcaaaggattgcaacttatttttaatttttaaaatagaagagaatgggccggttgtggtggttaatgcctataatcccaactctgggaggccaaggtgggctggtggcttgagcccaggagttcaagaccatcctgggcaacatggcaaaaccccatcgcttaaaagatagaggagaatgagttttaatgcagtagggaggatgacaacatctaaaggttaattgtgcttcttagtcctggaagagccaggtcaggacacaatggatgggggctcggtgcagggagtagagaaacagatatgtcagggaaaaatgagagtaaaagaggcagtttatacaaattgtatatatctgtaaaaggtctgcattgcctggagtttcctaaattgtggattaaaggagtggaatttgtttcagagaaaaattcgaaataggagatggcaacacaataagtagtttctctttataaaatagaaataatagtggcatttactttatggacttacgagaccaatttgtagtttatatatagcgtgatataagtatttgatttatgatgaggaaggtttaagctgcactaatgaggaatcaaataagaaatacatgctaaaatgctatataattgtataagatgatgcaaataagtcatacttttattctccttcatgatctagtagtatttttaaccttggagttgtaagtacagtgggcatagaaggacctatctgacaggttgagcaaatcattaaaaggtgaggaattccaagtgttaaaaggtattactaatttctaaggtgttgaaggtgtttgttctatgggctaaataatagcaaatggaagggaattatcccccatttaattgtttagtccatatgtccgaatcttttgtctgatactaagcacaaaatttatagtctttttacatttatacacatgtattggcttccttttacactattaggcggtcaagaagcagatcgagacggcggtcacattctaagtctaggagtcggcgacgatccaaaagcccaaggcggagaagatctcattccagagaaagaggtagaaggtcaaggagcacatcaaaaacaaggtatagcattgggtgagaaagcaaattttagggttcccagtacccctagtactgtgctacttagtaacaaaagaggtggttggggtgcggggcagagaaatagggctagacaggggaagaaactgtcaatatttgagtttgaggaggctgacgtttgctttctggtgcttccttgtaaactgaaacttcagcttacagctgagggcctaagtaaaatttcttagtagtaggaattgttagctgtcctgctaccttctttcataagaaataccgtaacgttttatttccatctaaaaatatattcaaaaaccagtcttttcgtgtagaaccaaacacttttaaattagtatgcccccagtcatttatagttgtgaggcatacaatttcacagcacttaatttttttagcaactgctttttatctcttgctaaaatatttatcttaattttctagaagcaactctatatttggcattattttgttcatttatatatttagttaaatcatgtcattaaagtaagtacagctggggacacaacataacttactcttgggaagcataaaactcaactgatgagaacagaagagtgggggtagctttactatcattgttaaacctgtaataatggggcttttagtccttatgtgctgcagagtgaatcaaacaaggtagattaatagaacagttatacaaaggaattaagcatttctttaaggactttctgattactaggagaagagtgatggatttaattacaggggaggaactgttaaatgatgattgctacttgctgatattggaagaggtttgagaatgactcgagtattaaattctgaaagatttgactagactcaacgggaggcatgctttcaggtggagaatggtgtttcttgaaataacaatattttgatgtagttggactagaaaatgaggtcagaaaaatataatgagaccgatcgtggaaggctttgttgttcacactatgcacttgatccaggaggcaactggaatgagttgaaaatggtgaacagggaattaatattttcaggtttgtactttaaaagatttctgacagagtacagaatcagtttatggaaggcatgactgggacctactaggggactgttctagtaatctaggagttagatgataaagattcaaatgaagagggaaccaatgataaagattgaatgaagagggaaccgaggatgaccagagaagggaaaaaaatgaaattgagaatgcagaatggaaagattagcttagaacagtaagagagggatactttgattcttaaaattagagaatagttaaagaggggggttgttatgagacttctcattcaacaaatatatatcgtttatctactctttgcttagagtcttggggagaatgatgatcttggggaaaaaatattgtgaggagtaaaaatttataggaatctgtaaaaaaaaaaaattgagttacggctgtagtcaaaatctgttgatattttctaataagccctgaatagttcataatagccgcagaaaaagaagcttgcttgatccatgatagaggttgacatgggatgtgtgtcttggaagaatattcatgatattgatggattttggtagtgctctatgggttttggcctgataggagaggtgggttgggaaagtggtaatcagctgagagaaaaaggagtcttgaggagcctagagatagttaacttattggtgtttaccaagtatatttcaagccaacatcctagttattttctcacccatagtctactttagtctacttgggagaaaacctaggataataggattttaaaagaagttattgtacttcaaatatgccacataaagtattatttttaaaacagtttctgtcagaacaacatttatgcttttaaggatgggattagatctgattatatttttgtgtttgtagtgctatataaattggcatcagctgagtcttctaatgcattcataaattgtgttcatttgttagagacaaaaagaaagaagacaaagaaaagaaacgttctaaaacaccaccaaaaagttacagcacagccagacgttctagaagtgcaagcaggtaaggtggcattgtgaattcttggcaattatttttttaactttgcttctaacagtatcagtacgctgtcagtatgaagtcttttccagaacataagtatttcagtgttgaaaaaagttacattttgctgttatttaaagtttttaaaaggcaatttgtgaagaataatgtagtttatttttctttttacttaatattttatggtctagagtatatttgaagtaacatggaattcaagagaggtgagtttttctctttatagtttaagttttaatggctaaaccatactgaattgttccattaagtaagcttattatagtaagctatatttatcatctgcatgttagtacttgagaatttttctatcccttttaatgactgttgaattaatgggaagcaatgcaggttctggtttgtgtcattcttagactaattctatctttaagctgtcagtgaaaattgaaatgttgcagaccttactgcacaaaaagcacattttcatacttaatttgggatttatatgatagtaagggctggacttcattccatttttcagatctcattcacatgttttgctgcagtgcttgttttattcatcaacattacttaaattcactaggagaaggttcatgccatataaaaaaaaataactgaaatgtataaaagacctaaatgtaagagccaaaactataaaacctttagaaagaaacaaaagtgaatctttaagaccatgagcttggtggtttcctagatatgacttcaaaagcataagcaacagaagaaaagaaaattttggaattcaccaaaagttaaaacatttgtatttcaaaggatactatcaagaaagtaaaaacctagagtgctagttagaaaattctttatatattctctattaagaactcttagaactcagcaatagacaggcaacccaatttaaaaatggcaaagaatctgtagccattactccaaaggagatatgcaaatatctagtaagtacataaaatctgttcaacatcattagtcaccaaggaaatacaaaccagaccacagtgagatatgtcacagtcactaggatggttataaatcaaaaagacagatgatagctgagcctgacagatgatagtaagtgttgattaggatgtggagaaattagaaccctgtgcattgctagtatgaatataaactggtacaggtgttttagaaaacagtctggcatttcctaaaaatgttaaacatagaggtttttgacccaccagttgtacccctgggggaaaatgaaaacattttcacagaaaaacttttatgtgaatgtttgtggcattatttcataatagccaaaaagttaactatccattaacaaatggataaacagaatggtatatctatacaattgaatatttttcagtgataaataaggttgatacatgctacagtatggatgaaacttgcaaacatccatgaaaggccgtgtattgcgtgattccttttatatgaaatgcccagaataggcaaatctataaagataccaagtagattactgattgctggggagatagggaggattagagtgataactaaagggtagggagtttttggggtggtgaaaattttcttaaaaactaaatttttaagcatgaaaatgaaaccaaatgtaagtacagaaggaaatgctgaatcaggcctgagggataggtggcaaagagatagaaaagatggaaggtactacatatattttcttaccttaaaaactgttgaggatttttttttttacctgttgctttatataatgtacttgtaagtgccttctcatgctgtattattggatcactctaaattaaggcatcttctgtgagttattaaatacccactgtgtttgtagttgtgctacagtctgttgaaggacacggaaatgtaatataaaatacttcttccgtctagagaatttggagtttcagttacataagacagtagcaaaaagtataaggtgcacagtcgtgacaatgtttgataagtgaatgctcagttatgtgtaacgtttccaggacaagggtcacagagggctgtgtaagtagaaaaaaagcttcatttggaaattagacaactaagtacagggttttttaagtctgataacttttgagaatcaggaacagaatttttttttttaagttacagtaaaaaggaggggaaggctgtatatcagctgtatatcttcaaagtaattggtgaaagcagggttttgggggactgcaggagggcgattttgctagagtataaggtttctacctttccactaactagttctctgaatttcatctaatgatttaaaggtgaatgtggggatattttattagtaactaccttctatatcacattattgaattattctgtacttactctgaacactgaatgtttgaaccaaaaactaacttcttcagtaatagtttacttcacacgtcacccctctcgcattagttttgttaaatcagttttttctcaagcttagtatttctaacattttgtcatcaattaaaagaattactagaaattaggagttttcttgagggtagtaaagggaaagattcatggtttgcagatgattatattactcatttaattgtttagcttataccagtattgtgaaacaatctttcatttttctgtttttttgagacagggtctctctctgttgcccaggctggagtgcagtggccctatcacaactcactccagcttcaacctccgcaggctcaagtgatcttcctgcctctgcctcctgagtagctgggactacaggcatgcaccaccacacctggctaatttttttgtattttttgtagagacagagtttcaccatgttgcccaggctggtctggaactcctgggctcaagcaatcccctcacctcagcctgccaaagtgctgggattataggcatgagccactacatctggccacatctttcattgttagaatcatctatgatgtgtctgcatttttaagatcacactgtattttaaaacctagtttgcacatttgtgattctagagagagacgacgacgaagaagcaggagtggcacaagatctcctaaaaagcctcggtctcctaaaagaaaattgtcccgctcaccatcccctaggaggtaagaatgttaatcatttaaatgtattttttatatttttcagaggtttttcattttaaaactgtcctgtagtttttcttttcagcagttacagttcttaagaatgttttaatgtattctccttctgacttgtgacttaaacaccattaaggactgaacattttagtcctataaacaagttagttttgtagcctgtgttacttctccaaggttttgaagttggatctttgctgtactacttatatcctgtgaaattgagtcaggctcatcatctaaacaagttaaacctgttgctgtacattttactgtcattctagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaagtatgtttacaaattgatttatttttatatttggggtgatgttggtactttcagaagttatttttctttggagaagtttacttttattattctccttggcaaagcaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaactta

SEQ ID NO: 35639 - DNA, 47001 bp, Homo sapiens
gtggtgggactcgcgtcgcggccgcggagacgtgaaggtgagcgcctgggtcggcccgcgggcttcctccggccgcgctcggattgagggccgggcggaggtgccgcccttgagagcagccggttgtcgatgccgctcccctcagggacggctccgggcgggaaggtgcggggccaacggtcgcttccatcttgggccggccgggcgggggtggcgggagcggccgcggctcgggctccctgcgcgcggggcctccgcgccgcccccgcctcctccagccgcgggccgcggcctccccgggtgcccagcgggggagggggcgggggagagggaaattcaagcggccgcgtgtgcgggagacaaaagcgggcggcgggccgcattgtctgacggcgctccctctctgctttttgttctcgcctcgccgccccgcccctccgcagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggtgagtcctcggcgcggggagcaggggaggccttttgtgagatgcttttcattgagagtttcgcgggcacggaaacaaacgtgagccggggcttgccggactgtctgctggggtggagggttttaggtgagccctgacttccctactgtgtccctccggttgttgagactcaagaagccgcttttccaaggataagtccttttttttcgccccagatgctgggtagctaccaaacgatggaacttggaaacatccaagtaggtctctgcgagactgaaaggcgtttttaagtttcttgtgcggggagactgcgtcctgagatctgtgagccctttaaatgtattcagtcggttcacaagcttcaggcagttgaaagaaggcgcaggcacctttttgttacagacaatgtagtagggattttttcccaaacccagtaatggaaatttacttagaaaatctgaacagatactttatttttcaagtaagagtatctgttgtgctcccccccaccccccataaacaggagaggaggggagttcgggaaatgtgaaaaggacacagctgtatctgaagaacacaatgtcctggtaaatttcaacatttaataacatttccttgctgttgcacacctgtgcttaaacactagtgttgaagtgaattcgtttccagtgtggagcagacaaggaaagctttccaggttttgaactgtccagtcttagcaaggacgattgttgggtggagtaggtggctgctgtgattcacccttattagtgagagagaacatttttagctttgtcattccatggatcttttgatccgtaggataagtttttaaaactgaaataccagcattatatccaggagtgtttttaaatgtttcagtgctgccaagagtcatttctatgaataaaatgggaaataatctcatatggtttgccttttaagtgtcacttttacaagaggcctacttatttttgatgtgtttgtgcacatcatattttaggtgggctttgatagacaagcatactagactggggatttttcaaaagggaatggaagaaataatttctccctggcctcctcccccacccccaccccccaagccgcctttcttcatctcatcagaatggtggggcagggaatatgttccccaccccttgtttaaaaaaaaaaaatccacgaaacttttttaacctatctatttttctaatacgatgacaggcgatccggacaaaatcatggctgatggaaataactggtaaagaggcaaagaaagtaatgcagacagtgtgtactaaagtggagaaaacttaagattatttactttatgaagtcaaaacttcgttgtattcttccgtgtgctcttagcttccagtccctgcttggcattgaagaagcacttgtaaaagctttttggactgaattgctcgtattaaaaaattttgccaacttgaaagtagtggtagacttcaacttgagtaacatatggtaatggctgttaacagcattatctgttaccaagggaagactcataagaattccatatgttaaggttttctatgtatgtattttggatactcttacagcatatttcatttctgttcagtttattgcttttcaattagttaccttgaagcaattcagaatcaccgcgtgatttttcttgttctcgagcaaggtgactctgagccaaaggaatattcgttttattttgtggctcttataaattctgctttttatgatggcgtaagtcggggaagagttttgcttagttgatacgtagcttgagagagagaccaggtgttattagaatagaactttcatacagaccatttcaatggggacaacccctgaatttaggacagtctcttttatatactgagaagacatagaatagtttagtttgatgaatccgagacaccaaggcataaatgaaatattcataaaatggcttaagaggctaactggggcttggtggccaacctataaaaaatatcttgggaaagcacttcttcaagttggcaactgtattgagagctttctgtgtgccaggcactgtgctctgagcaatatggggaggaacaaaacagaaccgtggattttgccctctgatgatttataatttagagagcatgtgagagatacacaaacataaataccacaatattcccatcagatggttaatgaacacaatgctatgtagtctgaaggaaatagaaacctttgaaaaggcttcacaaagataccgtttttttggggtgaacgttgagggaagaggctggcggaggtgtcagtattaaaggaatatccggggtagggcttgttcggggaacagtgtgtcggtgtggctggagcagagttcatgtgcagagttgctgcaggagacaagcctggaaaggaaggcagccatcatcatttatagaagattggagtaaggggggtttcttcatttggttcatgggaaactggtttttttaaagttttatttatttattgtagagatgggatcttgttacacccaggctggtcttgaacttctggcctcaagcagtcctcatgacttggcctcccagagtcctgggattacagatgtcagcaccactgtacatgtagcagcatctagaattcgtggtttgagggctgactaaccagtctgtgatctgaactgacagataaggaagttataagacaagtgataattgatgagttagtaatttaataaggagtctaggaaagtagagtaacacctaaagtttttgaacatgcgtgctaacatagggttttctttttttcctttggtgaacaggaagaaagatttggtgtggaggaggtgagactaacttggtaattatagaagactagttaaagtaacatgaaggatagctaaatttttggtagaaaagagcagatattctcagcctcctccctttcatagagtaggttggggcagaattacttaaaccatgtattcaaaataactgtgtgaacaactctcaacccttttgataatcacggtattgaaagaggttactgaaccgtggaagcacaaaaaaatgttaaaatccaagagtaaagaactataagtgaaccaaactctctaagatgaggggagttaagatttcatccagttagagctgtctctcagtgtcattgtaaaaccgaagactttgggcttaactttctaagtctcttcgagttctcatggtttggggctgtagagtaatgcaggtcctagccattctgctctgctctgacatccttccacctcttaaatgagtagtttttaaagtccagattgaagaatacatgacaggttgaaaactggtgactttagggaaatggcttcagaaagaagtgaggcagaagtcattggtgatcttactgagtgttggcaagagcaaaatttagacacaaaaaaactgggctttggctggatgtggtggctcatgcctgtaatcccagcacattgggaggccaaggctggtggatcacctgaggtcaggagttggagactagcctggccaacatggtgaaaccccgtctctactaaaaatacaaaaaaattagccaggcgtggtggcacatgcctgtagttccagctactcgggaggccgaggcaggagaatcacctgaatctgggaggcgaaggttgcagtgagccgagatgtgccactgcactccagcctgggccacagagcgagactctgaaaacaaaaacaaaaccctgggcttaaatattacaggtaagatgtttaggagtcattaagaagaacttggatgtgagggaagggcaaatggaaaaagttagaggggttcacaaagctcttctgggacttgggaacaaaatctgtcatttacaaagtcagtgaccttggaataagaaccaggcagtttgagtgtatacaagataatttctatcttagacatcatattatcctctcctgtacatcagttctagtagaatttcagtaaattacttcagcataatgcataaacaatttcagaaactaaagtgcatatcgcaatttttaaaaatgagagttaaaatagtatgtagggaatctctggaagttgtctgtcttagtgtaaaagctttgtaaccttaattgagtagtatgcttgaatttagttgtgtttaaatttaatctcaataaaaaatgtcttacgctgctcattattttttagtaagactgatatgtttttcttcatagttaatgaatctgaatgtgattttattgacacagtggaaaaagtatgggctctgaatcaatttttgaatcgttgctccattaccttttattttcgtggactctggcaaatttcttaatccctcagactctctctcttctgtaaattgatgatggtgcctgcctttatgggcttgtagttagaataatggctcataattaacatttaccaggtattcactgcacactaaacactattttaagcactttatactcactttgctcccctaaggtaggttgatagtatctctgtttcagagttgaggaaaatgaggcataaagaagttagtaatgtggtcaagattacaaagctagtaagtgttaagagcaaggattttaacccaagtggtgtaactgcttatgacatgaaacacagtaggccctaagtacatggcagctcacttaagaccatggtgtgaatttctgttttgaggaatttgtgcattttaataaatataagacattaatgcttctaacgaggaaggtagacctgtgatgggcaaaactcctagtctgtaatattgaagactttcttatacacacaatagtgtaataagatttaaaaactcattgacgttgtgggttttgcccttagattgtaggctgcttaaaggcaagagttttggggggtttgggttttttttttttttgtgatggagtcttgctctgccacccaggctggggtacagtggcgccatctcagctcactgcaacctctgtctcccgggtttaagcaattctcctgcctcagcctcccgagtagctgggattacaggcatgcaccaccatgcctggctaattttttgtatttttggtagagatgtgccccagccaaggtttttgttgttgttttttaaagaatgaaatgggctgggcatggtggctcacgcctgtaatcctggcactttgggaggccgaggcaggtggatcacctgaggtcaggagttcgagaccagcctaggcaacatgataaaaccccatctctactaaaaatacaaaaaattagcctggcgtagtggcgggcacctgtaatcccagttacttgggaggctgaggcaaattgctacaatcggggagacagaggttgcagtgaggcgagattgtgccattgcactccagcctaggcgacagagcgaaactcttgtctcaaaaaaaaaaaagagtgaaatagaatattgtaagtttaaggttaggttcgtgtcactcaaccaggtgattttacccactccccactgcccccagcggaattttggcaacatctggagaccttttgggttaagacttgaggaaggaaggtgctgctcacgtctagtgggtagagaggcctgaatgctactaaacatcatgcggtgcacaggacactccccaacgaagaccccagccccccccatgccaataatgccaaggttgagatgccttggattagtccataaataaaatgagctgtattaagttgtattggattgtgtcatgctgtcctttggcttcttcctaacgtgttgatatcttacctgaacctcttgtctagctagacttgtcatttttccccttgtcattattgtgtgtatgctgttcaaactctacagttcaccttactgaaacttattcagtgggtcctattttttgtttggtttgatttgatttgtttttatttttgagacagagtctggctctgtggcctaggctggagtgcagttgcgccatctgggctcactgcaacctccacctcccgggctcgagccatcctcccacctcagcatccggagtagctgggactacaggcacttgccactatgcctggctaatttttgtattttttgtagagatgaagttttgccatgttgcccaggctggtcttgaactcctgagctcaagcaatccacccagagtgctgagattacaggcgtgaaccactgtgtctggccgggtcctatattttcaaagtgccacttcttcatagttgtctccaaagccctgagctcttttaaagacttcgcacagactgcaattatattgaaatctattagatgcagtgaaaattgatgaacggcaaatctcctcccctccttcatagtagcttggcatatgtggttcagactttttaaatttaattttatttatttatttatttattttgttgagacagagttttgctcttgttgcccaggctagagtgcagtggcgcaatcttggttcacctcaacctctgcctccgggttcaagcaattctcctgtgtcagcctcacaagtagttgggattacaggcatgcaccaccacacccggctaattttgtatttttagtagagacgaggtttctccgtgttggtcaggttggtctcaaactcccgacctcaggtgatcctcccgcctcggcttcccaaagtgctgggattataggcgtgagccactgcacccggccgtggttcagacttttaatgcagtggtgaacactgtcaacaatttttctccaaacaacccctgggaagaagatcgttgttgcatgctttatgctaggatttacttaagttctcgaagtggaatttccaaatcaaaagatgtgcggttttttccagatagccttctgaaaaggtatgtgtatacactgtcatcagcagtggttgagaaggtcattcatttcccctaaccctttccagcacaagcaagtttttaaggctaacaaaaatctggtgaccagaaggtttaacgtcttatctccttgttcagtattggatgtatgaggaccacctcccttctcacaaaggactgcttaagaaaactagtatttttaagtctcatgtagtttcatttagaacatgataccatagcatgggattagttcagtcaaggtgttgctttggcagttgggaaatctggttggctatggtaatgttctctatttttatcattaagaccagtttttgtatttaacactaatcctttccaaatggcaacagaaaacgtatctgaattcataccactgactttctggatatcagggaggtggtagagagacatcatttaaaagatgtgaagagaagcaaagtttatccattgctactttaattaaactcttaatccatagataagtcagtgataaatatgataaattactagatttgaaactattgtttgcatattgagtatttaaagacaaaatgatgataatacctaggacttcagagtaattgggggaatacagatgaaacaggagtgtctatgaattaatatagttgcagctggctttaattggaattcattgtactattctttgttctcctgtgtacctttaaaattccctattataagtttttcctcccctagaaattccactcttaggtgtttacgcaagagggaatgatgcatggggccaaggcgcataggtacaaaaatgttaataacagctttattctaagagcagaaaactagaaataatccactagtaggaaaattgataaacactgatgtattcataaatggaatactattcagcattaaaatgaatggaccactgatactacaatatgattgaatttcaaaaacatgctaggtgaaagaaactttgcatgaaaaagtacatagtgtatgtgattccatttatatgaaattttagaacaaacacaacctgtttatggtaggaaaaaaaatcaggaataatggcctctgtgggagaataggcagagattgggaaggggcaggcttctgggataattgtatttttttttttttttaatactttaagttctgggatacaagtgcaggacgtgcaggtttctttcataggtatacatgtgccatggtggtttgctgcacccatcagcccgtcatctacattaggtatttctccaatgctattcctcccctagcccccgacgccctgacagtccccgctgtgtgatgttcccctccttgtgtccatgtgttctcattgttcaactcccacttgtaagtgaaaacatgcggtgcttggttttctgttcctgtgttagtttgctgagaatgatggtttccagcttcatctatgtccttgcaaaggacatgaactcatcctttttatggttgcatagtattccatggtgtatatatgccacattttcttgatccagtttatcgttgatgggcatttgggttggttccaagtctttgctattgtgaatagtgctgcaataaacgtatgtgtgcatgtgtctttatagtagaatggataattgtattctttagttgatatgggtttgggttttatacatttgtcaaaactcagcaaatgtacacccaagatttgtgcattttgtatgtaaattttgctttgaaaaaaaactagtgatatgcctgtacttatgtcttcagcttgtaactgctagaaatgtatgggtatctgaaaaagcaagtatggcaaaaggttaatggtaagatccaggtggtggatatgtgggggtgttcactgtaattgttggttgccatgtattgggggttatgatatttcacatcactggttgagtgtctttaatacatatagcaagaagatagtgtgtagcctgtgtcttgttatcctcaagatacgagaatgtatagaacggtattgatccccacttaggagacatcactggcaccatcacttttttgtttgggtgatgagtgctaagtagattgatggagttaccagatgctgtgtaagacgtcttaattggccatactctgggacagtggttcacaaatttgatctcaggacccctttttagaaaataaaataactttaacaaaaaattgaatgagaatagcggcattgcatttcattcaacctattgtagtattccacctcctgtagcttctggaaaactccacttgtgagaaaatgacagtggaaaaaaagcaaatatcttagacttatgaaagtggttttactttgtctcctctccaccccacaaaggatataggggagacctctaggggttcccagactatactttgccctatgagaatttaattactgaagttaatagtagaactgctgttctacgagaattttattactgtgtttgggtgattgagcagtttattttctgagtagtcatcatatgtggtgataatggaatttgtaaaaccttccccacccttcccatttctctgcccctgcaccccatcttatccctaggaatataggtttgaagaccaggaaaatcacagatgtgataatgaagaaaggagaatagttgatattagacattgggtaataaaagtccctgttaattcctggaaaccagctaaagatctggtatgttggaatgtctttctgctttcttgtgttgagaaggataatatgaagttaataatctcttaacttgcccctcccaatacctgaccaaaaagcagagttgacatccatgaaaaatatggataatggtctttcagagctggttgcatttaagttttaaaaatacacagcttttggaggcagtaagtcaggttagctgttaaccagcattggtcaaagtatttatcagtgaaacttgtcttcataccaacctttgattgtcagtttacatgtttttctatccagatgagtagtatttcatgatctctttgtcatctggatttttactacagtatccagttgggtttggcacagtgtggtactaaatacatattctgtacgatactcttcatttgaacattctgtctcctgtacctttgctacaggctttacttagagaaatggaaaaataatggtgcaagtggtgagaccatgatgataagaacttacataaatttaaatgctttcttaaaggatggtcatagattgtgaacgtcatgtcgcggtgattggaggaaataaatggagaagtgtgtgaaaatgctttaaagccataagctatatggatcatcagattagacattttattcctgaataactcttactgctgttgttcttcaataattagtactccattttccctcttgttttgtacattccaccaaacattacttgaatgcagctcacaggatttttgctcttaaaagctacagttgttaaacctctgcagttaaacatatttatactaggtgttctgatctttcagcctggtactgtttccagtcatttgggaatatactttttagatcttcagtgctagtgtttgccctcttgggattctgatggataagaggttggaaaggttacattacggatttaaaatactcttgattatttggtgcctgattgcagagaccaccatttggaaggatagaatatcccattaaatatagctatgctctgtggaagttactttttacataattaaatttttaatatatttttaatttttttacatgtaactctttgtttttttgtgtatgtttttttttggtgagacaaggtctccctctgtctcccaggctggaatgtagtggcacgatctcagttcactgcaacctctgcctcctgggctgaagtgcacatataacatttaaacatttaatacctttttttggtattactgtatttattgttagggtttttcatgccttatttcttgctgttttaaatagtacagtgtacactgatgcagtttgaataactcagcaggtaggatttaaggttgtatacctctattttgttgttgacgatcagctgtacatctctggaaggtgatccttcttatacagataccaaaaagcacttagtgatttattttttgtccaggacaggtttctgaacatttctgcttgtaatcaaaatggcctggtaaatgtttataaacttattttagctattgatgaaactactgtagttttcttttaagtttatatcaggataccaaagcaacatatttagcccccacgtctgttgagtctttaaaggacctactaagattattagtatagattctcaaatattattttttcagaaggatgtattcctcttttttgctgtggtagtagaatttgtaattagagtttatggagaaaaaggactaaggggaagggtggaggtcacaaatttataaaagccctgaactatttctcatttaacacgtattctctgatcattttttctagtgtgttatttttgtttgttgttttgaacatctgaaataaacataggctgggcagggtggctcacacctataaccctagcaatttgggaggctaacacgggaggattgcttgagtccaggaattcgagaccagccctggcaacaaagtgtgagaccctgtctctaccaaaaaaaaaaaaaaaaatcaaaacagtggctggggatgtggtatgtgcctgtgagctaactggcggttgaggcaagagggtctcttaagcccaggaggtttaggctgcagtgatccgtcttcctgccacttcactcaagcctgggtgacagacctagtctctgtctcaaaaaagaaaatgaaacaaagacaactctaaagagtataggcacatatattgaaaagtcatagtgatgattgctacacaaataatttccctctttagaattaatttctctaaggaaacttatctcctttccttaagtttcaaagaaatgtttacaaaataatttggcttagttgcagatactatccttgttagagaagctatcttgttttttgttgtccttatgtaaaaacttggagtgtcagtttacatatattttaaaattaaatataattcaaataccataaattttacctttttaaatatgattctgtggtttttagtttattcacaaagttgtgcagccatcattattaattccagaacgttttcattaccacaaattctatatccattaatagtcattcactatcttcccttacctcagctcctgacaactactaatctgctttctatccctatagatttgcctcttctggacatttcatataaacagaatcatataatatgtagtgttttgtgtctggcttctttcacttagcctaatgccctcaaggtttatttgtgttgtagcttgcatcagaacttttttttttttttggcagagggtctcactctgtcacccaagctggagtacaatggcacggtcatgactcactgcatcctcaaactcctgggctcaagggatcctcctacttcagcctcccaaatagctgggattacagatgtgcaccaccaccctcagctgattttttagagatggggtctcactttgttgtccacgctggtctcaaactcctgggccagatgatcctcctgcatggcctcccagagtgctggaattacaagtgtgagccaccacacctaaccttttttaaataaaactcttatagtgtggtaagataacacgtaacataaaagttagcgttttaacccttcttaagctacagttcagtggtattaagtacattcattttgtcgtgcaatgcaaccagcaaccatcgtctgcaactcttcatcttgcaaaactgaaactctatacccattaaacagaagctctccattccccgctggcaaccaccattctactttctatgaatttgactactctaggtacctcatataagtggaattatagaatagttgtctttttgtgtctagcttatttcattttgcataatgtttatgttgaaacatgtatcagaattttgtgcttctttttgtggctgaataatattacactgtatagaaatactactttttttggacggacgtggtggctcacacctgtaatcacagcactttgggaggccgaggcgggcggatcacgaggtcaggagatggagaccatcttggctaacatggtgaaaccccgtctctactaaaaaaaaaaaaaaaattagccgggcgtagtggcaggcacctgtagtcccagctactcgggaggctgaggcaggagaatggcgtgaacccaggaggcggagcttgcagtgagccgagatcactccactgcactccagcctgggcaacagagtaagactctgtctccaaatacaaaacaaaacaaaacaaagtactactttttaaaaatcttttgtccatcgatggacatatttgggttgcttctacctttaggctgttaagaataatgctgctgtgagaatttgcttgggcatgttttcatttctcttgtgtatatacccatttaatgttttaggaactgccagattgttttccgaagtggctgtactatcttacattcccaccacagtgtaagagagttccagtttctctacatcctcaccaatcctggtggatatgaaatggtatcatgtacttattggcctttagtatatgctctttggagaaatgtctgttcagatcctttgcttgttttaaaattgggttatttgtgtttttatcattgggttgtaatcttttttttttttaaatatattatggatactagacctttatcagatagatgatttgcaaatgtttttctcccgttctgtggattgtcttgttagtgtcctttgaagcagaaacattgttaattttgaagtcctttttttttttttttggttgcttatgtttttggtataagatctaagaaaccattgcctagtccaaggtcatgaagatatatacttatgatttcttctaagttttatcattttagctcctgtgtttaggtctttagtccattttgagttcctttttgcatatggagtgaggaaaaggtccaattttattcttttgcatgtggatatccaattgccctggcaccatttgttgaaataacaattcatttatccttgatctgaaattctcacacttatagaaaatataatcagatctaattgggtataaggaaaactcatgatttctgtggttcctgtgttctagccaagttgacagcgctgtattttgtttccattactctactgtaatgtattccctctccctttctgcacgctgaaatcacacccatcctacgaaatgcaatttgggtactattacgttctatagttacaaattatagcttgttaatacttttcaattctgttacctagcaccatccagtgtgcagttatgggtagataagacatgagtaaggaaattgtaaggaaattgaggcatgttaatttactcagttccacagctagttagctgtgaaactcaaattccccttttctagaatcgtgttctttgagttctcctactgcctttcattgtagagccctcctttacaggaccctgttcttctgagatcatctctcctttctctgaattcccttgtgtgtaagtggggaagaatctaggctttaaatatatatgcccttcaaccagtgtgctcccttttatctgttttaatatatactggtattgctcataaagacttggggaaggaataattactgcttcttcactcaatcattaccatgtaacatggagtttgggttccctaagaggacctctgagaccttccagcatttttcttcagcctcttttctcactcattgttccctctgtcctccaaccacatgaaactacctgtggttctttcctatattgcccactttcttacctttgctctagttctttttttttttttctttttattattttctgaattgaaaaaaattctttttaagactagtcaagtgcagtagtgagaaagggggaagagtagaacaaggagtttgatttggtaactgaatgaacaatcaagataactccttaccttcggaccagcctgctctaattttttaccctctgtaataatatgtgattatgtttatatagtgtcttctttttcaccaagtttggtaatgagatccagttcagttctatattgtctggagtttaccggtttcctaagttgctcttgtgactgctagcaaagtaaattatgcccaattcagatcagtattggtaagctgtaaggacataagaataaggacttcatctttattttttcctctatgtactgttaaacactacttcatgtccagggtttttatgttgtccctgggggttcatttgaatatgatcagtaactcatataagtttagttgtaaatgcgaaataattttcttaaccataggctcttaaattcctgttgactctattcttccctttgtaccccataacagagctgatagactagaggcaggaaggggttgtatatacttcagctgcagagataaatgtatatggcatgtgttagttataaatggaaaagttagcctgcaaataatgacgtaatttctataacgtagtagtggcttaattcagtttgccatagacttaggcaaagctcaaatcaaagtatacttgtgtccttgctagtataaaccattttctatctttagtagtcttcttaggatatagcaaaacttgacccatatatactaagctagcaaggcaattttgacctatttttgtttaatgcaacatccttttattaggtatcaggatgtctgtccattttgattactttatgaccagaccaagatttgacttttgccccccattttaaggaaagttctttgtttcttctttatgatttgtccttttcctccacaaattaatggctaaaaaacagatgcctttcccaaatcagtagctaaaacagcttgtggatgctagtaaattgtaaattctctaaggggaagaaagtgtgtatagactttggcgtttatttgccttgattctttttgtagcactgtcctggaaatgttgttaaatgatggtgatgtatgtgtaattgtttttaatgcagattgacagatttggaatgtagtatgtgtcaccagtggaagtattaaacttttcttccaaacctgaatatcctgggaatcttggagcagaaggtagaacattttatattgcggttatggccactcagtatccagcttctaaaatgtggggatatagcataggagcccagagactggacattatgtttattgctaatagcatctggaattggttaggctgcattggatgaagtgaaggaacaaacactctgattttctctaatactgtcacattgcagctcacccatacccttactttattgcctcatgacttgtcagaggctaccatctttctgttaggtatcttcaccactgcagtcacagcacctcagtacctgagttggaagacagggtgaacatttttcctcaactacatctttattttttttacgtggttaattgtttggggcaggggcaaggtaatactgtgctcacaaaaaggctgtccctttccctgtaagacaccactgtgctatagcagatgttgatagcaatattactgtatgtaattttgcctgggttgtgggatggtggtggctagagatcagatggactgggaaaagatgtcgagaaatatttgggtcatggagataatgctgcttctctttgtatttagagtcttggattctcttcatctgctgcttccctttctcttttgcctgtttatcctgtgggttttagctccttattttctttagcccacaaaaataataaaccacttgattgcataagcctacccttaggcttgtatttgctttcactataactacagtggcacatatcccactgagtgtgaggagcccatattctctgacatcatgacaacttattgtttaattcatgacattaatttggcaaatattccagttaatgttgggttttatgccttttttgttccttttagacttaaatctcaaaagtttgaaaactttttatgtgatgtgatttttagtctgcacaaatactgatgttaatcctttttcatccagaaaagcaaattcacattaatgagtgctccatatgaaggcccaataacactttttaaaaaaaatatttttgaaggattttccctcttcttatcaggataaggaagaggtagtagggtgctagacgagtaaaatagtgtacattcatggttgagggtttgtccctccctcatcctgttggctctatgtctaatttgttggtctgttgagagaggagctgcaaggattaagtcaggcaaagagacatgatcgagccatgtttattgtttgttggtaaatgtacaggaggacccaaattaccactagaagattgagtggtgaacacagaaatcaacaagaggctgtagttggatgaccttcatgaccagtcactctaatagtgctgcatctagcctcagtgtagctgccttactgttgaaagactgtactcatgggctcgggtggctttatctttgagtagtgctggagatacttagtgttgctttttaaactttcctcccaatacctgctgtattcctagcatcctgacatgaagaatacttgcatatgttacttcttagagtgccacttaggtttttgggaggcaccttgttgttgctccacactcctcctactggtccagaaaaggttataatagacataaggttgatgtcagtcaggacaatgcttcccaactccttttgtgtaatggcacacagaataacaatctttgtatagtacagaggaaaatggatttctcaccctgctgtggtggttactaaggggatcaatatctctttaccatttaaattacctggaagctctaggttagggtctgattctgcaggaccttgagtctgcagaacaatgtctggctttaagtttatcctttaacaggccattgggggttttgagaaggagttaacgtgcccgcaatggaatttaagattaatctggcagcaaggtgtaaactggatccgagaaagaggaacccaaaaacctggtagatcagttagattattggagcagttgaggtgaaatgatacagttaacttgggtaatagaaataggaatgagactgagaagatagattttcaaaaatactgtgacactgtgaaaaggtgaaatcagtaggactttggcaatttgtggtggaatgggaaatggagagtgaaaactcagaggtagtgtggatgaacgtaggtggctgggagatcagagggtgagggaataattggtagaaataagtaatgtaagtatagaaacagggatgggcgcagtggctcacgcctgtaattccagcgctttgggaggccaaggcgggtagatcacatgagcccaggagtttgagaccagcctggccaacatggccaaacctcatctgctaaaaatacgaaaattagctgggcgtggtggtgcacacctgtaatcccagctactcgggtggctgaggcacgagaatcgcttgaacccgggaggcagaggttgtagtgagctgacatcgcaccactgcattccagcctctgggtgacacagtgagacctagcctcaaaaaaagagtatagaaacaggtttgggatctagtagatatacatatttcaaaatatgtaaggatactaagccatgtaacactacagagaagttaggagtgtgtatgtgttggggggtatttcccaaaagatggagcgggagggttagcattactcttgtgagtttactgcaattcatggtgtggcctttagctttgtgagctataccagggtggagcaatctttcaagcctagatccacagtgatcaagctcatgcgactggtgcataaaaccaggaaagttagcttattcatttacagtgagccataactagcacaaagattgcagtactgtgttgacatgactagtatgttctctttcaggaggcagatagactcacgtaggaatcaagacataatcattaaattgtttagtaagtgtggtatgacagagaagagttggatgctgctcaaatgttgaatgaccatcgtctccacagtagggggtagatttgttagtgcactgattgtggttcacacttttttagactgtacattggatccttcagtgtccttatgtatcaaacccggacaagaaaatatcttttctttcagtggctctaaagagaagggaaatatatgttctcaaagtatactatgcttacttgtctgagaaaagtttccaaatcagtcttgacttcctggagaaaactacttccaggggcttgggtgactaaatatagaaggcagggagaatgagtccaaagaaagagtagggtgactcctaggtttctgcctagggctactgagtacttttcctaagacagaaaatcgagtaggggagcagaatcaatagtagatcgtgtcaggaaggtaaatttaatttttaaaaaatgagtaggcagggtgcggtggctcatgcctgtaaccccagcactttccgaggccgaggcagacggatcacctcaggttgggagttcgagaccagcctgaccaacatggagaaaccccgtctctattaaagatacaaaattagccgggcatggtggcgcatgcctgtaatcccagctacttggaaagctgaggcaggagaatcgtttgaacccaggaggtggaggttgcagtgagccgagattgcgccgttgcactccagcctgggcaagaagaatgaaactctgtctcaaaaaaaagagtaaagtttaaagttccagtggtccatccagatgttaatatatgtcggaggcacttggtatggtatgtaagagaaagatttgtgtcatgctgtatgacacaattgagggttatgtaccaagcagagtttgtgttaactcatttaatcttcacaacaaccctatgaattaagaactgtcagtaactgttttacagatgaagaaactgagatacaactaggtaaggagcaaatttgtgagttattagcatgtagatattggttaaatcataccagtgaaatggacccatgtcgtcttgtcatttaccttaagatagatactgggctgttgaaatatttaggatccttgattattctagtgaaacattttcttctggagcaaataatcaatacttcagttgtcagattttagaaagtatggtcttaaaaggcagacacttggtagattaagggggaaaaaatcatgtaactgtcctccaaaattaagataatcctctgaaagagatgcgggaaacacgtgtcctcttcatacttctttgctttaatagccaactcagtcctttacagtactcttattttggactgttaatactctaattgatgacttcttttattccattacttcttccttcccactctaaaaaagtttcttttagtaatgatctgtgagtgggaacttctgtctttctggaaacgtctttatgtttttgcactgtttttgtgtggtgctttaattggttacagaattctagttgacagttgtttttctccgcactttgaagatacttacttgattgttttctgatgaaaaatcagctgtcatattgttgtttcttcctttatggtaatgtgtcatttctctggttgcttttaagaattttcttgtctttggcattctgcaattttaccatgatctaggtatgatttttttttatcttgcttgggatttattgtgcttttcctatctcaaggtatttatcccattactggaagtctcggccattatcccagaataacatctcatcttcattctttctgttctctcctgaaatagctgttggctattaccttagaccttctctttctattcgcatcttataatttttccactttttttgtcttattctttattctgtattctgagtaatttattcaaatatgccttttgttgtattaattttctttgtccatctccaattttaaagttgttttcatttttttttattctaaaagcccttccgcttctcccacctccaagctgccttttaaaattcactgtatatatggttcatttctcctggcttctgtttttcttttaaaatctttttgattgttttagtcaggaaaaatttcaaacttaggtagaggtgaagaaaatcctgtagtaaccctatgtatccagcctcaacatctttaaaagattatttaattattttcagcatatttatgttttattatacacagttttaaagctcttgggaactgactatcctgtttgtgtctgctgacgcctcatgatagagaatccgtcccttgagtatttttgttatttttgtttgtttgtttgtttgtttgtttgatttggagtcttgctctgttgctcaggctggagtgcagtggtacaatctcagctcactgcaaacctgtacctcctgggttcaagtgatcttcctgcctcagcctcctgagtagctgggattacaggcacccgccaacacgcctggctaatttttgtagggacggggtttcgccatgttggccaggctggtttcgaactcctgacctcaagtgatccacccacctcggcctcccaaaatgttgggattacaggcgtgagccatcgcacccagcctgttatttttaatagcgtggatgttgcttttttttatggcacttgtgtgtaccttagattgtgagaatctctctgtttacacagtagttttgattatttgtgctgggcacactgtgctccagcccatttttaacattttcagcttgtgttttcatacatcatgcatgaaataaacgtttgactagcacctgcacagaagaacataggttcgagtttctgctttttatgggagactgcacccccaaaaacccaggaagtagatttctggctacttctcagcgatgacaaagtttttctagggtcctcaccctcctccacactgttgttgtgttgtaaactttcacttattgctgtagctttctttcctcctatctagcgcctcgatgtatttcccctcttttctttgaagctctactgtatgttttttctatttttatttaaagtatttctacttagcatttagattatttttagtagaagagggaggtattctccgtaagctcagtctcactgtgttgccggaaccagaaagtcatgtttctgtgaatctattttaaggttgtgagtcacacatttcttaagtactccatactgaaagtgaatgcagtgtgttttaatctgatatactgctctttattgctctaaaattagtaacatttggccaggctcggtggctcacgcctgtaataccagcactttgggaggctgaggtgggcggattacgtcaggagttcgagaccagcctggctgacatggcgaaaaccccgtctctactaaaaatacaagaaatagccaggcgtggtagctggtacctgtagtcccagctacttgggaggctgaggcaggagaattgcttgaacccaggaggcagaggttgcagtgagccgagattatgccactgcactccagcctgggtgacagactgagactctgtctcaaaaaaaaaaaaaaaaaagaggaagaatttagtaacctttaaaatgtgttaccatttcatatggtcaggtagacaataaacacaaattcagacttgcatttcaactaaaagtctcctctttgtctattttatttgtgctgaaatcacagtcatattcacttgcgtttctcatgtcggtcagaagtgttggtactgttttatctgatttaatgtaatagaaaaatgccaggtacgatggctcacgcctgtaatcctagcactttgggaagccgaggggggtggatcacgaggtcaggagttcgagattagcctagccagcatggtgaaattcagtctactaaaaatacaaaaaaaaaaaaaattagctgggcatggtggtatgtgcctgttagtcccagctactcgagcggctgaggcaggagaatcacttgaacctgggaggtggacgttgcagtgagccgagatcacaccactgcactccagcctgggcaacagagcaaaaccctgtctcaaaaaaaaaaagaaaaaaaaaagtaatagaaaaatattaggccaggcgtgtggctcacgcctgtaatcccagcactttggaaggccaagatgggcggatcacaggtcaggagttcgagaccagcatgaccaacatggtgaaaccccatctctactaaaatacaaaaattagccgggtatggtgtcgcgcacgtgtaatcccagctacttgggaggctgaggcgggagaatcgcttgaacccgggaggtggaggttgcagtgagccaagattatgctactgcactgcagcctgggcgacagagtgagactctgtctcaaaaaaaaaaaaaagaaaaatattaaatgcagttgtgttgccagacaggctgtttacatatagtttcatctgagagacagctaaaaaatgaactaattagtatatagagttcctacaaagcagtaaggaaaaactcattaggaaaagggcaaaggatatacactcaccaacatggtgaaaccccttctctagtaaaaatacagaaattagcccagtgtggcggcatgtgcctgtaatcccagctactcaggaggctgaggcaggataatggcgtgaacctgagtggcggaggttgcagtgagccgatatcacaccactgcactccaggctgggcaacagagcgagactccgtctcaaaaaatatacacacacacacacagacagatgttcacctgcatttatgataaggaaaaatgctaataaaactgtagtaaggtatttttcacccattagattggaaaaggttttttatttttatttttatttttatttttattttagtagagacggggtttcaccgtgtttcccaggctggtcacaaactcctgagctcaggcagtctgcctgccttggcctcccaaagtgctgggattacaggcatgagccaccaagcctggccggaaaaggtgtttaaagtttgttacacactgggttcagaaagatgttgagaaatgggaacatttatgcattgctagtgggagtataaattgaaattaactccaggaaggacagtttaacaatttatcttgtggatcaagtgtacatttggtgcatagttggaaataccaagattggaagcagcttaagtgttcctcagaggaagctaaataaataattagggtgcccatacagtagaatactgtacatatagtgttatatatagaatgaggcagctattaaatatatggacatggaattatctcagagcgcttactaaatggaaaagctaaggtgtagaataatgtgtagtgtgctaacatgagggagaggggaacatacatagattttaaatgttttgaatccttaaaagaatgtacaagaggctgggcgcggtggctcaagcctgtaatcgcagcattttgggaggccacagcgggcagatcacttgagtcaggagttggagaccagcctggccaacatggtgaaaacccccctctaccaaaaaaaaaaaaaaattagccggtcatggtggtgcacacctgtagtcccagctactggggaggctgaggtgggagaattgcctgaacccgggaagcagaggttgcagtgagccgagatcgcaccactgcactccagcatgggcgatgcattgagaccctgtctcagaaacaaaacaacaacaacaaaaagaatgtacaagaaactagtaaatgatggctgccttgggcaggggacaagaattggacatatcaagtgaggatttttttaaaaaagtattccctgaaggagcttagaaacagagcagaggctggggtgtggtggcctcatgcctgtaatcccagcactttgagaggctgacgtgggaggatcacttgagctcagtagttaccagcctgggtaaaatggcaaaaccccatctctacaaaaaaatacaaaaattagccagatgtggtggtatgcgcctgtggtcccagctacttgggaggctgaggtgggaggattactcgagcctagaagttgctgctgcagtgagctgagatgatgccactgtattctagcatgagcaacagagtgagaccctgtctcaaaaaaaaaaaaaaaagagagaacagaatggggaaactatcattttttcttaggaatttttgagtagtcttaacctattacacattatgactttgatcaaaataaataaaataattcacatatcatttcaaagtagtattctgtatgaaattccacttctgttgcatccatttcaacatgttgccaggccatggctgatgttcatttgacaaataatgagtcctactatgtgatagacactgtgctacattttgtgaatgaaaaataactgagaaaacatttttattgagttcatctgcttaagagtttgccgttttggtttagtgcttcagaattactgtagattcttaaaactggagaatttttttttattataaccatcgctctgtatctgaggggaattggtttcagcacctccttgaatactgaaatccacacatacgcaagttccttcttcagccctctggaacctgtgggttcaaaaagccggccctccttacatgcaggttttgcgtctccttaatactgtgtttgtgatccatgtttggttgtggttgtagaacctgctgatagggaggcctgactggaaaaaatccgtagaaaagtggacccataaagttcaaacctgtgttcaagggtcaaatgtgttttgtagaagaggagatgaaactgaggaacttgatctaaactcatactctaaaaccaaattactggcccagtgcttattccactgagtcagtcaaatataattcatagtgaatactgtgaaatattggtgtctttagttctctttgtgattgaaatttctttcttttataaagaaagtcaccttcagtgactttctacatcttagtgcagataaaccttttcaaatgccagtcttcgccttggaataccttttccccccgtattttctgtctctcgtttgttaccttaagaaaaattcttctaactccataattaaataattattttttattttgagctcccatagcacttgtatatacccgttctctcagtgtttctgctcaggtggggagcgtagcactgactttggacagaggtcagtggtgctacacatcctttaacacataggagcccaggcctgtgtaaggaattgtccagctgttctttcagttaggtaaaaaacttagaggagctatctgaggccaaagcctaatttggctttacatttaaagacaaagttttagtttatgggttttgttgttgttgagatggagtgtcactctgtcgtccaggctggagtgcagtggcgtgatctcagctcactgtgacctcctcctcctgggttaaagagattcccttgcctcagcctcccaagtagctgggattacaggtgtacaccaccacgcccagctagttttttagtatttttaatagaggggagtttcaccatgctagccaggctgctctcgaactcctgaccgcgaatgatccatctgcctcagcctcccgaagtgttgggattaccaggtgtgagccaccatgcctggcctattttatggttttaataacatacagaattaaccaggaatgcatctactgtgtaaaaatcaaggaaagccaggcatggtggctcatgcccgtaatcacagcactttgggaggctgaggcaggaggatcatctgaggtcaggagtttgagaccagcctggccaacatggagaaaccccgtctcttctaaaaaaaaattagaaaaattagccaggcatgattatgcgtgcctgtaatcccagttactcgggaggctgaggctcaagaattgcttgaacctgggaagttggggttgcagtgagctgagatcgtgtcactgcacttcagcccgggcaacagagcgagactccagctcaaaaaaaaaaaaaaaaattcaagggagaattgtactttgttttgcttgtaacttgactggtcaggccattcatgatatttgaacagattgtaagtctgtatttgaaggttgtttgttgttgttgattcttagaggcagatatctgactacgttgtgtttatactttagctatatgaatgtttacctattgaaaatactgttttattaaaaattactttgttccttataccttaggagataaatgtacattttaaaagtgttcctcagtcaggtgaggtggcttatgcctgtaagttcaacacttggggaggccgaagcaggaggatcacttgaggccagaagttcaagaccagcctaggcaacatagcaagactgtgtccctactatatatatatatatatatatatatatatatatatatatattttttttttttttttttttttttttttttttttaaattaggcatggtggttcacacctgtaatcccagcattttgggaggctgaggcaggaggaccacttgagcctaggagttaccagtctgtgcaagatgatgagaccctgtctctccaaaatataaaaacaattagctgggcgtggtagcctgtgcctatagtagggctaaggtgggaggatcccttgagtccaggagttcaaggatgcagtaagctgtgatcactgcactgcactccgttccaggctgggggagacagctgggtggtgggactcacctgtactcctagctactcaggagtagctgtttaaaaaaaaaatgtgcgtaggtgtattattagctactagtttcattttaacttagttaaggaggcataaaatgttattaaaggacttatttttatttatttatttattgagacagggtcttgctctgtcacccaggctggagtgcagtggtgtgatcataggtcactgcagccttgaacatctgggtacaaacaaccctcctaagtagctgggacttacaggcatgaggcaccatgcctggctaattttttaatttttggtagagacaagatcatgcttagctgcccagactaatctggaactcctggctacaagtgatcctcattccttggcctcccaaagtgccggaattttaggcatgagccaccacacctggccaggagttattatattaaaggataagtgaatagaggaggagggaaaggatatttacaaattaaaagctctaatgtatcattactaaagttgctttattttttggcattactgaggttaatattatggttcgttgtctgaattagtatctgttcatttgatatatagacaactttttgtttttattaatcttaagaaccagccaggcatggtggctcatgcctgtaatcccagcactttgggaggccgaggcaggcaaatcatctgaggtcaggagatcgagaccaccctggccaacacagcaaaaccccgtctgctaaaaatacaaaaagaaattagccgagcaaggtggtgagtacctgtaatcccagctacacaggaggctgaggccggagaatcgcttgaacccgggaggcagaggttgcaatgagctaagatcacaccactgcactccaacctgggtgacagagtgagattctgtctcaaaaaaaaaaaaacaatcttaagaactgctcttagttatggatggcatcacgtgtgtggttctcagtgtatgcctaaggaagttttattaccttttatatgaacgttaaatggtacaccaggatgattcattttttaccttttaagtattgaagtaataattttgaattataatattttttgtttgtttgtttttttgaggtggagtttcactcttgttgtccaggctggaatgcagtggtgcaattctggctcactgctcactgcaacctctgcctcctgggttcaagcagttctgcctcagcctcccgagtagctgggattacaggcgtgcgccaccacacccagctaatttttgtattattagtagagacggggtttcaccatgttggccaggctggtctcaaacccttgacttcaggtgatccacccaccatggcttcccaaagtgctgggattacaggcttgagccaccatgaccggcctgaattataatattaatgtcttatctacaggatgaccacacaatgtcttccaaagtgggatatttctaagaatgaaaataaatagcattaataattgcagatttggttgtagaccaccacaattgagtgaattatctcaataaagcaagtcacagaaatttttggttccctacagtgtataaaagtcatgcttacactatactgtagtctgttaagtgcacaatagcattttgtctaaaaaccagcgtatgtaccttaaatagaaaatacttaattgccaagaaatcgatcatctaagcctttagaagtccttatctttttgctggtggagggtcttgcctccatgttgatggttgctgactggttgggggtggccgtggcaattgcttaaaataagacaacagtgaagtttgctgcatcagtttgtgcttcctttcacaaaagatttttcttttttcttttttctttttttttgagacagagtttcgctcttgttgcccaggctggagtgcaatggcgcgacctcggctcaccacaacctctgcctcccgggttcaatcaattctccttctttagcctcccaagtagctgggattacaggcatgcaccaccacacccaactaattttgtatttttagtagagatggggtttctccatgttggtcaggctggtcttgaactcctgacctcaggtgatctgcccgcttgggcctctcaagtgctgggattataggcatgagtcaccacacccggccctcaaacgatttttctatagcatgtgatgctgtttgatgccatctcagctagaatagaatttctttcaaaatcagaggcaatcctctcaaaccctgccactgctctatcaactaagtttatgcagtgttttcagtcctttgttgtcatttcaacggtgttaatggcatcttcaccagaagtagatccttctcaagaaaccactttctttgctcatccatgagaagcaagttctcatctgttcaagttttaacatgagtttgcagcaattcagtcacatcttcaggctccatttctaattctagtatttctcttcctgtttctaccacatctgcaggtggaagatttccactgaaatcttaaaagtcctcaaagtcattcatgagagtagaaatcagcttcttccaaactgttgttaatgttaatattttgacttcttcccatgaatcacaaatcttcttaatggcatctagaatggtgaatcctttctaggtggttttcaatttattttcccagatctgtcagaagaaccactgtctatgacagctatggccttacgaaatgtatttcttaaataattccacttgaaagttgaaattactccttgatctatgggctgcagaatggatgttgttttatgtgagcaggcatgaaaacagcattaatcttgtacatctccctcagagctctttggtaaacaggtgctgcattgtcaatgagcaattataatttgaaaggaatcttttttttctgagcagtaggtctcaacaatggacttaaaatattcagtgaagcattttgtaaacagatgccgtcatccaggcttggttggttgttccatttgtagagtgcaggcagagtagatttagcataattcttaaggaccctaggatttttggaatgctaaatgagcattggcttcatcttaaagtcaccagctgcaattagctctgaagagtcagccttcctttaaagccagatactgacctcctatgaaagtacttgatggcatcttctggtatgaggctgtttcctctacattggaaatatggtattttgtgtagccatcttcattcatcagtgatattagctagatcttctggataacttactgcagctctacattcgcacttgtaccttcagcttgtacttttatgttctggaggtgacttctttcggtcaacctcatgaatcaacctctcctagcttcaaatttttcttatgcagcttccttacttctctcagccttcactgaattgaagagaattaaggccttgctctggattaggctttgatttaaaggaatgttgtggctggcctcagcttctattcagaccacataaagttttctccatatcatcaataagtctgttttgctttcttatcatttgtgtgttcactggggtagcacttttaatttccttcaagagctctttctttgcacttacgacattgctgtttggtacaagaggcccagctttagcttgtcttggctttcgacatgccttcctcactaagtttaattatttctagcttttgtaagtaagagacatgtaactcatcttttcacttgaacacttaattaaaggccattgtagggttattaattggtctaattttaatatttttgtgtctcagggaataggtaagccagaggagacagaagagattgggagcaccccattgttggagcagtcagaacagacacagcatatatcgattaagtttaccatcttgtgtgggcatgcattctggtaccccaaaacaattacagtagtaacgttaatgaccaccgatcacagattgccatagcagataaaataatcataaaaagtttgaaatattgggagaattaccaaaatgtgccacagagacatgaagttgagcacacgctggtggaaattggctctgatagacatgcttgattcagtgttgctacaaaccttcaattggttaaaacaacaaaaacacaccacagtatctgcaaaagagcagtagagcaaaagacaataaaatgagatctgtctgctaggacagtgggcttaaactggaatggtcctgggcagccaggtcacatggtcactttactactccagtatacctcattgttaaaatgtggttgtagaggtttggaatttggtataggattaaatgaaaagttttaaccttgtggatacaaggatgtaaggatctgattaggctttgcaacttgagtttgactgatgtcttctgtgtggtgtccgctaaatcccacagcatataggatcagtcgcattggttataaggtttgcttctggctgggtgcggtggctcatgcctgtaatcccaacattgggaggccaaggcaggcggaccacctgaagtcgggagtttgagaccagcctgaccaacatggagaaaccttgtctctactaaaaaaaaaaaaaaaaaaaaaaaaaaaatagcccggcatggtggtgcatgcctgtagtcccagttactcgggaggctgaggcaggagaattgcttgaacctgggaggcagaggttgcggtgagccgagatcatgccattgcactccagcctgggcgagatcgcaccattgcactccagcctgggcaacaagagtgaaactctgtctcaataaaaaaaaaaaaaaggtttgcttctatctctgaaaatttttacttcattccatacttcatttttttgaaaatgaacttaacatgggcaccagaatggggttgattcatcattcttggattctaagtcttaacaatttttttttctttttctttttttttttttttttttgagacggagtttcgctcttttgcccaggcaggtgatcttgtctcactgcaaccctctgcctttcagtttcaagcgattctcctgcctcagcctcccgagtagctgggattacaggtgcctgccaccacgcctggctaatttttgtatttttagtagcgacggggtttcaccgtgttggccagggtggtctcgaactcctgacctcgtgatccgcccaccccggcctcccaaagtgctggcattataggcgtgagccactgtgtctgccccaacaattcttagagtaacatttaaaaataacacaaggacacttgactgtttaatgcattcattttattaatgatcgaaaatatttccatagatgaattgatgttatatgatcaacttggattaagtcttaggtgattcactgcctccttggttaaggcaacaaatcctttatgagatttaattctaacaggtatagtcataaaatggtagtttctgagaccagagacctttagatcataatagtctcatcacatagttacagagacagacacttgagaaggtgtgatttcctacaagattatagagctaacgatagtataaaagttccacaaattacaatctaatttctaaaactcatatattctgacacataacacagagttactctgtcccttttttgttttactgattaaatctctaagctgggcaccgtggctcaggcctgtaatcctagcactttgggagactgaagagggcggatcccttgaggtcaggagttcgagaccagccatggtgaaaccctatcccagttacttggggaggctgaggccaaagaatcgcttgaaccgggaggcgaaggatgcaggtgagctgagattgagccactgcgcttcagtctgggttggcagagtgagactcggtctcaagggggaaaaaaaaaatctctagcttagatttggctttatctttcttagaaatgctccattttagggtctattaatatgctggttaactgataatatagaaataatgactgatatgtgtatcctaaagttagagattcagcatgttaatagtgtgtttgctaatgaacctcagtaaactattaggaaaatgaaacttcttagaacatttttttgcttcctgttattttgcgtgtattttaaggcttttcataacagttacctactctttcttcaatagagtagcttatttactctgtaaaatggaaatcgcttataaatgaatttagaattaaaagattaatttgttgagtgttacagaattttgccactgaaaccaaataaattattttgaaaaagtggttgaagtgacggtaggattgttttatacaatagttaactcttgaagatcgtatgggggttttgttgttcttctggaagcctttttttcctaagatatgggggtgggggaaaggaggaatagttactgttctaaatttgcattaatattatttctcaacagtttcatttcttatattattctttatagcttttgtgttatagtctattgttcccatcctatttttctaagattaaacttattctgagttcctttagcatttcctaaagcaacctctataataacttacattctttcctttcactttccttgtttctttggtctagagtgttccaaattactagttcatcttttattgtgggtagtacattgacctcttagttttcaaattctcaaaaaggaacacactaccatccacattttaccctcagtcaagtaacactgtcagcaccagagggaccttcagtcttagcccaccaaaactcccaagataataaaatttgctaacgagtttacaagggggagctcctgcttaattgataagaataacgtacagaagaaatcagtgggggaacatctaactatactcccgtctggtgactttttttttttttttttttttgagatggaattttgctcttgttgcccaggctggagtgcaatatctcagctcactggaacttctgcctcctgggttcaagcagttctcctgtgtcagcctcccaaatagctgggattacaggcatgtgtcaccatacccggctaattttgtatttttagtagaaatggggtttcaccgtggtggtcaggctggtcttgaactcctgacctcaagtgatccacccatctcggcctcccaaagtgctgggataacaggcatgagtcacggcacctggccctcgctcctgacttctgggaaagactttcagggagttatgtgtcagtttggggtttttggtctctgatccgtgttttttacaataattttaaaatattatacatttataggctatattctatctggcattaataatatttggtattgataatacagatacagacttgattatttgggaaagacatgaagcagactccattatgtcttttagttgagctaaagtatacatctttactactgatagtatatggaaagacggaactattctgtacctgttgtttccttcacagagagctagtggcatctgacaaagaaccatgatacctggctgaaactccaggatggaagtaatgcccaagtcactttgtaaaagcccaacactgtaaatcatacgtaatggttatatgcaaactagtagtcaaagttaataattttagaaagaagaggttagctcataagtggctgtgttgtaatgaatgcagtagctgtttggcagctttctgaatccttggaaggccctttgtccacagtccttgagaacacccacacatctagcatgagtgactcaggagagactagtgctagaatggaaatttctctcttccctactcctcaccctaagccattgttctagtcagacttttctcagcccctgctcttacaaatctaccacagttaacagagcactaggtcttaaaggtactgagtagctttttttgtgaccataaataatatcttcaccagagctggcatctttttggagatcctgtggaatttcattgtaactgactgactcacttggaggaacaagaaaagtgagaggcatcttactttacattagagttccttggtgtgggtacaggcagaggtggtatttctctcggtataaatactatgtttgccttctttgatactacttctcagaatccactcatttaaagataccaatgactgagtcagtttgagatctagaactttttttgtgactatctcactattgcctcctaccctcctccttccaccacaaccctaaattcagttcataaaaatagtttttaaattgaaagtcatccataatacatgaaaatggtaatagaggaaaaagttaaagtaatataattttttaagattcgagtgtctcagtttattaaaaaactattaaaattatattggtgatgttgagcacaataaattctgaaaaactgatttgtctgttgtttttacagttaagagtgtagtgatactggagcagcacttgtcacagttgcctttaatttgggtgtggccctaatgacctcttttgccacactcctggctcagcaactttccaacttgagccacaattttgatactcatgacttctataatgcataaacttctgagacttcgatacataattttatactaattttttgtgcgtgcgtgtgtgtgtgtgtgtgtgtgtgttttaacttcctctggcctcaggcccttaaaaaagtgtgtgtgtgtgtgtgtgtatatatatatatatatattttttttaatctatttaaaatattttttcaattaaaggatttttaatgtttttctggtttttttcttttagagacagacaggatctcttttgctctgtctcccaggctggaatgcagtggcacgatcatggctcactgcagcctccacccccggggtttaagccttccttctgcctcagccttccaagtagctgggattacaggtgtatgccaccacacctaatttttttaaaattctttgtagagacagggtcccattatgttgcccaggctggtctcaaactcctgggctctcaggcaatcctcttgcctctgcctctacttcccagagtgcttggatggtaggtgtgagctgttgtacgcagcctctgtttattttctttaaaaataacttatgggccaggcgcagtggctcacgcctgtaatcccagtactttgggaggccgaggtgggcagatcacttgaggtcaggagtttgagaccagcctggtcaacatggtgaaaccctgtctctactaaaaatacaaaagtaagctgggcgtggtggtgtgcgcctgtagtcccagctgctcgggaggctgaggcaggagaatcatttgagaatcaccactgcactctagcctgggcaacagagtgagactttgtctcaaaaaaaaaaaaaaaaaaaaagacatggatgcagtgattgcattttgttagaccacttttagtcagataaacaagaagaaagttcttggttagaattgtatatttttaaatttataaacagccttccttttctttagcagttatgtgaatttgactcaaccttacttgttaattctccagacttgccaacttggtatcatggatggtattttatataatattaactgagcgtatctgtggttatttttccaaaatgtaaaaaggatcttctctcttccctgctttaaaacgttcactagtttcacttttcctagagcagtgcttttcaaactgtgtacctaggctgatactagctaacatttactgagtacttaacatgtgacactattccaggctttgacatctgttactggttttattctcaaaacaaaccaatgaagtaggtattagtatcttaacatttttatgagaatttcattttgctttgtaatatttaatacaaaaaagctttttttgtttttgtttttgttttttgagatggagtccacactgtcacccgggctgcagtgcagtagcatgatctcggctcactgcaacctccacctcccaggttcaagcaattctcctgcctcagcctcctgagtagctgggattacaggtgcccaccatcacgcttggctaattttttgtatttttagtagagacggggtttcattatgttggccaggctggtctcgaactcctgaccttgttatctgcccgccttggcatcctaaagtgctgggattacagccgtgagccaccgcgcccggccctaaaaaggtttttaaatggatgacctagcatcaagaaaaatggaatctaagaagatttctatcatatttgtcttttgtgactttttatactccaaggcatagcataccatgtactagaagtgaaaatttctttgtatgaaattagggacaaaagacatactcaagaacttttttaaaaaaataattagatttcgtagacctaaaattattcttttaaattgctgtgcaagtttctaaacctcttactctcgattcctgtatttacctcattttagatggatacttgaatgcaaagggcactgagtagcactattctccctcgtacttgatgttttaaacattttgtttcccgtccctaaaatgagtgcacatccctgttttctgtttggtgcatttctacttttccttcttcatgcctcaaatactctttccctgggaagcctgtcttaactggaggccatctccagcagagctactccatctgtgtgcttccttagcaccgtattcacatctttcttagttcttggtatgtagttggtgtacttacagacggtgagcttcttgagggcaggggcctgattttaagtcttctctatatccgttatagcacctagcaggtatgagtaaatgttgaatgaatggatgagtgaacagataggctgtttcaaattacaatgtttggtgtaatctagaatctagccttaccattagaaactataggctacatcatttaaagcctcccagggcaactagtggcaacaacctaacccctgctctaagaacatgcttcaagtccaggctggtatggtatagtattactgtagtagtaaatgattgaaatgcccgctaggcagaagttttatcatttaatgataatgcacagtaggcagaagtttagtgcctaatgttctgtcttatttatttcaggaattgttggataaatatttaatagccaatgcaactaatccagagagtaaggtcttctatctgaaaatgaagggtgattacttccggtaccttgctgaagttgcgtgtggtgatgatcgaaaacgtaagtttatttgttatatgggcaaaagtagaatataaaaaaaagaaatggggataaatgggacactatgacagtatacgtagtcttcaggctctttgtgacttaataattgaatgtatgtcaagaaaattagtattaccttatgttctcaaaaatgaaaattggattataaatttacatcacatgctctttaaaaaaattaagctcatctgtgaactctgtaatctcatatggtattatttaaaacaggattaatcttttatgctttttagaattttggttcaccatatttttagctccagagttttttgtgtaaactttatgagtgattctgcatttcacatggcctttctattatgccttaaaacttcagatcactggaaattacatacagaacgtggaaacaggttgttgtgcttttgctgtttgtcatattcattatcgtctattttaaggggtcataacattgactgctaattacatataatcagatttctgaggagaggtgaaatgagtgtgttattgctggtgtataacttgctccaacttcacagtaagtttgaatgactcatggttaggttttacttgagaaggttgaatatacaggaactgttgattaatcaagtagtggtcataaaaatagattttagtattaaataccttttttttttaacctagactatcatagaaaacatggatatgagaaaaagtgaccgaattgcctaacttgataataaaaaagtgaagtgaatttatttgcagtgaatgtctcttgggatactggcagctgaatataagatagatctcattaaatttagtgtatgtgcttgctaccagatttatcaagttctaggtattagaagtgtcagtccttattttttccagtaagtttgttgttttgttcttaattttgccctgtctacaaagatatacccctacaaatagttactatgatctgaaaatgagagttttgccatcctaaatatcagtgtaactgaatatataaagagaacttgtacctgagaaactgttataccttgctataacaaaatctatatactaaacttacttattctgttactgatgtgtaatttctgttgccatgaaggtaagcagaattggacatgatacgggcacggaactgtacatttaagtatcagaaagccaaagagaagtatttgggagattgagacatagctgtagctttaacctgatttaacccttaggagctcattggcactttcaggtctcacacgtagtcctgtgtacattctgataggctgcgattcatagataggctgtctttatagcctaattgctgagacactggtgcttcctaatttgccaagctgcaagaacttcttattgcatgtgggctgtaccagtcagggattagatcaataaatgtgccatttcagaggaaagaaaatgaacataattcaggtcataaagggatagcttaattctcttacgtcagtatctctaaagctgtaataggccagtggcctcatacagaaaactacccttttcaaaacatgggtataatcagattagtgttggtaatactgaacattttttgaagggggagtaacattttaattaggctagtaatcaaactctggtcagagcagattttgtcctatttattgaaacttttatattgcctttcaaataataccacttgatactaagaatcagtatttctgcaaatcagaaaaatagagattttggtgttgatgatctttgtaaagtttacattatttagggaaagggtattccagtcaaattattattattattattaattttgaatggagttttgctcttgttgcccaggttgaagtgcaatggcgcgatcttggctcaccgtaagctccgcctcccgggttcaagtgaggcttgtgcctagcctcccaagtagctgggattacaggcatgcatcaccactcccatctaatttttgtattattagtagagacggggtttctccatgttggtaaggctggtcttgtacctccaacctcaggtgatctgcctgcctcagcctcccaaagtgttaggattacaggcgtgagccactgtaaattattccagtcaaattatttttaattgctgcatttccaagtaatagaattaaaagacataaaataagaaaatagttttagcctaggtatggaaaaaagtctgatttactataatatctcatgttttttttccattaagctgtttatatgtaagcaacattctaaactggttttttgttttgtttgtttgtttgagacaaactgtcactgaggttgggagtgcagcagcatgatcttggctcactgcagcttcaacctcctgggctcaaggggtcctcccacctcagcctcccaagtagctagagctacaggcacgcactaccatgcctagctattttttattattattattttttgtagagacagggataagatctccctgtgttgcccaggctggtcttgaactcttcaggttcaagtgatccccctgcctcaccttcccaaagtgttgggattagaggcatgagccactgcacctggccataaacaagttcttaaatacccagtacacaatattgtttttgtttgtttgtttttgacacagagtatcgttctgttgcccaagctggagtgcagtggtgtgatgtcggctcactgcaacctcagcctcccaggttcaagcgattctcatgcctcagcctcctgagtagctgggattacagatgcccgccatcacgcctggctaatttttgtatttttagtagagatggggtttcgccatgttggctagactggtcttgaactcctgatctcaagtgatccacccacctcggcctcccaaagtgctgggattataggcgtgagccaccgcgcctggccacgataatgttttttgttagctaccatgattttaaaagacccatacagagaaaaaatcttggttctaccaagagctagtagcatatgttcaagttgttaatgtactgtgtactggatggttatttttaatattgcacttcttatttttcgctcttcacagaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggtaagatgtgtgtccaggaaatacgtactttagctacagttatttgagataccaggtatgttaatttataggtattttacttggatacccagggatgatttctactatatttattttgaaatctcctctttttcttcccatcatgattacctactcctacccctgacaccttactctaccctatgattataagcagtgatgtgcctacagagcatactgagcagagtaatcaaagaaggataaatgatgttaagaaggaaacataaaagattagaaagtcatgcctgccaggtttggttactagaatagctgtgcatcagccacattcctcaaagtggctcaaaacgagagaataaagaggaccctgtagagataagtactacttaactggaaagaagtctgttaagcattgctgctgttccgttgtcctgtgaaagaaccaagacatgcttgtttactaagtgtatagttttataaaattccagtcatactcataagttcttaaactgggagtgtgagagaatggttctgttgagtttgttgatggtagaacataaggtgggtgttcacttattttgtaaaaatggtttgtaattgtagaataaccagttttcgtcaatgcacatattttaccatggatattaatatttatcaggcttttgatgaggccattgctgaacttgatacactgaatgaagactcatacaaagacagcaccctcatcatgcagttgcttagagacaacctaacagtgagttgtttactcttttaattttattttcttttcagaaacaaaagtatttatattttattttggacttcgtgtcttttagggaagatacatacgagctgaaagtatgagatacgtgttagtattttatgggacgaacattattttgtaggcaggttttcaagttgaataggcattttatcagaccttcctgagaaggttctaacatgataggaactcaatattaatattactatttcattgggatgaagatgttgataaattatgttaataaagagcttatcaagtttcaatattttggggcaaatcagctatagccagttagggactatctaaatatctacgctttcttaaaatcacaggaagtaccttgttctaataaaagtttactttgtgaattgtgcatgatgttctacaagcatttagggagtaaacctatacctaaacttactccttctctgcttctaggcaaaagcttctgttttgtttgtctttttctccctgcttcttagataggcaattgataaaggaagtaatcaagaaaaagtacagcttaagctttactttaacattcttttgtaggttcaagtaaatttgataggtaaaatcttagacttcacagaaggaaaaagaagggaacaaatcttttaatatagatctcgtcctcccagccccctagtttggtgctttatcatttactagataggattttttaaatattagcaccatgtctattcaattttgctgaatagggtaattatgaatccactgaaaggggaacgaagaccctgcatttctagccatgagaagtgcctgtggttgtgaggggacaatggaagatgatcagcaaatagttctacagaggaagagcaaattaggcagttatacctcttcccagatgtataccttggagctaactatcttttaatcggttttgttttgttatctctattatggagacaggtctttgggggattttgttttgtttgtttttatttagtatcttcataataatctaaggattatgtaagattctggcttttctgaaattaacactaatgtcttgctgttggtctaataaagtgcaattatagtcaataaatactgacttctcttcttcacttcatcttcctatcctaaaatcagagagatcctggaagatccacttagttttaacattctgtctaattcaagaaccctgtctatacatgcacacattgcttccctgtagcttccatcacccacttctatttaattcttggagaaacacaaagtaagtctgcttttcctatagtttagcccttcacacacttgaaaattgttaaccatgattgtggctttttcctccctgtgaaaatgttttgctttattagtctgtaataataatgcagtagtgctttcaagaagagcattgggctgctgggaatagagactatcactttgcttattctgaaagtagagtgcctttttaaaaaagtttctcttttttttttttttttttgagaaaggatctcaccctgttgcctaggctggagtgcagtgtcataatcatggatcactccagcctcaacctcctggattcaagcagtcctcctgcctcagcctcctgagtagttaggactgtaggcacacaccaccccgtacctggccaattttgtttttgaaattttttgtagacgtgggatcttgctatgttgtccaggctgttgaactcctggcctcatgcgatcttctcatcttggcctccctacgtgctgagattacaggcgtgagccactgtgcctggccaaatgctttttaaataaaaaggaagctataaaaccatgctccagtggtatatgtatgtatgtatgtatgtcattttgtaagtgcatagtgaaaggtctgcaaggatgtactttgggaaggtgatggtctttggggttttgagagagaacttcagtcttagtcaagatctccattgtttgaggaatttactactcttgtagttaattttgatataacaatactacttagtgtaattgcctaatctagaaatagtaacttaatatgattcttctttttctagctttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 35640 - DNA, 30290 bp, Homo sapiens
ccggaactgcagttgctgctgcagctgaggtacagcggcggtttctgaggttcttcactcgcgactgacggagctgcggtggcgtctccacacggtgagtaccaaaacgagcggggttggagccgactctggagaggggctgaggccaggaacccgggttcctatcgcgggtcgctctgggccggtgggttcccgggtccagagagggcggccgccggcccaagccgtccaaccgagctgcgtgccacggtccccgcgccttgggctccttgtccggtcatcagagcctgacggccttggcttctcggcttctcggtttctcggtttcgtgcgcgcgttcgtgcctgagacaaagcgagagggccgcgcgggaccggcgtcacgaggagacagaggcccttctactctgcctggcgctctccgtgtcctcgcccggttcgcgtggcacccctcgccctctccttgttgaaccccgcgtgtttctttgtgtttttttttgtttgttttttgtttttttgccgtggcgcagcgggtccggcgggcactgtgtgcgaacgtgctctcctcgccgggcgccatgctcagcggttttttttgacgtgcgtcactttttcgtagtggcgtataaggattctgtgggacagatgtcctcgtttttcccattgtgcagactgggaaataagagactcagagattaatacgtccaccgcagagccacagctgacaagtggtggatctggatttgaaccaaagtttaccttggtctttttcacggaatctgttatctttcttggcctttctgaaaaggaaaaacctggatcgagttccacccaaacgagttgggcctaaatggccattaagccacttaaaatatgatgaagaaactggatgggttttaagacgcttggcaaaggaaaggatggtggagcaggcatttgctctctcaggcaaggcttgagaaggaagcaagcgcagtacgcttttaataaagctcacccctcctgcccccacaagaaaaacccctgagattcttactctgccttcagaacgacttaggtgtggcaggtttcatcctccgtgctttacataattttctttatttacataaaatgtacaacttagatattgttaggtaccctcccccctttttatagatgagagcactgaagttcagagaggagtgggtggcactatccaaggtcacacaggcagtaagtgttggatttggaattcaaaccaggtctagctcatatgtctttgttccatcacatgtgtaccctgtgttccaggcaaagctgtctgttctgtggtattctttgttcttctctaggtgggagcaactgtgtgatagccatctttgtatcctcagttctttgtagggcctagttgcttagaaaatatttgttacatcagaaccctctgcttctcagacaccaacctaatagaacatgtatctccttttcagcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggtaagggcaactctggccaaagcaggattgcttctggattgagcccatagctgctaataggccagataattgggagagagaagaatgttgaagaacataaccacaaaagcaacgctgaataaaggtgtttagaagtcagcccctctggtttgaaatatgctcttcttgaatggtatcctagccagatcacttttatctctctcagctctgtagaccccattatcaaccaaatggagataacagtttctacctcttgcattgctgtgagggttaaatgccacagtaaactaaagcttacactgtacattggaagtggtctgcaaatcgtagtttctgctgttcttgagccttttctaaatagctcaaaggggtaaggcaaggctaagatcagccctttggagaggtagatcttcatgagtatagggaagaactgtctaattctcaggagttgtgcaaaggtgaaaagggttgctgctttgggagttgatgagtttcttgtcattggaaggatttgagtgtggtgggtagtcattgggtggattttgtaaacagattcagctatgaagtgttaggactatgctgtgtttgaggttcctgcgagacttttggaagcaatgacaggttgactttgctggatagactagactgctgacttgggggaggaactagtactgcctggaactattggtctgtttagaccagcagtgtccattagaaatacatatagtcatctcttgatatccatggaggattggttccaggacctcccttggataccaaaatccagggatgctcaagtctctgatataaaatggtgtagtgcttacatataacctatataggcacatcctcctgtatattttaaatcatctctcgattacttataatatctcatacaacataggtcttatgtaaattgttacaccgtattgtttagggaataatgacaagaaaagtctgtacagtgtttagtacagatacagtttttttttttttacccccccgaatattgtcgatccacagatgcagaacccacggttacagaagggtgactgtataatgtgaaacacataagtaatttaaaatttactaggagtcacattttttaaaagttaaaaactagtgagatattttatgttcttttttttttttttactaaattttcaaaatctggtgtgttttaaacttgcagcacatgtcattttagagtaactacattttaagtgttcagtagacacgtgctttgggtttctggaacagtggtcaggaaactcaggatgatgttctgtggcagtcatatagatggaagagtgaggaactacaggaaaggggaatggagataataacttagaacatttactgagcatttaagatgtgtcatgcactgtgttaagtgctttatgttgatgaaatcggttgtcacaaccaccctggggtaagtaccattattcccatgttacagatgagaaaactcagcctcacagagcatagacagcttccctaaaattacacaactgaaatggtagtgtatggattccaggctagttctgtgtgttgttaagcattctgctacactgctttggtatgtgcagcagagtcctggaagtaagtccgtggaaggcagaaacaaggtttatatgagccgttgtggccagagattgacatttggatgtataccacagttcctgtcaggttgtgaatctacaagtccagaattcaaaacgacttggataagtcatccatctggggctgtgaacagaccactgcccatgcaataataaatagacccttaatgtggggattaggggcattggtcccctgtgcagtcgaaaatccatgtataattttgaactccccccaaacttaaacgctaatagcctattattggctggatgccttacagataacataagcagtctattagcacatattttgtattatatactttattcttacagtaacataagctagagaaaaaatgttattaagaaaattgtaaggaacagaaaatatatttactattcattaaatggaagtggatcatcataaatgtgttcatcttcatcttgactttcagtaggctgagtagaaagaggaggggttggtcttgctgtctcagggtggctgaggtggaagaaattctgtgtataagtggacccctaccttcaaatttgtgttaaagggtcaactgtatatccattacccccaaaaagataccctgggttttttttgttgtccctccctccctccctcagttcttgttcctcctcaggcaaccactgataggctttctatcactatagattaatttgcattttcttgctttctttttttttttttttttgagacggagtctcgctctgtcacccaggctggagtgcagtggcccaatctcggctcactgcaacctccgcctcctgggttcaagtgattctcctgcctcagcttcccgaatagctgggattacaggcacttgccaccacatctggctaatttttgtatttttagcagagacggggtttcactatgttggtcaggctggtcgcaaactcctgccctcatgacctgcctgcttcggcctcccaaagtgctgggattacaggtgtgagccactgtccccggcctaatttgcgttttctagaattttatataatgaaatcatataatatgtactggagggggtggtatctgagtctttgactcagcataatttgagattacgccatgttattacaattactagcagttcattcctttttagtgatgaatagtattccaatgtgtgggtagagcagtttgttcatctattgatggacatttgtgctttttcttgtttttggctattacaaatatagttattgtaaatactattgtaccagtctttgtatggatatgtgctttaatttctattggataaatacctaggtgtggaatggctaggtcttgtggtaaatgtaacttttaaagagttttccaaagtgattataccattttacgttgtcactaggtggtatgagttcaagttggtccatattcttgtcaataactaggtatgctcagtctttaattttattttagacttttaaaattttactattatttccttgtcatttgaatttgcatttccctagtgactagcaatgtagagcattttagcatatgcttatttgtctgtttgattattttgcccatttttaaaatagggatgttctgttgtagagttttgggagttcattgtgtattctagatacatgtcctttatcagatgtgagatttgcaaatttttctcccagtttgtggcttatcttttcgttctcttaacagtgtttttcaaagagcagaaagtctttattttgatgaaatccaaattagccttgtcttttatgaatttatgcttttggtgccgttggtgttttatctaagaaccttttgcctaattcaagatcacaaagatttctcctgtgttttgttctagaagtgttaatagtcttaggttttatgttttggtctctgatccttattgagttaacttttatttagagtgagaagtatggatcaaagtttgtgggtttttctgcatatggctaattatttcagcaccatttgtagaaaaactattctttctccactgagttgactttgcatctttgttgaaagtctgtgaccatataggtgtgggtctttctctggagtctttttgttttccattgatctgtttgtctagtctttatgtcagtttcttattctcttggttataatagctttataataagtcttaaaatcaggtagtatgagtcctctaactttgttctttttaaaagttattttgactgttgtaggcctttgcccttccatatggattttagaatccgttatatcagtttctacaaaaaaagtaagctgatatctggattgggattctgttgattacagagcaaattgaggatagatgacgtcttaacaatatttaattttccagtctatgaatatggtatctctccatttctttagatctttaacttttcttagcaatgttttaaaattttcagtatatagatttttcacatcttatgttagatttatccttaagcattttatatttttgattctattgtaaatggtaatttaaaattttttatttccgattgtttgtcgccaataagtagaaatatgatggatttttgtatattgatcttgtgtcctgcaacttagttccaccaagtagttttctgaggattccatggtattttctgcaaagatgatcattatccagtcttggatgccttttgtttttcttgttgtattgcagtggctaacacctttagcagaattttgaattgtagtggtaaagtgggcattattgctttgtgtttgatcttctggggaaaacatttagtctttcaccattaagtctgatcttagctgtaggttttttgtaggtgctttttatcacgttgtggaagttctctttgatttctcatttgctgagaggttttatcagggttggatgttggatatttttcaaatgcttttttactgcatatattgaaataggtggtttttcatttttagtctgccaatgtggtgaatgacattgattttcaattatgaaattagacttacattcctgggataaactgaacttggtcacaatatactattctaattatattttgttggatttgatttgctaaaattttgttgagaatttttgaacttatgttcatgggatagttgtagttttcttgtaatgttttggtgttggaatcagtaatgtagcttcagaatgatttctgaagtattctgttcagttttctgaaagaatttatacaggattgacattttatacccaacttaaatttttggtagaattcatctgagcctgcacttgtctttgtaggaagatttttgactacaaatttactttgtttaatagattagagatatttgtgttacttatttttttctttttttttttttttgagatggagtctcggtctgttgcccaggctggagtgcagtggtgcgatctcagctcactgcaagctctgcctcctgggttcacaccattctcctgccccagcgtcccaggtagctgggactacaggtgcccaccaccatgcccggctaattttttgtatttttagtagagacagggtttcaccgtgttaaccaggatggtctcaatttcctgacctcgtgatctgctcgcctcggcctcccaaagttctgggattacaagcatgagccgccacacccggccacttatttttttcttgagtgactgttttctacttgcagttctattagtttttgtttcatgtattctgacaatcagtttatgtgaatacatgttttatggattaaaatattagattattattatatcctctaaatgaattggcttgttatcgttatgaaatggccccctttatccttagtaatttttttttgttctaaaatgtcctttggtattgatgcagccagtccagctttattgattaaggggttagcatggtatgtgtttttcaatactattactttcccttatttatatttaatgtgaatttcttataggcagcatataaatgggtcttgctgtttaatcagacagttcgtgtctttgagttgaattattgaagccaggcatggtggctcacatctgtaatcccagcactttgggaggccaaggcatgtggatcacttgaggccaggagttcaaaaccagcctggccaacatggcgaaactgtctctactaaaaatacaaaaaaatagccaggcgtggtggcatgtgcctgtagtcccagctgcttggggggctgagccacaagaattgcttgaacccagggggcggaggttgcagtgagctgagattgtgccactgcactccatcctgggtgacagagtgagactctatctcaaaaaaaaaaaaaaaaagaaaagaaaattaattgagttactgagattatttacgtttaatgattattgataatggtgggtttacttatttattttttgactgatagcatacctgatttatttatttttttcacatttctgttttttattttaaatttttttttccttttctatgtttagatgtttatttttaatttttttaaatttttccataagttattggtgtacaagtggtatttggttacatgagcaagtttttttgtttgtttgttttttgagacggagtcttgctttgtcaccctggctggagtgcagtagtgctatctcagctcactgcaatctccaccttctgggatcaagccatcctccttcctcagcctcccaagtagctgaactacaggcatgtgccaccatgcccggctactttttgcatttttagtagagacagggtttcaccacgttggccaggttggtcttgaactcctgaactcaagtaatctgcccacctcggcctcccaaagtgttgggattacaggcgtgagccactgtgccagtttagtggtgatttgtgagattttggtgcacctatcacccgagcaatatacgctacaccatatttgtagtatttcatcccttgcccctctttcattcttccccccaagtacccggagtccattgtatcattcttatgcttttgcatcctcataacttagtcctgcatatcagtgataacatacgatgtttggttttccattcctgagttacctcacttagaataatagtctccagtctcatccaggtcactgcaaatgctgttaatccattcctttttatggctgcatagtattccatcctgtatataccacagtttctttatctactcgttgattgatgggcatttgggttggttccatgattttgcagttgtgaattgtgctgctataaaattatgtgtgaaagtatcttttttgtataatgacttcttttcctctgggtagatacccagtagtgggattgcttgatcaaatggtagttctacttttagttctttaaggaatctccacgctgttttccatagtggctatactagtttgctttcccaccaggacatagaagtgttccttgttcaccacatccatgccaacattgttttttttttgagatggagtttcgctcttgttgcccaggctggagtgcaatggcgcaatctcggctcactgcaacctctgcctcccgggttcaagtgattctcctgcctcagcctcccgagtagctgggattacaggcatgcgccaccatacccagctaattttgtatttttagtagagacgtggtttctccatgttagtcaggctggtctcaaactcccgacctcgggtgatccgcccatctcggcctcccaaagtgctgggattacaggtgtgagccactgtgcccggctttttttctttttttaagtcaaaggctcactctgttgcccaggctggggtgcagtggcacaatcttggctcactgcaacctccgcttcccaggttcaagtgattctcctgcttcagcctccttaagtagctgggattacaggtgcctgccaccatgcccgactaatttttgtatttttagtagacatggggtttcaccatgttggccaggctggtcttgaactcctgacctcaggtgatctgcccacctcaacctccggaagtgctgggattacaggcatgagcaaccgtgcctggctgccaacatctactgttttttgattttttgattatggccattcttgcaggagtaaggtggtatcacattgtggttttgctttgcatttccctgatcattagtgatgttgagcattttttcatgtttgttggccatttgtgtatcttcttttgataattgtctatttatgttgttaacccactttttgatgggatttttttttcttactgatttgtttgagtttgctgtagattctggatattagtcctttgtcagatgtatagattgtgaagattttctgccactgtatgggttgtctatttagtttgctgactgttccttttgctgtacagaagctctttagtttaattaggtcccagatatttatctttgtttttattgcatttgcttttgggttcttggtcatgaaatccttgcctaagccaatgtccagaagggtttgtccaatgttaattttctggaatttttatagtttcaggtcttaggtttaagtccttaatccatcttgagtggatttttgtataaggtgagagatgaggatccagtttcattctcctacaggtggctagccagttatcccggcaccatttgttgaaaacaatgtcctttccccactttaggtttttgtttgctttgttgaagatcagttggctgtaagtatttgggtttatttctgggttctctattctgttccattggtctttgtgccgatttttataccagtatcactctgttttggtgactatgggcttatagtatagtttgaaatcaggtagtgtgatgcctccagatttgttctttttgcttagtcttgttttggctatgcaggctcttttttggttccatatgaattttagaattgttttttctaattctgtgaagaatgatggtggtattttgatgagattgcattgaatttgtagattgcttttggcaacagtcattttcacaatattgattttacccatccatgagcgtgggatgtgtttccatttgtttctgttgtctgtgatttctttcagcagtgttttgtagttttccttgtggacgtcttttgactcctttgttaggcatattcctaagtattttttttttttgcaaccattttaaaagggattgagttcttgatttgattctccacttggtcgctgttggtgtataaaagagctactgatttgtgtacgttaatcttgtatccggaaactttgctgaattgtttatcagttttaggagctttctggaggagtccttaggattttcaaggtaaatgatcatatcatcagcaaacagtgccagtttgacttcctctttactgatttggatgccctttattttttttctcttgtcttattgctctggctaggacttccaggacgatgttgaagaggagtggtaagagtaggtgggcatccttgtcttgttccagttctcagagggaatgctttcaccttttccccattcagtattatgttgactgtgggtttgtcatagaaggcttttattacattaaggtgtgtcccttgtatgccaattttgctgagaattttaattgtaaagggatgctggattttgtctaatgctttttctccatctattgagatcatgtgattttggtttttaactctgcttatgtggtataccacatttattgacttgcatatgttaaaccatccctgcatccctggcatgaaacccacttgatcatggtgggttatctttttgatatgttgttggatttggttagctagtattttgttaaggattttaggatctatgttcatcagggatattggtctgtagttttcttttttggttgtgtcctttcctggttttggtattagggtgatgctggcttcatagaatgaattagggagggttccttctttctccatctcgtagaatagtgtcaaaaggattgggaccagttctttgaatgtctggtagaattctgttgcaaatccgtctggttctggacttttttttgttggtaattttctaattaccatttcaatcttgctgcttgttattggtctgttcagggtatctcattcttcctgacttaagctaggagggttttttttccaggaatttatccatcttttctaggtttcctagtttatctgtgtaaaggtgttcatagtagccttgaatgatctttcttatttcagtggtttcagttgtaatatctcctgttttgttttatagtgaggttattttgattttctctcttcttttcttggttaatcttgctaatggtctgtcaattttatttatcttttcaaagaactagctttttgttttgtttatcttttgtttttttgtttgtttgtttcaatttcatttagttctgctctgatcttggctatttcctttcttctgctgggtttgggtttggtttgttcttgtttctctagctccttgagatgtgaccttagattgtctgtttgtgctctttcagacttttcgatgtagccatttagggctatgaactttcctcttagtgctgcctttgctgtatcctagaggttttgatacgttgtgtcattattgtcattcagtttgaagaatttttaaatttacaaactgattttgtttttgacccaatgctcattcaggagcaggttatttaattttcatgtatttgcatggttttgaaggttccttttggagttgatttccagttttattccactgtggtctgagagagtgcttgatataatttcaattttcttaaatttattgaggctcattttatggcctatcatatggtctatcttggagaaagttccatgtgctgttgaatagaagtatattctgcagttgttggatgaaatgttctgtatatatctgttaagtccatttgttccaaggtatagtttaaatcgattgtttccttgttgactttctgtcttgatgatctgtctagtgctgtcagtggagtattgaagtcccccactattattgtgttgctgtctgtctcatttcttaggtctgttagtaattgtttcgtaaattggtgagctccagtgttaggtgcatatatgtttaggattttgatattttcctgttggacaaggccttttaccattatataatgttcctctttgtctgttttaaccattgttgctttaaagtttgttttgtctgatataagaatagctacccctacttgcttttggtgtccatttgcattaaatgcctttttccacccctttactttaagtttatgtgagtccttatgtgttagatgagtctcctgaaggcagcagatagttggttgatgagttctgcatccattctgcagttctttatcttttaagtggagcatttagaccatttccattcaatgttagtattgaaatgtgaggtacccttgcgttcctcatgctctttgttgcctgtgtactttagttttgtttttttgtttttgctttttaacttgtatgtctgcatcctgtgtgatttttactttatactttaaagaggttgttctgttttaatacgtctccagggtttgtttcaagatttagagctccttttagcagttcttgtagtggtggcttggtaatggcaaattgtctctacatttgtttatctgaaaacaattgtatctttccttcatatatgatgcttagttttgctggatacaaaattcttggctgaagattgttttgtttgaggaggttgaagatagggccccagtcccttctagcttgtagggtttctcctgagatgtctactgttaatctgataggttttcctttataggttatctggtgcttctgtctcacagctcttaaaattctttcctttgtcttaactttgtataacctaatgacagtgtgcctaggtgaagatctttttgcagtgaatttcccaggtgttctttgtgcttcttgtatttggatatctaggtctctagcaaggctggagaagttttcctcaattattcctccaaatatgttttccaagcttttagcattctctccttcctcaggtacaccgattattaggtttggtcatttaacataatcccagacttcttagagcctttgttcattttttcttattcttttttctttgtctttcttggattgggttaatttgaagatcttgtctttgagctctgaatttctttcttctacttgttcagttctattgctgagactttccccagcatttcacatttctaaaagtatgtctagagtttcctgaattttttattgttttctctttatgtatttcctttaatatttctccctccacttcttgtatcattttttggatttccttgcattgagactttatctttctctggtccctccctgattagcttaataactaacctcctgaattctctttcaggtaaatcagggatttcttcttggtttggatccattgctggtgaactagtatgattttttgttgggggctgttgaagagccttgttttgtcatattaccagggttggttttctggttccttctcatttgggtaggctgtttcagagggaaggtctagggctgaaggctgttgttcagattcttttgtctcatggagtgttcccttgatgtagtactcccccttttcctatggatgtggcttcctgtgagccaaactgcagtgattgttgtctgtcttctgggtctagccacccagcaaatctacccggctctgggctggtactgggagttgtctgcacagagtcctgtgatgttaaccgtctatggggctctcagccacggataccagcgcctgttccggtggagatggctgagggtgtgttggactctgtgagggtgcttagctttggtagtttaatgctctgtttttgtgttagttggcctcctgccaggaggtggcactttccagaaagcatcagctatagtatggagagggaccagcagtgggtagggccctagaactcccaagattatatgccctttgtcttctgctaccagggtggatagggaaggaccatcatgtgggggcaggtctacgcctgctctgactctccttgggtgggtcttgttgtgggtgttgtgggggatgggggttagattcccaggtcactggagttgtgtacctaggaggattatggctgcctctggtgagtcatgcaggttgtcagggaaatgggggaaagccagcagtcatgggcctcacccagctccctcacaaaccgaagggcagtcttactcccaccgtgtcctccccaacagccccagtctgtttccgggaggagggcttgaaaacttgcccaaggttatctgcttcccagctctgaaagaaaaggggctttagttcttcccctacctgtgaagtctggattcgtgccctcccccgagttctggccaggaggcttctggtcctgttcagattgttaaatcaaattgttacagaatttggctagagaatgccttctttctgtggagttttgcccccagctcctgtggccaccctcccagtggatccctgtggtgccaggcaggaatgggctgcttggggacccagcgagctcccagggcctttctgctgcttcttctacccctgtatttcgctcagctctctaacttgactcagctccaggtaaagtcagaaacttctcctgcaaacagaccttcaccttctctagtgggggtgtgtgtttgggagaggagagcctccctcctctccacagttggggcactcacggtatttgggggtctcctgggtcctgctggagcagtccagttccttcagagggtctgtggttcctctcaggattactggtttgttcttgcagtcaatctggagctaaaactcacaatgcaagcctccccttgctgctctttcaggagttgcaatctagtcctccctcctgtctgcagtgatcccgggagcagcatcagtggttaggtttaaatctgttacttttctattagtcccagctcttctttgtttccttctttggcactgaatttgtgtgtgtgtgtgtgtgtgtcagagagagagatactattaagatctacccatacgccgggtgcagtggctcacacctgtaatcccagcactttgggaggccagggcaggtggatcacgaggtgaagagatagagaccatcctggccaacatggtgaaactgcatctctactaaaaaaaaaaatcaaaagttacttgggtgtggtggcagatgcctgtagtcccagctacttgggaggctgaggcaggagaatcgcttgaacctggaggtggaggttgcagtgagctgagattgtaccactgtactccagcctggcgacagagcaagactgtgtctcaaaaaaaaaaaaaagattttctacccacagaacactcttggcatcaaatgtgtgggtttttcccacactcacaaccagctctgcaactctgtggacaccaactggttatcctacaattctgttcaattcagacactatctacctggagctagtgtcattccttacaggttaagggctcagtcccacaaggttgcccccattaatgatgctaatcacaaataatggtacttctggtcagcttggctacaaattgggtattcccacaacaccttcctcaggttcagcactttgctatgcctgacagaattcagggaaacactttacttgtatttaacaatttattataaaagatgtaactgagaaacagccagatggatgagatgactagggcaaggtatggggcggggttggaagtcaggagaggtagggcatggagttttcatggtccctgggtacaccaccctggaatctatccgaactccatcgtttagagattttgtggaggttccattgcataggcatgattgataattgattaaatcattggttgttagtgactgagctcagtctccagtccctcttccctccctggaggttggtggggagaggcagctgaaagttccatcccccatcctgaagctgtctagggactccagccactagtcatcttattaacatgcaaaaagatgctcttactactacagatatttttaaggtatcacaaggttttatatcagcaacagaggactaagaccaaatatttcaacaaaagatgcccctgtcactgagaaagttacaaggctcttagaagctctgtgtcaagaattagggacagggactataatacatatatatgcatagataccattttatcttttttgttgtcttattagctataattcttaacgtctttttagtgattgctttggggtttatagtatatatcttttattatagtttaccctcaagtaatttactacttcgcatacaatgtaagaaccttacaagagtattttccatttctcccctcctttgtgctttttgttgtatacttcatatgtgttagagattctagaatacatttttattatatttgctttaaacaattatttttaaagatgtttaaataagaaaaataaggggttttgtttttttgtttgtttttagagacagtatctccctctgtcacccatgctggagtgcagtggcacgatcatggctcactgcagcctcaaactcccatgctcaagcaatcctcctgcctcagcctcccaagtttcgaagactacaggagtgtgccaccatgcctggcaaatttttttaaagatgggagtctcactatgttgcccaggctggtcttgatcctcccgcctagacctccccaagtgttgggattacaggcatgagccaccatgcctggccataaaaagaagtttttaaatatttacctacgtagttactgtttcggttgctctttatttctttgggtacatccagattttcattttatgttatctttgctattgcatgaaagactaatatttctgatagcttacatttgctgctggtgaattatttcagcttttatatgcctaaagtctttatttcacattttgttttgagtgggtgtagggttatagattgtcagggttttatttttaggcattcaaataaaaaatattgctacactgtcttctggcttttcattgtttctgataagtctgctgttcttcttatcaaaagtttcatgtgtctgtttttgctctcttttttccttatagtatcttatttttgtgtgtgtggttattttttactgagagctgcttatttcctttgaaaattgtgaaaatttttggagatgtatggtaatggtttctcccttgagaaagcatttattggcttctgcctagggcattatcactttggaacttctttaaattctcagcctgagatgttttgttttgaccacccagatgatttggactctgtgtacattcaaaggccagtttgaaaatgttcaggcatagacaaaagttttatatttacattttctgaaaacttaagaaaattttcttttactcctttctcaccaaagaaaagtcttgggaaagtattgtatggattactgtttcctgctcctcacagaaacaacacatacacccaaaacttgccctttctctctttattgtttcatttcttggacatttgtaattcgttactggtgacctaagacctcagtgctagcctgccatacttttcctcgggttctaatttacatgtgccttctggttccttctggggaaatctgtgtagagtggaggagctttgggtcggtcagggtggcacttggctaccttattctatgcaaaagaatgaattccagactaaagtatgttcatctgttgattcacactgtttttactttgttttgtttttttacttttaaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggtgaggtttagttccatttaataaatattttctaggtaaatcccaaatgctcgttggtaaagatgaatgagctgtggctcctgccctctagggtaagccactctcatctataagccagacaattaagccctacagaaaattgatatagtgacattttttcagttccctcaaggataatacatggttggtgccattgtggatgcataggaaatttattggatacagtagatgctcagggcagggattagcaaactgtctggttttataaataaagttttgccggaacacacccacacccatttggttttatattgtctgtggttggttttgtactacaaaggtgaagttgagtagagttaatagttgtgacagagaccatctggcctatgaggtcagtaatgttcactagtgaccctttcagaaaaagttggctgatccctgctctaagctattaggatttaattctctcagggaattcactctgggaagggcttcactctgggaatcttaattttataatgaaagcagcaattaattaccaagttgttactattgctaagccctttacccacatgatactatgagaatttctgcaccagagacgaaaacaacagggcattagtggacctttcagaataattctaactgagggaatggaagggcttcctaggagaggtgtagcacagctgcaggtcatattcctcccagcattatggtgccccagtgctccgttttcccagagctttggaggtaagcatacctgggttcaaattcagcccctttggtgtggttggaggggagggagtagaaaagaaatgaggctgaagaagtagagctcagatcacagaagacttggtaagccctctaggagtggcgtcaacagtctggccaggcctgctcttttagcaatgctctagggcattacactgtgctgatgtctgtctctgctaatctggggtgcctgtgtcagccatgtaagaaaatgatcacccagattgaataagtgtcccttatgttttctgtcccataggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtaatagatggcacttctcttttccccctcactgccttttctgaaatgagccttaggtgacatggtgtgggcaatgccttcttctcatcgcagaatgctatggtgtggtatcatccagaccctggcctttagaaagccaagagtgcatgagggagattagttgagggcctgatggtggtggtggtagtggggtgtgtacgtgtgtgtgtgtgtgtgtttaggatgagtgtagggtgtgctatagatgattcctcttaacccgctgctgaccaatgatatgggtctctctggatctgcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagagtaagttaggactgtccccagaggcttaacctctagttagttactggggtaaaaggggtcaggatggtggggaaatggtagaaaagccaccttctgtcataggggccttgtctcagtagtaggtagcctttttttttttttgcacagcatttggcaaggttactgtcatttagtgaatttggttgcagttaaatgccatacagaaacttcaatactaatgaatataggtgacaatacataatattgaatgtatagacaatagattaggtcctgtgctggcactttagattcagaatcacattcagttactctcctaacatccttaagaggaagcagaatagattcatggttaagagcacagatcctggaaccagaatgcctgaaatcaaatcctagttctgtcactccttaggtggtcaagttatttaatttctctgtactttaattttctcattatttggataataatagaacccattctagggttgttatgaagattgattgtaaattcatgcgtgtaaagtgtttagaacagtctctagcacatagtatgtatatattgctaaatgttagctttaataatttctagtccctttactacttattaccattatcactattctcatttatagatggaaaaatgaggtctagaaaagctgatcagtgtgcccaaggtttctctgcctggaagtggtagagctgggcctcagacaagcctgtcggacctcagagcccatgctatttcttattcctgatgtctttgtccatctgcctttggaccagactgatgctcagggaatggggtgcagattgtcaagatgagggcctggaaagttgaggcagactacaaagtgtcttttgccagtgttttgtcaggtcatggggtaattagtttctagaacaagtgtttgatttactggtttttaaaaattggtaagtagtatcagtggtttactgagattagcttagaacaaggcttggcaaactataggcctcgtgccaaatcttgcttgctgccctttttttttctaagatggggtcttgctatgttgcccaggttagacttgaactcacgggctcaagcaatcccaccttagcctcctaagtagctaggactaccagtgcatgccatcacacctggctgctgcctgtttttttagtagacgttttactggaacacagcaagacccatttatgtattgtcaatatcctcttttgcggcagagttgaatagttgccatagagactgtgtggttcacaaagctggaaatgctctctggctctttacagaaaaagtttgctgaccttgatccagagcagtagtttaatgttttacaaactaggatttgcattgcatttcccggcctcagctcagacatgcagggagtgaggaccctgaagggccagagtcttatgttttgaagcacctcaagtacttttgactttccatgaaccacacattgagaaacatcatccaacacatttatcaagtgcttaccatgaaccagatgttgttctctgtggtggtaataacagcagtgagtaatgcaaagtccttgctctcatgaagcttacattctagtagagggagataataaattgcaaagtaagcccacagtctgccaagtgatcctaagaagtaagtcgagcaggggttggagaaaagagattgggtatgtgtggtcagtctctgatgaagtgagaattgagcagagagctgaagaaagtaatgaagtgagtcatatggacatctgaggcaagaccctttaaggccttaaggagtagcaagtgcaaaggcttggaggtgagagcatgcttggtttgtttggggaagagcaaggaagtctgtgtgccactgggaggaagtaaatgagagggtgctaggagaggagtcactgacccagaatatgtatggcctcatttaactcactgaagggagtctttatcattgcagagtatggcatgttggttggggtcaatgagtcccaaatttggatccagactccacagctgaatagccatgtagatagcttgggaagttaatctctccgagcctcagtttttctgtaaaagggtatacaagtgatatcttacagagtattggtaaggactgtaatgtttaggatgctcagcagttggtaagaatttgattaaagatagctgttagttattattaataagctttctctctctaccccagctgtgttctcttggcaacagatgtggcagctcggggtctggatattcctaaagtccagcatgtcatccattaccaggtaggggcatctgaaaatttataggcatctgcctgcactgaatggggaatttttaaggcaaaggttgggggagggaggaggaattgttggttccaaggctcttgcatcagagaataccactggcatcgagtgcccactactcccacttttgcaacactgctgagatttggtctccagaaaaccttgctttgtctcatgtcaagtagcccttctctccaagctacttgatattgtcaggttagagtcttagttttttctgtgaaatgggcataagttaagcatgtaattggttaccctgatgtagagaagtattaatagaagagtgtggtagtttagatctctctgggctcaaatcccagctgtgtaaccttgaacaagtcatgtaatctctctgtatctcagttttctcatgtattaaatggcagtgagtacctgcttcttagggttcttactgaggtaaaataagttactaagtataaagagcttaagaagccacctggcacattgcaagcacttactcatgttaactgccattgatagtagcagtaatattagtgtgtgcatctagtgaatatcagcataaaattttggttaggagtatgggcaccggagccagactgccaggctttgaatccccagtctgctgcttcatagttggttagctttaggcaagttatttagtacctctggtttcagtgtcattgtttgtaaactggaagtaacaactagctaccccatagggttatcctgagaattaaattgagctgatgctgatgaagccggtagcacagtgtaagtactcaataaatggtagctggtatggcattatcatttttcctctttaattcctctttgtgcttttaaaaatcttttaggctgctgtttcagagaaacaacaaactcacagtgctttttcccattctctcacttcacaacaacaatcaacatagaagacttctgtaaccaaatgtgtgggcgtttttcaccacatatcaagcagcagccaccagctgggtgtcctctaatttagtttcattttctgatgctgtcttcctggagatagcctcagatcccacaagatgtccctcctccccgcaaccagtcgataagtcagggcctctggaacttctgaccaaccagcttcaagttggggttctcatgaccccccgctttgggttcaattaatttgctacagcagctctcagaactaaaagaaacacatttaccagtttattatagaggatattacaaagaatatagatggggagatgtataggctgaggtacaggggaaggagcatggagttgccatgcccctcctgggtacaccaccctccaggaatgtccacatattcagcttattcaaaagttctccaaactctgtcctttaggaatatttatggagacttcattgggtaagatgattaattaagccattggcctttaggaagtagtgctgcaagtcccaaccttctaatcctgccttggcctttctggtgaccagcccccatcctgaaactacctggggggctatcagccatcagtcaatagtttgtcattagtatacaaaaagacattacttttgagattcctttgccaggaaacaggatgaagagcaaatacatatttcactgtatcacaggtgctaattttggtttagcaaatctctatagtcttcccttttttggggaaggagctgggtcaacctttgtggagtcaagatgaatcaaatacagtcccagcccctaagaagtattggatccagcagaggaggtgagatgaccacagccataatttaaggcagaaggtattagaaaattacaaaatacaatggaagagagaggtaacttctagtttgggaggttggaaagtactttctaaaaacatgcctggcatttaagggtgaagaggatttggacatatagaggcattaaaggaaggagcaaagaaatgggcagtgttcaggggcacttggctcacagtgagaagagggtatgtgttgggaaaggaatagttgctgaggctggaggggtaagttgagggcaagtcactaaaggcgctgagtgtcaggttgaagagttgggcctttatcctgtaagtaaagaaaggcaaatctcatttctagaactcttatgaacagttcatagtggctacttaaagtactgtattgaaaaggatacctagatgttatctgggcccagtggagaagactgttgtgcttgattaatggtgtgtgccaggggctcagtgggtgtgttagcaaccatgccacattatctatggataaaatatatataggagtagagaccgtataacccagggattaacatggtctgtggagctgggctgcttaaatcctggataagaagtgactgctgtggtctggctgcatggtcctgaggacctgaaccagggtcaggggcatgggagggaagagcctacacagtgaatgggctaaacctgggaacattttgaatgtgggactaagagaggagggctagattgctctacaatgctgcagaagtttctacctgcctggctgggaggtaggagggtctggtttggggatgtggccctgaggagaggaccagtgtttggcagtggccatgtattgatctcccagttcttcctgtggcaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggtagaaagcagttaaaaccccagtgctaatgaagggattgtgctgctcccttgcagagcaccttgctgtgggactctggcagcataacccttgaaaactaaggaatggttctgccaacagctgaacaaggagacttgtagaaaggattgagagcaacatacctgggaaaagggagaaaaggggagtgactgaaggtgggaggcattttctccctgaaccatttcttccttctctggccctgaagtcccccctcctcaccagacagtgcagtggtcatggctgtctggatatcctgtcagagggttgtagacagtgtggttagtgtttcctgctgaggcagatgctacaggtttggcacatccctggagcaggtgccagtaaattctgtcttttgggttttaactcagcaggcattccccaggtaggtgccgcttaccatgggacactgtattagtgaccaaagtggggtgggttctccttcccagaggtttgccagctgtgaataaagttcaggtacagtggagcagtatggaattactgggcatatggttacattgggaggagaagaggttctatcccagcttcctgctggcaaagatgtggaagggtacagaggaggtggaattccaggaattgagggagcaaaaccatggcacagttcaaggaatgttggcttctctggctcaaaaggaatattagctgtgtggggaaatagggtggagataaggatggaaaagtggaaatcatagagaattcccattagtaaggaggattaggagccacccaggcttcccttggtttctttccccacatcacaagatccttctcattttgccactgcactgtaaccccaaaaccctctagagggagagttgaaatgttttatcttagctcagctgtggaagcaagctgtggcatctgcgtaaagacttcactttggttacctataggttggcagtcaaaccagtaagggttttcaaaggatgtggctgttcaggttgattgttgggaaagctggcagttgtgtttagatgtgtacacacagacgggtaatggttgcccactggacttttatcaggaagcaataaatgcatttcaacaggaactgaactgcatctcaccactgatctcaagagctttttatttatttatttttaatttttaatttttaatttttttttgagacggagctttgctcatgttgcccagactggagtgcagtggcacaatcttggctcaccacaaccttcgcctcccgggttcaagtgattctcctgcctcagcctcccaagtagctgggattacaggcatgcgccaccatgcccagctaattttgtatttttagtagagacggggtttctccatgttggtcaggctggtcttgaactcctgacctcaggtgatccgcccgccttggcctcccagagtgctaggattacaggtgtgagccaccatgcccggctcaagagctttttaaaaacactacttgctgggcacggtggctcacgcctgtaatcccaacactttaggaggctgaagtggaaagattgcttgagcacaggagttcaagaccagcctagacaacacagttgagaccctgtctttacgaaaaaaaaaaaaaaaaaaaaaaaaaaaaagaaattacctaggcatggtggtgcctcccagctgcttgggaggctgaggtgggaggattgcttgatccaaggaggttgaggctgcagtgagccatgatcatgccactgctctccagcctgggcagcagagtgatacctgccttaaacacacaaacacaactcaagtgagactttgcttcccagaggcctgaactctatttcagatgaatattttctgttacttccccccaggagcgaatccgtttagctcgacagattgagaaatctgagtatcggaacttccaggcttgcctgcacaactcttggattgagcaggcagcagctgccctggagattgagctggaagaagacatgtataagggtaagcccttgggcgggatgggaattgaggaagttgaaatctctctttaacttttgctttgttggaaccatctctactactgtgggtcttgtcaaaatcagcaaggcgtccttccccctctttgctaacaggccctggtcccaggtgagcctactgccctcggtcagtctttgtttcctctgtctctgtcttgtgccctcagctgcctcctcttacatggacaggcagtggagtacagtgaggaagggagcaggctctctggccaggctgcctgtgttagaatgccggctcattgccttaactatgtgactgagtcaagttatttaacctctgttgtgttctcagctttctcctccataaaatggaagtagtcaactacctacttcatgggattgttgtgaagactgattgagttaaaaaatgttaagtgcttatagcattgcctggcaaatagaaagtattacattttaagttatttgtcattatggttcctactacacctgccttccaagctgacaaagcacttccatgccattatctcatttgatcttctccactttcatgacatgaacacagcaggaagtactcttcttttacatatggaaactagataccacagcagaggcagtttgtgcagggaaacagctctgtcacaaggcatttccagagctgctactctatatgtgaccacaggctgaggcttcagggatgaatctgcccggtccctgcttgagaaaactcctggtctaaaaagtggtagaaccaaatctagaactccatgctccttccacaccaccaagtatgcagctcagcagagatgttgacacctcggtgcccaagtcagcaaattcagaggcagacttaactgctgtctgctcagcatggaagccaggagccaaaccagtgggcttgatgacagtgagctatttctggtggctcagggttggggcttgggccgaagatgtggaggccctggcttcccttcctgaggacagactgaggtggaaccttttggctctgccagcttctccatgtgcagtcacagcactggtggcaaggcataggagagctgggctacaaagaagcattcagtgtctcctggggcggcagggaggtgggggttgtaattgtgaactcaccaaaccccaggtgggcagtaagtgggtgggtcataggaagaaaagtgatcttcagtcaggagacttgggttctgggctctgtctgatgactggctctgtgatgtgagccaggtgacttctctaaccctgagttgcctcatctgtaaagataattccagtcttggaggatttttatggagtaaaaaaggacagagcggtcctgtgtatcccctgcaaatggttagacgttatccatttacagcccctgccaagccaccactagcttcttcagagaacttttgaaccctgcctccctaaagtagttctaaaacatttttcactgtgttacccatcaagggaaacaaaatgtttctacaaaccatagtaaataggatcgtttttgtattgtgtttcaaggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcag

SEQ ID NO: 35641 - DNA, 36437 bp, Homo sapiens
cctgtaaactggctcgggcgcccccacgcccgcccttccttcttctcccagcattgccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagcgtgcgtctcttatctccccggttgcccggactccttgagacggcgctcccgattgggtgtcggcccagtggagggcgggggccagcgctagcctcgagggtcccgggcctgccctgtgcgcgcggcggtccgcggtcctgggaggttgtggccagggctggggtctgcggactgggtctgggagagaggaggactccgtgattggcggcggcctctgaatggcctcttggggatgtggggcgcgcatgacttgctccaagtaggggagggccgccgggtgggtcgggacctgggaaggtttttttgttttctgggtttcgactgctgggccaagtggggaccgagaggcgaaggcctgccatcctaattcctgctcttcctccgcctctcattttggtttaggtgtcctaagaggacggggacgcaaaaacacccccccaccaaaggtggggactagccaagtttaggagcgaattaggttgtagaaacccgcctccccatctccccggatcctcccattgaccaggataggggttgagggatttgctaagcagatgaacatttatttatttcttttttttgagacagtctctgtgtcgcccaggctggggctggggagcagtggcgcgatctcggctcagtgcaacctctgcataccgggttcaaaccatcctcgcccctcagctccctaattagctgcgattaccggcgcgagccaccacgcccgactaatttttgtatttttagcagagacggggtttcaccatgttggccaggcttggtcgggaactcttgacctcaagcgatccacccgcctcggcctcccaaagtgttggaattacaggcgtgagccaccgcgcccagcccggatgaacattcctggttatgggatgaggtgacccaaggctctgagccgggctggtgtgggattgagaacagttagaactgcaagtccacctcccacctgctgtgtgaccttgtgcaaattacttcaccgctttgggtctctgtgttccataaaatatgggctaattgtagtcctggtcttgctggagggacttgtgagggactgaacgaattatgacacaaataaaaagtagaatggtgtcaggcctgttgtaagggctcgataaatattagctgtaattattgggagtggtgattaaagaggtcccatcctccctttaggtctgttttcccatttataaaattggacaaggtgcactgggtaacctgccaaacgtgggtctcgcctcctaggttcctggtatatcactgtttctggtggcatacaggttgtggttgtattcccggcccttccacttgttactgattgacaagggcaagttagttaatctctctaggcctgtttcctcttctctttaatggggttaattacctagttcatagggcggttgtatgaattcttttgttcagtaaatatatgccatgtatgagatatgatgctggggatatagtggagacaccagttgctatacaggatccagatgtgaaacaggtcagcagagctgaatagatgagtgtttgaaaagtgatgggaaggaaacaaataggatgtagtggtagcgaatccatattgaattgggcctctattctgtgcagggcgctgttctaagcactggtatatagcaggaacaagacagaaaaaactctaggccttggggagtttattttgtagtgaggagagacagacaataaacagagtatactggggataagcattagggagacaaataaaaataagagagatggggtatatatagggcatgcagttttaaagtgtggtcaggggaggccttgttgagatcctgtttgagaacacgcctgaaagcagagggcacagcaagtacaaagtggggtggggcagatccattttaagaaggccaatcaggcaaggcccctctgaggatgcagagtttgagaagagattgaaagaaggtgggggagagcctcccaggaagagggaacagatatgtaatggcctttttttttttttcttctttttttgagacggagtcttgttgctctgtttcccaggctggagtgcactgacgcgatctttgctcactgcaacctccacctcccgggttcaagcaattctcctgcctcagcctcttgagtagctgggactacagacgcaggccaccacgcctggctgatttttgtgtgtgtgtttttagaagagactgggtttcccggtgttggccaggctggtctcagactcctgatctcaggtgatcctcctgcctcggcctccgaaagtgctggaattacaggcgtgagccactatgcccggccagttttttgttttttttaactccaggatcacttccttcagctatctatcctcccatcttttcattcatccatccatccactaaccagcagacatttgtagggagatgtctttgtgccaggatcagagctaggcagcttaccggtttattctaaagaatattgcaaaggatacagatgaagacacatgcagggtgaggtgtgggggaagttgtgtggagcttccatgccctccctaggcattccaccccccaggaaccgcgaggtgttcatctgtctggaagctcctatggctgcttttgtgctacagcccagagttgcatggttgtaacagagatggccgcaaagcttcaaatatttgctgtctaaccctttgcagggaaaaaattgctgacctctgacttaaaccatctgcgtaacaaattattgggtgcttgctctatgttaggtacagtacagaggaatatcactgacgatcttactgaattctcacaatcactctttgaagtaggtcctgtccttgtccacattttccagatgaggaaactgaagcaccataaataacatggccaaagctgtgcagctgagaaatgaaggagccaggaaaggaagtaggacctaagggtggaatagaatctggggtgggacacacggttgctgattatattcatatgccagacattttaattgtgtctgagacagttcaggatactagaaggaacatgggacatgaaatcctgtagtcttgatttatttgttcagcaaatatttatcagcacctcctgtgtgccagactctgttttagatactagacatacagtagggaacaaaacagcaaagctgcccttgtggggtttacattctggtttgggagacagatagtagatctgtagtgggatgtcagtggcagtaattgctaagaagaaaaattgctggacgtggtggctcaagcctaattgtaacactttggttttattttattttattttttttgagacagagtctcactctgtcgtccaggccgtctctgctcattgcaacctccgcctcccgggttcaagtgattctcctgcctcagcctcctgagtggctaggattagaggcgcccaccaccacatccagctaatttttgtatttttagtagagagtgggtttcaccatgttggccaggctggtctcaaactccctgcccgcctctgcctcccaaagtgctgggattacaggcatgagccaccacccctggccaattctagcactttggaaggccaaggtgaaaggatcgcttgagcccaggagtttaagaccagcctgggcaacaaagtgagaccctgtctctaccaaaaaaaaaaaaaaaattagctggtgtgatgacacaggccttggtcccagctgctcaggagactgaggtcggaggattgcttgaaccagggagatcgaggctgcggtgagagcctgggcgacagcaagaccctgtctccaaaaaaaaaaaaaaaaaaaaaaaagaacaaaataagacaggtacagggaatagagcaagcacctggggctgctttgttagatagggaggttagagaaagctgctctgaggaagtgatgttgaacaaggatttgaatgaaatgaacaggtcgtggaagagcagtctgggcagagggaatagttggtacaaaggccaggagtgggaggatgcttgatgcgttcaaagcacagcaaaaaggccagtgtgactgaggcagagagaatggcaaagtggtgggaggtgaggactagaccaggactagatcaagtgaggcctgtgggccaaggtgaaggccttgaagatgggagggaggaggaggaattgcaaggctttcagtagtaattatgggttctggtataattttaaaggatccttcctctggctgtcataggggttgggccctgttgaggtgccattacaaagcacccaggaccagtgttagcatgcaggggggaagtatggttacagtcaggacatgttgaggggggctgatgggatttgctggtgggtaatgtagagggaagagttgagggtgactgaagtttgaacccccgctctgccagttgtgctctctgtgtgcccctggagcagtactttcccctctttggacccagattcctcatctgcaaaatggggataatgatgaagaatcagcgtgtgcctggttgtgaagatgcagtgaaattggcttgctcattgttctgcggtagtcatatggtggggattgagcagacctgaggaaatggggcatctggggaaccgtgtgggaccaagtcagcaagtgctaaagcctgggttgggaatacactgggctgtttgtttttttggttactatcaaggaagcagttgtgacaagccaggcccagtgagaatggatcagtagactagggtcagattgtgttgggccttgtaggccagagtaaggccttagcttttattctgaatgtgcagggaaaacatactacatgtgggattataccatatacattcatattatggaaggctccatgggttgaatgcagggtggatcttcaaaagtgggtcccctttccacaggtgcatatagtgggaaggcggattttatttattaactcaccacagagcaggctctgtgccgaggcctgctgggacacagagagtcccagtctagggtggtaagtgctgtcatggaaccatatgggtggactctttggaaaatcccaattcctattctctcacttaacacaacaatcaacaacacagaagaagacttccgtgactaaatgtgtgttggggtggggagggattcttcaccaccactaagcaagcattcagttctgcagcacacgccaactggatgtcctccaattcagttcagacacgacctggagacagtgttggatccaacaggttgagggctcaggcctcaaaactgccccttggccctcgccttcagttgccattctgggtcgtcagaacttctgatctacctgcttcaagttggagttcccatgaccaccctgcctttgggtttgattaatatgctagagcagctctcagaactcagggaaacatgtaagtttatcagttcattataaaggatagtataaagaatacagatgaagagaggcatagggtgagctatgggggaaggggtgtggagcttccatgcccttcttgggtgcaccaccctccaggaacctctgtgtgttcggctatgttgaagttcccaggccctgtccttttgggtttttataaaggcattgttaggtaggcaggattgattaaacctggtgatcaccttgaccttcagcccctctccgatccctggaggttgtggggtgggactgaaaatcccaaccctctaatcatgcctctctgttttccatgactatctttccagtgaccatggaccccatcctgaaggtatcagtcaacattagcatacaaaaagcgccttggagattccaaagatttgaggagttgtatgcaaggaaatggggatgaagcccaaatctgtatctcacagtatcacaactgtagcaggtgcttggtggggacacacttgggagatagtcagtgcacagggaattctcaggatatgacatgatcaatggccagtcaaggtttctgaaatgatattaatagattttctatcaggaatgtgacggagaccccaacctagagttgtttaaacaagtaagagttctctttatttctcatatagcaagttcagcagctcaaagctatcacagaattgggtcagctcaaagatatcacagaaatgcggtttttttgactggcctgttttggttataagattccagcagcatctgctgtcctagtggaactgcactttttagtgcagtttagcagaggccagcttaggacacagaggttctttccctcctcccttttatgaaggaggaaaatctctcctgaatctcctcagcagacttgcttgtatatctctttgccaagaactaggtcatatgcagagttagttgaagttaagtttggctgtaagtagtagaaaaactctaaataacaggggcttaaatgagcttgaagtttctatctgactgatgaccaaaatgtctggtggcaatccaggctgctgtggcacttcatggtgtcagggtcccaggctcttaccattatgcgctggttgtatcctccattctaccctccgtgtcccccaggttacctcaggtccccaagttggctgccgaagccccaaccattatagctccattccagacaggaaggagggaagataagtgtgacccccatccctataagttgcacaaaacatttccacttggattttattggccagatgttagttttatagtcacattcagatgcaaaggcaattcagaaatgtcttttccaggggtcatgtgtacagctgaaaaccaaggattatgaacagcagtatagccccatgcaggagctcctaacttggggatcatctgcaattcccaggcaggtccatgaatttggatggcaaaaataacatctttattttcattaacctttaacttacatttaacttcccttctgttatagattataatatcactatagtatatcataggtagcgttagcaaaacctgtgacttaccagtggaaatcaggagttgtgttcacatgtcatttctgctattatacatatcttctagtgttgtttatgttcacctctttcaaaattgcgttcattattagacctgctaaggggattcatggcaccaccccacccctctacaagagaaaaaccaaaaaaagccgggtgcagtggctcatgcctataatcctagcattttgggaggtcgaggtgggaggattgcttgagctcaggagtttgagggcagcttgggcaacatagtgaggcctcatccctacaaaaagttaaaaaactagctgggcttggtgacacctgcctgtagacccgtctacttgggtagctgaggcgggagaatcacttgagcccgggaggtcaaggctacagtgagctacgattgtgccactgcactccagcctgggtaacagagtgagaccctgcctcaaaacaacaacaagcacaacaaaaaagaaaaaacagagcaaatatgaatccatagtactggttaagaacctggtggctgggattcaaatcctggctttactaccagtaagctgtatgcagttaagctccctgtgcctttgtgttctctgcctcaagacgggggattctgtatttccctcatgggattgtgagggtcaaatgaattaaaacattaaagcctggggcatagtagagactaaggaaatatttactgttattattctgtcatggtgaaaaaagggaaaagaaacatcagtggaccagctgccacgatgtccttcttaataatctgaacaaaatcaggatgctgtcagtgaggcgtggttgccacggctgccattattaatcttcccctggtgctagggtgtccctgtagaatgtcattttgtactcaagacaaccctctgagggtaggtattctcatcatccccacttcacagatgagaaaattgaggctcagaaaggtacaaggattgcccaagattccacagctaatatgtaagcagtttagccttgaacctggacagtgcagctctgtagtaccaccctaggccatctttctcaagcattgatgatgctgtctgcctgaagaaacacttttaatgaaaccaaaagcagaatcccaaagaacagcagtggaaggaagggagctctctggatgggaaagcagcctgattgtcatgggcccacctcttgggcatccccagcttcaagttggggttcccacgaccccctctttgggtttgattaatttgctggagcggctcacagaactccaggaaacacttaggtttaccggtttattataaaggatattccaaaggatacagatgaagaggtgcatagggtgagctatggaggaaggggcggggagctttcgtgccatccctggggatgccaccctccaagaatgtgcatgttctgctatcaggaagctctctgaatcctttcctctttggtttttatggaagcttcatgatacaaacatttttgcctaaatgacagtatgatattgaaattgagtcaggctgcctggcttcattgctttccagtaagtgacagcctcacctctgtgcatcagtgtcctcactcgcctctgtgcatcagtgaagtggggacgctgctaacaatacatacctcagagcagttatgaggattcagtgtgttaatcatccatgtcaatcacttggattgctgccaagcacgtagcaaacaataaatgtttgttgctattgttctggcatttatgattatgattattaattgtaattattccctgtaccatctcattgtcctcagggctgttgctcacctagtatggccctagcccatgtgtatatttccccatagctcaggctgagagaagaacacacagatcaacttggagaaaacaaagaggaaagaaataggcaactaggtcaatactccccacagtattttatgttattttattttatttatttatttatttgagacagagtctcactctgtcacccaggctggagtgcagtggcaccatctcggctcactgcaagctccacctcccaggttcacgccattctcctgcctcagcctcccgagtagctgggactataggcgcccgccaccacgcccggctaatttctttttgtatttatggtagagacggggtttcaccgtgttagccaggatggtctcgatctcctaacctcatgatccgcctgcctcggcctcccaaggtgctgggattacaggcatgagccactgcgcctggcctccccacagtattttattatgaaagttttcagacatgcataactttggaagactaacacaagggtcagcagactacagtccatgggtccaattcagcccactgtctgcttttgcaagtaaagttattggaacacagctatgcctgtttgcttctctagttctggttctatggttgttttcagtgccacgcaagcagagttcagtagttaggtttgcaaagctgaaaataattactgtctggcaatgtatagaataagttttgctgacttctagcatagtgcagtgagcacctctatacttacaccccaggtcagtgattgttagtgtttgctatattagttttttatctttctataggtctgtctctatatacgttttattttttagctgaaaatcagttgcaggttttgtagtactttatcctgaggtccgtttaatgccagaatggtgagtttttggactacctgtatgaaagatttactgtgtgcatttttctgaggagagaccatcacaacacttcatcagatgctcatcgtctgtgatcgcagagatattcttcaactcctggaccggagaacccaactcacgcaagatcttagtcacttgtagacctcgtctcagttatgtagggcctcagaacagaacaggctaagggagctcctgctcctcaacctcgccctgtccctacctgttctgcctctatccaggaagaaaggtcccccgtgggaccattagtcactctccccctcatgaaagcatttcctcccactctcacactcatgagctcattccattcttgtgacagtgctgggagctattaataataggagaggcctcgtggtgatgaagaaatgaggggagagtttcacagtctgtcctgccatcagagcagctggctttggatcccacactccctcggtgcttgctttggtaggtgtctttacctctctgatcgtcactttccaaagtggtgaaaagaggatattagccatgcttttcttttaggatctggaggatcaaatgaggtcccaacatgtaaatgcttgttgtgagatctattatgtgtgttagccaaatataatagttctctaggactgccacagcaaatcaccatgaactgggtagcttaacacaacgaatttattctctcacagttctggaggccggaagtctgaaatcaaggtctcggcagggttggttccttttggaggctctgagggagacccattccatgcctctctggaagttaggacttctggtggctccagcaattccttgtgttcctgggcttgtggatgcatctcctggtctctccacccatcttcacatgcgtgccttcccctctgtatctgtcttcctttctgtctcttagaaggacactgtcactggattcaaggctaaccctccgtttaggatgatattatctggacacacttaactacgtctgcaaagactgttttgacgtgcacgtcactggattcaaggctaaccctccgtttagggtgatattatctggacacacttaactacgtctgcaaagactgttttgatgtgcacgtcactggattcaaggctaaccctccgtttaggatgatattatctggacacacttaactacgtctgcaaagaccgttttgacgtgcacgtcactggattcaaggctaaccctccgtttaggatgatattatctggacacacttaactacgcctgcaaagactgttttgacgtgcacgtcactgggacataactttttgaggctgctattcagcctcctgtactggtggtattattactactgctaatgctactcttgtttttgtagtcattttattacaataatttttttttctctttgagacaaagagtctcactctgttgcccaggctggagtgttgtttgttcttttacaatcacttagccagcaatcctggctttaaatcctgctccatgtgatcttagctgtctgaccctgagaggggcttttgttccccgagcctgtttccctgtctgtaaaatgggactccagctagtgacatgggtgcaggtgtgtggatgtgtttagccgaggaccgggcacagaggaagcgtgttataaacgtggctgctgctgttaaagtacagtgcattggcatgttacatgatactgtgtataggagaaagtgatgaagagagaggaggagagggagtacagttttcaacagagtggtcctggaaagtgcaactgagtaggtgtcaccttcataagacccaagggatgcttttgcatttgttgctgctgccactactattgttgttatttaatgattccctcgaggtcacagggtctcttggtgggtgtttgccaaattactcttgagcatcttcacatgtaaccaagcaaggcttccaggggctgactgggttgagagctgtcagaactcacgcgtgtctgggatttctaacattctcccctcctcttcttgttctctcattagcttcgcctcaacagcatcaagaagctgtccaccatcgccttggcccttggggttgaaaggacccgaagtgagcttctgcctttccttacaggtaacaaaggggacccctggggcccagatgtggggactcttgggaggtggttttcactatataagagaagacttgtggatttaacatattgtttgtgaatatctgccctgtgttagacactatggagtgggaaaagggattcagagaagtgcagtcttgctctaaaagaatggtctggaatgatggagacagatggtgaaagggatctagaagcaggtagaacgaggtttgagttgcagctccaacagttggaagctggtgactttagacaagttagtttacctgtttcttatatttttcatctgtagattgggataatcatccatgtgccaaagtgttgatctgagcattcaatgttaataacaattgctaatacttatgatatgcttactgtatgccaggtggtgttctacaccgtatcttgtgaggattgagttcatataaagtgtttagaaagctgcctgtactcagtaaacatacatcactatcatttcacccagttgatctcacagcagtgctttaagcaggtaatactgctgtccccatgttatagatgaagaaaccaaggtgtagagaggtgaagtgattcatttgcccaaggtcatgcagtgaggaggtaactgagaagggatatttatctagtcattctggcctttaacttgacagcattggttaatgactgatttcaaatctgagctctaccactttctaggtgtgtgactttgggcaagatattttacatctgcctgcttcagattcttcacaggtgaaatgggcataattatgtaacctaacatgaagactaaataagatactgtaaagtgcttataacactgtatagtacgtgccgcctaagcgatagctgccaggctgttactaagcactgctgtttgtgaggatgtaggtaaagcatttaatacactgtctgacacagactggaccacaattaatagtaaattctctgttatcattattcccattactacttcatattttatacttattaccagctgaaatcacagctgaaggttcagagtgctttgtcactaaactcttgtgtatgggaacatcttacttggacctagtgatgatcctggggaggaaggagcttgagattgttacccctccccacactggacagatggggtattggagcctaaagaggtgcagtgactcgcctacagtggcacagctagtgactgaggggtgcaggtgtgtctgactggatggtgcatgaagagtaggtgtctgctcgtatgacactgaacaaatggccccaaaccaggtggcttctattggtgaactgttggggagacttgaaagctttagaatgctgaagcatggcaggataataaagtggtgaagaagttgtagaggaaaaatgttggacctgggtttgcaataagcagctctgccactgacttgctaggaaaacctgagtaggtcactccacctctcttagcctcatttcccttgtctgtaaaggagtctaataagaggagtacctaacactcggggtgtgtagggaaaactctgtgactttcctctactttcacaccacagcaatcataacacagaacatgacttctgtgaccatatgtctgggtttttttccccaaactaagcagtggacagcagctggttgtcctctaattcagttctgacacgtctgcccagagacaggttcagatcccacagattgatagctcagtccccaggactgtccccagccctgaccaccagtcgctggtcctgtggaacttctgattgatcagcttcaagttgggattcccacgaccccctctttgggtttgattaggctcatagaactcagggaaacacttatgtttactggtttattataaaggattttgcaaaggatacagatgaagagatacagagaatgaggtgtgggggaaagggcctggagcttccgtgccctccctgagcccaccaccctcaagaacctctatgtgtttcaccatctggaagctctctgaaccctctgggtttttatggaagcttaatggcagagggtcctgagtggaacggaggcaccagccatgtggaactctgtgggaagagcatttcaggctgtggggagaggcagatgtaagctcagtgtgttggaagaatagcagtgaggtagccatgggttgagcaagattgttaagggagagtgagactaggacatgaggttggagaagaacagtgaccacagtatgtgagatcaggtttctttgaaactattggcagattgaaatgaaagagtgtcgggatttcttttacacctgaaagagtcactctggggtctgggagatcagatggtgtaggggcaaaggtggaagcaggaaaaccaggtaagaagctgttgcagtctcccaggcgacagctagtgatgatcagagtgaccttagtttgggagggttgacaggcttggctcagaaggagctgccaacccttccaagaaggatagttctctgtggattggtggaaagacaaggtgctggcagttcccaggtgtttggccttcagcagcattgcttggctataaggtctagactggagataaagatgaataagaattgagtccgtggatacgcataaggtcttcaggagacaaagaaaacagggagggtggttttaactgtgtgcagagggagccagggaaactgaggctgggaacgagcctaagaacagtgtagctggagtcacattggcgagaatttatttattgaaggaagaggcagagatactaaccctcctactgggccctgtgctgagctcttcaatgaaagcatttatttccctttagtctccgaacaaccctatgaagtgagaacagccctgtggtgatttaggggatgacaaaggctcagagagatgaagtgagctgctgtataagcagccaacagtaaagcaagatttgaacctaccataaaatggagatgatgataatgactccttaaatgagagggttgtggtaaggaggtgatgcagaagttgaacccaccacttacactcacacccctttggccagagcaaggttacgtggccttgccaactgcaagggcgtctgggaaatgcagtcggctgctggattgccatacacccaacttaaatgcaggaggtttaagtgccaatagatgccagggatattagcagcttgtgctgtgcagagatcagcagttcccactgcctcagggatgagaggatggagcttaagagagaggcctttggatgtgggcattagggacagaacggattttcccttcacatattcattctttcagcaaacctgaattgctgtctgtctgtgctcagctctggcaggaactggggcacagagaggagccagtcctgggctcgctgattatagcctatgttaaggatgtggtaaaggtggcatggaaggagagagagactgagcccagagaaggtgtagcggacatcctagaaatcttccaagaaggggcggctaaactgaatctccaaggataaaaataaatttctggcagagggaacagtgctgaggggagaagctggaccccaaaaaagctctcgttgaccatgctctgcgctttatacacctagtcatatttgctcctcactgtaaccgttgctacgagggagggatggtgaacaccattttacagacgcagaagctgggactcagagaggtggaatcactcagtcagtatttcacacccgctagagggcagaagcaggacttagggctctcttatcccagccaagcctgtaccttaatatctgtggcagcccaggtggagagtgggggagcaagtgggcggatggaagaactgagtgctgacagcctgaggaagcagaatggagtccatgtgttctgagcttgggctggggtcagagttgagatgggatagtcacgaagtctgtcttggttccacagataccatctatgatgaagatgaggtcctcctggccctggcagaacagctgggaaccttcactaccctggtgggaggcccagagtacgtgcactgcctgctggtgagtggaaggcaggaagtcctcttgcccaccccttagggtcggcccatggtcctgccggcctagggcagggaggggagcgtgtcagagagcgtggggatcacgtcagaacagccgggccatggacatccgctttaatccaacaagtcaggagtggcttttaatatcgtgaactcagggtgcagttatcatcctttctgtttagtggtcaggtaggtgcccagtgccaggccttacctgggattctacatagggctgtgggtttagagtcaggttgggttctactgcttatttgctgtgtgacttgtaagagaattacttaccctctctgtgctgtacctttctcatctgcacaatggggttatgaaaacctttttaaattaccttgaagagccctagcacagtacttggcacttagtaggtactaaccgatgttaactgcaattgtcattattgttgctgtgacatcatatccagcctttggggtaggagggattccctgtttatgggtgagccacctggagcactgagaggttaagcgtctcttcagattgtatgactagtagatggcagagctgggattcttggtctgtccatttgactgtctgccaggtccccaccccactgcctgcctgtgtgtcccgtgctaggtgatggccaaggacacaaagatgggccagatcccaacaagcagcgttgtttgagagaagatgatctgggaaggcagaccgtacaggttacctagtcccctggttttcactgttctcagagtgctgggccactgctgctgcctctgcctctgccccactcccccagtgattgtgtatttcactgtcgctagagatacaatgtggcaccggcagttgatggtgtattagttagcagcagcctttctcctagctctagtggtgtataaagaatggtgcttatcattgttgggatcttgggatttgagtaaatataacaatttgtttcttcccaaatagcattatgtaaagaaacttgatagttaccattaaattcggatatctcagccttcatctgggcatatgtgtataatttgtgcgtatggacacacagaaaattgtatacaaatagatcgtttcatacattttacacaaaacagggcttaacatgagcatgatgaggtttgggggccagcctagaaggggttccttgaatttcacaaaattatctgtagcccctgcctggtatttgtcaggtggaacttctgagcagtgaattcatagctttcagtagcttctcagaggacttaggagcagaagacattatttttatgaaaccgcaaggcttcaacaagggcccccagggtctgcaactgaggttgggactcaggcttgctgtggagctgggctgggacccagggatccttctcctacctggccagggtctcccaacagaacattctcagtgaggaaagtcccagtcaagccacgcttccttttgggaagcagttccctgtgaccgatgtgcctgacgttcatgtcagccagcagacacatcctggggctgtctgggccaggcagtgctggaaaccagagaagagttagatcagaatagcttgtgcttgctcgttgcctgcagtgcacatcccaagagccttacacagttgtatactgatgttagctgtattgcccagatgaggaaactgaggcacaggcagatttaagtgaattgtccgagctgggaagaggcagagtccagattcgatcccaggcccctaattcttagccactcctatgtgctatcctcagagggctcctggttgctttcagagctgtaaacaagggaggcaggggggtccttaaacccagggaaggcgcctaacctgcttaggtgggatgggaagttgtcagggaaggcttcctggaggaggtggctgttaacctggattttgacaggttataagaaatagaaaatggctttgtgtagtttcttcattccacaaacattgagcaaggtctctaggctatggaaacccagagatgtgtcagacccactcccggcccttgctctcagcagtggtgaaatggaattaattacagagactcctgtagctgcagtgtaaggattgtttttttgtttgttttgtttttttcccgagatggagtttcactcttgctgcacaggctggagtgcagtggcgggatctcggctcactgcaacctctgcctcccaggttcaggtgattctcctgcctcagcctcacgagtagctgagattacaggcgtgtgccaccgcacccagctaatttttgcatttttagtagagacggggtttcactttgttggtcagattagtctcggaatcctgacctcaggtgatccacccaccccggcctcccaaagtgctaggattacaggtgtgagccaccgtgcctgggtgtgagggttgtttctgtgtcagcagctctttttatttttatttttctttgagacagagtctcgctctgtcacccaggctggagtgcagtgttgtaatctcagctcactgcagcctctgcctcccgggttcaagtgattctcaagcctcagcctcccaagtagctgggattacaggcacccatcaccatgcctggctaatttttgtattttttgtagagacagggtttcaccatgttggccaggctggtctagaactcctggcctcaaatgatcacctgccttggcctcccaaagttctgggattacaggcgtgagccaccgcatccggccagcagttcctaactcttttggaattatggatccctttgagaatctgttaaattctggaccctcttcttataaaagtacacaggattttaggcggttcacactcttccctaccctgtgtggtctccaggtttgagaacccttgcccccagacttcacagagaggcttcacagtagtgagtcttcactgtgcaaaggcatcaattgcagtttcttaaatgtgtaccttcctgggccctgcctccagatattctgattgttttggtccatgctgggataggcctccgggtgattctgctgcagggtggtcagggatcatcctttgagaactacttcctgcagtaacctacaggagaagagaaccttggcttacataattactgctcagcctctgtcccaggcctccttataacagattgccgtaagttccaccggtagtcacttggcaagtgttgattgagtaccttctctgtgccagcccaggtggtgggagaactgaggtgaacaagaggaactctgtccctgcagtatcccagtcacaccgcacctatggtcacactcccatgatactgtcctgaacttgagacgtcacgatagcatgaggacctgtgacagtgacattatgctggcttgcttagtattacatttttcctttgaatcattcattgcaactatttttaaatgctatttttaaacatttgtttttattcttagttttactgtaaaaatatacatagaatgtgctattttaattattttaaagtgtgtagctctgtggcggtaggtttattcacattgtgcagccattatcaccctccatctccagaatttttcacctcctcaaactgaaattccaaacccattggacatgagctcccccttccctctcccccagcccctggcagccaccgtaggagtttgactgttctagattcctcatataagtggaatcagaaaatatttgtctttatgactattagctaatttcccttggcataacatcttcaaggttcatccatgttgtagcatgtgttacatgagacttctcacatacaagattcttgagtttttttgagggctgcatttggaaaaccagatttgcttattgccagctgcattctcccatagtgacagtccttggagctggggagcacctgccctccctgggctacatgccctccagggtgccacagtgcctgcctcttcctattcatgcctcctgccacccctgcctgtcaccttggctgatggcatcattctgttacttgactgagccctggaggcatttccatttatgattttttttttcctgctttaaatacctgtcagcccaagttgaatttcagatcagagacctccacacctttatttgaacatattgggataagttgagtctcccttcagtaggtcactaattaagagttcctgtcttgtgctaagagtgctgctgggctctggggatacagtggagagccagtcgtatgtatctgaaggagcacagtcattctaggcccacagtaacaaccagcgagcagtcccgagccccatagtcccccagaaacatgagatcccaattcagtcaccagagctgtgtgtaactgttcatgggaagcttaggtcaggttttcgatcctgacctgtagctattactagcttgggcaagccaggctgtacctcagttttctcttcttttttttttttttttttttctttttgagacggagtctcgctgtgttgcccaggctggagtgcagtggtgcgatctcggcttactgcagcctctgcctcccgggttcaaggattcttctgcctcagcctcccgagtagctgggattacaggtgcgcaccaccacacccagctaatttttttgtatttttagtagaaacggggtttcaccatattggccaggctggtcttgaactcctgacctcgtgatccacccgcttcagcctcccatagtgctgggattacaggcgtgagccactgcgcccggcccgttttctcttctttaaaatcaggacttgctttatagaattcagtgaggaagaacaagcacccctggtacaacacggaggtcctgcctagtacacacagtgagtagatgttctacacagtgtcagtgatgatcattgcactttgagaggctaagaactttctcctcagaaagcaacgtgtgtaattttaaggtttatggaccccagtgaaactccttcaaggacccctaaataagaacctttgtggaaggcacgctgacagagaccttctgctggctggcataatattacgtttttcctttgagtcattcattgcaaccatttttaaaggctattttaatgaaggtcgggatgggtaatagggaagttttctctgaggagatgagcccatgatggggtgcaggatggggctccagggctgcggatggtggagagggagctgtccagtgactttgtgttctcaccacagccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtgagtctctgcctccttggaagctccaagctcccatctcagctccaaccttctctaaagcctcagactccttttggtctagctggggcccaaatgcccctgaactctctccactcccactcctgcttaccacctgataggccacatcctcgagagttggtctctggacacggccacgtgtcagtttacccacctctgcccccttgctcacttaggaattgagatgatgacaggtcctccttcccactggttaatgtgaggatttaaaagaattatcacacataaagtgcttagagcaaaatctggaacataaaaactttcagcaacttacatctgatggtatctccagcctgtcccaggtccagtgcctttggcagataaaccacctcagttttcagcctcctgctcgtctactttgcaaacgattgaccgtcaagcccgggtttgagcctgactcactccagaactctggtttatggctgtacacttgcttagatacttacactggcccccaccgcctttgatcgaagcaattgctgctgaaaaataaagcctttctgtggctctagacctgcctcttagttaagcagttttttgtttgtttgttttttgagataggatctcgctctgtcatccaggctgaagtgcactggtgcagtcatagcccactgcagcctcaacctcctgggctcaagcattcctcctgccttagcctctcaaatagctgggaccacaggtgtgcaacaccacgctgggctcattttttatttttggcagagatggggtctcactatgttgctcaggctggtcttgaactcctgggctcaagcaatcctcctgccttggtcttccaaagtgttcagattacaggtatgagccactgtgcctggctcgttggttaagcaatttttatgggaatgatgtaatcgtcagcacttagcattgactagatttattatgcgcaatctgcgaagtgtctcacacacactattttcatttaaacctcatgcggacctgtggggtaggtactgttactatcagctccgtttcatagggctgggaagacagagagggggtcatcacttgcccaaggtcattcagctaaaacctggacccacacaactgcagagtctgtgcttgctcctctctgccatactgcctgctgcctcaggatccccgtccccgactcccaggtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggtgagttttgcttcctggccctctgctctcccgtccttctggtggttcctgcccatgaaagagaatcccagagctcagcaaggcctctgctgccctcccactgttcctctcctctccctaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagaggtagatgagcgaccgttgacattgtcccactggtggggacactgacactctcagaagggaagcatataggagctgaggtttccattaggccgatggaaccattgggcgtttgagcaataagatctctatgatcatctaactgcgtctcgcttcgtgtgccaatcctggttgattgacatggcatcttaaagtgctgccttgagaaagattctgaggcaaagttaaggctacgtggaggaaagtgccacaggagcagagaagggtagcacatgtggggtgttcctgacataatcaagctgtcctttcacaaaggggaagacagcccaaaaaggtggggttttttggtgttttttttttttttttttttttttttttttaagatggagtctgtcgcccaggctagagtcttgttacccagctggagtgtggtggcgcaatcttggctcactgcagcctgtccctcccgggtgcaggcatttctcctgcctcagcctcctgagggactgggattacagatgcccaccacgacacccggctagtttttgtatttttattagagacggggtttcaccatgttgttagccaggctagtctcgaactcctgacctcaagcgatccgcctgccttcatctcccaaagtgctgggattacaggtgttagccaccgcgcccagccccggaaagtttaattaactgatcagagtgacactaccagccaggcagaaaggggacaagactccaggtctgtgactctcaggacagtgctccttccacagggatccagattgcctcatcccacaaacatgtttgctgagcaccagctatttgctgggccagtgaattcggatcattcctggccttcatggagctaggcagtctgaaggggaagactgacttaggggaaatttgattataaagtgtcacaggtgtgggacagacagacagatgtggggccttggaagcattgaggaggggaggtggtgttacagctggttctagaagatgagtgggtaagagctaagataggaactttgttccagccagaggacaaagaaccctgggaggtgagagcaagtgcaagcaggaacattcaggcctgatcttgatggcccagcctgagagaaagcaggagagagggcagggtgggatcggagagagggcagggtgggatcagagaggccttgagtgccactccaccctgaggcgccctttgcctttaattatgctggttcccactggcatttgcgggaaggactcagagcttcagaatagcgtaccatcaccacagttagggaaggttcttcccatccttgtctcctgagctgcataaactgtgtcacactgggtcttagaataaaaattccatgagggcaggaattttaggctgttaaaccagttcttggcacatagtagacattcagtaaatatttgcaagatgaataaaaggcagtattttcccaagatatcatgaggtccttcaagatttttacttgttcattcccgtcttcataatgaactgtcctgcttcctaccaggtcttcaggaaccagctttgcagcaggagccgtgcgtctttccatgcctggtgccatgaaacaggcagggccaagcgtgcctccctttttttttttttttaagacagagtctcagtcttttgcccaggctggagtacggtggcacaagctcagctgactgcaacctccacctcccagactcaagtgattctcgtgccttagcctcctgagtagctggaattacaggtgtgcaccaccacacccagctaattttgtatttttagtagagatggggtttcaccatgttggccaggctggtctcgaattcctggcctcaagtgatccacccacctctgtctcccaaagcgctgggattacaggtgtaagccactacgcccagccctagagtgccttcctttctgtcaatctttattgttttatttttattttgagacagggtctcacaccatcacccaggctggagtgcagtggcacagtcacggctcactgcagccttgacctcctgggctcaggtgatcctcccacttcagccttctgagtagctaggacgataggtgcctgcccccacacccggctaattgttttgttttttttgtagagtcagggtttcactgtgttgcccgggctggtcttgttctctgggactcaagcgatctgtccacctcagcttcccaaagtgctgggattataggcatgagccatcgcacttggcctattgttttattttcattacaaaagtaattcgtgcttctggtaacagatctttaagaaatacagccatatataaatcaaaaagttgcagtcactatatcatttgaatgtttttgaatcaggtaacagaaaacttaacctcagtagcctgaataatatggaaatgtgttatttttaatgctgacaacaccgtgaggtaggtgccctcgcagtcctcatttttctttggaagcaaaagaggctcagcgaggtgaagagccttgccccggggccagtcttggcactcgaattagattttagcactgcttccaaggcccacgctctgtcccctaattctggtgccttcactttgattttggcttccttagcccagagtaaactgccagcccctctcactctccccctcctccttcctgtctgcagctccagaaagcagtggggcctgagatcaccaagacagacctggtccctgccttccagaacctgatgaaagactgtgaggccgaggtgagggccgcagcctcccacaaggtcaaaggttggtgctggcagccggaacacagcaagtggggtgggtatccaaggggctggaggtggaactagcacatcaggtctcacttccctttgcctccctctccctgcccacagagttctgtgaaaacctctcagctgactgtcgggagaatgtgatcatgtcccagatcttgccctgcatcaaggtaacagagagtttgatgggaggaaccaagtggatccgagcctgccaaaaagaggggctggagacaaggctttggggatagtcagctgcaaactaggttcccagccctctgggaccaggcagctcttgggtttcaagcagttaggggtcctgactgcagcttgaggctgaccttaaaggtggaagtactttctagaacctcagatgtcactgagtcctgtcattcacagggttttggggttggagtgggggctgctgagagcaggggtcattgaactcttaagtaggtggtactcataaggaatagtgatttcccctgtaccctaagccatcccctgctctatgaatgagaggggcagaagcaggttattgtctcttaggagttggcatctgcttagccacttgctgctgcaggggttgcactgacccctgtgcctgcctcttctctctcccaggagctggtgtccgatgccaaccaacatgtcaagtctgccctggcctcagtcatcatgggtctctctcccatcttgggcaaagacaacaccatcgagcacctcttgcccctcttcctggctcagctgaaggatgaggtaagggcaccaggatctcagctctgggtttgtggaggggacaggcgggtcttcctagattgctagggtttacctagattgaccaggaatctgctgatatctcaacagacatccagatctttgctgagttgcatgtttgtgggcatagctgtgtgttcatgcgttcattcctccaggcactcttcatgaggcctttcctggacatggaggatatgaaaaatagaaatttaaagtttttatttatggccaggcgcggtggctcacgcctgtaatcccagcactttgggaggctgaggcgggtggatcacctgaggtcaggagttcgagaccagcctggccaacatgatgaaacctcgtgtctgctaaaaatgcaaaaattagccaggcatggtggcgagtgcctgtaatctcagctactcgggcagctaaggcaggagtatcacttgaactcaggaggcagaggttgcaatgagccaagattgcaccactgcactccagcctggacaacagagcaagactctgtctcaaaaaaaaaattatttatttatgttttgagatagggtcttgctctattgcccacactgcagtgcagtgatgtgatcatggtctactgcagcctccaccttccaggctcaagtgatcctcccaccttagcctcccaagtagctgggactacaggcaagagccaccacatctagataattttaaaaaacattttccatagagacaagatattatgttgcccaggttggtcttgaactcctgatctcaagcagtccttttgccttggcctccaaaggcctgggattataggcgtgagccgctgcccccagcctagaataagagttttgatccccaaaagccttcagagactggcagtggagagagacaggcagtcccatgatgccattaaggtgttacaggtgctgttaaggatgagttcatgttttttagggtttaggctaaggtgctctaatatagaccccagaatacattctggcttaaattcggtggtggattttttttctctctctcataacagtctaggacgagattcctcacatgtgcttgcaccccatacacccattggccaggagggtcacgtgaccacacccagcagttcaggttgcctgtattacaaaggatgagaggcggtgctgggtgatgactggagagatcatcagggtgaccactggggaaggagtttggacttgactgtgggcaagcggaagagccagaatagagttggtgttagaaggcaccctgaggcttatgtgaaggaaggattgaagtgaggtggccagcagcagtgtaggcagaccaaaccggaggctgtgggagtctggaaggctgaggctagactaagtggtatgtagagatgaggctgcattgatacggaaggattcaagattgttcaggaggcagaagggaccacgtggtggtttttgccttggtggtgaaaaactgggcagatggtgcaattgtgtgctggtgtgtgacatctttcccaaaagatgggaagtgtgtgaggcttcccaaaagcctcagtctttcttccccatccccttctttcttttttatacacaggcgcccacacagtctgctagaaagttggaggaaatactgtaacagaaagtactgcatcacatttcagtcctccatgcccctaaaagttacgttattcaattctgttacagtggagtaatctcttagccccagaattacagtgaattttttaatacattgaaaagagtgcgctatttttaatatttttttgttctttttgtttttccctattagtgggtgattaactgtactggttttaatcagttaattacgtcagttgctaaaagtctgaatcttcattagtgttcatgacaaattttatgacttaagtaatttatctgagttatgcttcacatgcacatagtttttataattttatagatattaatacaatttatatttgtttttgatgctttaatgggcataatttggcaggtgagagcccctcaagttgtctgctatgtcatttcacacctctccagcgttttggggatcattttgcctctggcatgagggaaggatccaggctcagcccagtttgaaggcaagcccatacgtgctgcaagtgcgctaggactggagcattttttgctccagtttcaccttcagcaagcgctatatggtaatcgtgtgctggcagccagcctgtctcagggcagcttctcttagaagaaaagaaccagcatggttttcttggtgtgaggaattcatctgacttatatttgagatttccattttagatttataaactttatattttacattttgactctcaccagaatttataaacttgtctaaatgaaaaaggctacctttttactggtgcaccaaaaataagtctttttaaatgggtgaggtatagtctctgagccttctcttctcatgcacatgttcagcagcttgaggctcacacagcaagggctggagctgggcaagggccagtcctatcctcggaatgtgcagggtttcaacagcccaagcctgccaggcttgttcacttggttattgattcatttcagtgctcctttatttatttatttttttagactaaaatagttttaataaggaaatagttttcttccttcccttctcccatgttgtggattgatacccagaaaggaacccttgttagcaagcagcggagctaggattagaagaatcatgtctgcctgttttttccagggtgctgtattttcctactgtgattcttaaagtcttttcaaaatggataaacatttcttgtgatactattgtaaggtttaaaaatctgcttaagttagtgatccatgctgcttgctttttgtgtgccgttaatgtgttcccagaacggggagctgggcttggacaggagtagtccctcgggagatgtccataaaagttgatgcagctgagctctttccatcctgtcctgggttgctgtgtgcattgcattctctcagaatccttctttcctctcctcagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctggtgagtgaggaggcctgggggccaggcagtgctgcctcaggggaggtgcagtatgtccagggctgtgatggggaaacggggctttgaaggcttagtggaggctgtgacaactgcctggggagtcgaaggaagggacccaggaaatagggccttaaaagatgcattggattcaataagagagaggagggaaaggagcacctcagacaaagttgagaagtgtccggtctttctagggtgggtgtaggttccatgggatgtggctagcagctccccctgtttgctctcctggaacgcttaccttggaacccttggtttctcctgtagggagtggagttctttgatgagaaacttaactccttgtgcatggcctggcttgtggatcatggtgagtaccttcacaggagcagcaagaggagatgggagctccagaaaggcaggatggattggctggggctgtggcgggcagtggaggaggctagagtcactccccacgccgctggatgctcgtatggaccagctcgcatgcttgttagagtcctagagaagtgttgagtgggaggaggacgaaacagatcacccaggggttgcctggtatagtggagagccagagggccactgagcagccagaccagggttttgaatcctgcccttggggctgtcagatctaaaacaagtcacctgctgtctttgaatgagccccacactcattctttgaaacttcttattctggtgccttggggccattatgagaatggctcattgtttacactaagagaggtaaaaaataaaaggtaatatttatctctgtgaagccctgtttgaagtaataagtgccacataatttaggcaaatcacttcttagagccttagtttgcccatctgtaaaatgaagccagtagtggaacctacctcttggagtggttgaaaagatactgtataaaaaaaaacagttactagatatagcacatagtaagtccttttttctctctttggctcacatgcagcctggcacctaggggctgctttgtaagccatggtgagtgtgacctacattttgcccacatcagttcttcacctccaaatccctgtctctctcaccctcacccttctgcagtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgagccttccacctgcctgctggcccatccctagggaactggagcgcgtgggagaggagggatgctagagggttccccaagggagacacctggcttgggaatggagacatggagtgcatcttctatccagagatgagtccttggggaactgcaggcaagggggtggggctcccagggtcagggtcatagggcctctgggactggggacttggatggtgagggacccagggcctgggagacttgacctgttggagcagcgatctcaagctttatgagcacccctctccttccctgagaaatgtgtgtctctatctgtggtgcgttgggtgagtgtatgggctctaggtcagacctagttttaaattctggtactgccatatattagctatggaccttggatagttacctaaccgatgctttggtcttctcatttgtaaataattcatactgtaaagaattcatactggtaatcacagcctggtgagcgtgaagattaatcaggttatacacgcacagggcttagaacagttatgctacaggtaggaagtgctcctgtctatttgcttttcctacgattataattatctcatgtactacttatttatgtgtaaaccatacacagggctagaaaggaagggatttaaaaataaatataactaagtgttctgatcatttcttcccacgccactctctggagagcattgctttaaggagggatcctagggcttggtaattaaggtcgatctccagaataattaagggaagcctgaggacagagaaactgggacatggtgttaggatggtgttagtggagttgggagattcactccactaactgagtcacccgtattgctcagcctctgtggggcctgatgatcaccagagtggcctggtcagaggcagcaggaaatgagagttagccaggagctttgcatactcacccctgccactcactggcccccaggtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacaggtgaggtctggatactcccccacacactggcaggggcttcttgtgggcaccttaatctttgacctttgaaggtagagcccagggtcagaggcctggcagcgctccttgcttgctgtgtgaccttggctcccttcccttctcaaggtgtgttttctcaactgtaaaatgaacatcacagcatgaaatagaaagagggggtgatgggttggcagtcctgtatactagcaacaagtcattagaaaatgaaatcaccttatgttttatatgtaagtatgtgtataatttataattgcaccaaaaatatcaaatagccaggaataaattcaatgaaagatgtgtatgtaacacctctaatgtaaactgtaaaacactaatgtgagaaattaaagcagacctgaccaaggtgggcggatcagttgaggtcaggagttcacgaccagcctggccaacatggcgaaaccccgtctctagtaaaaatacaaaaaattagccggtgcggtagcactcacctgtaatcctagctatttgggaggctgaaggcaagagaattgcttgaatccaggaggtggaggttgcagtgagctgagatcatgccactgcactccagcctgggcgatagagcgagactgtctcaaaaaaaattaaagcagacctacataatattcacggatgggacagttccctgaactcatctttagattcagtataagcccaataatcttaacaggttctttagtggaaaattgacacttctaatgaacaaagttgtctgatttacactaccagagacgaagacttatgacaccacaataattaaaatagatgtgaacacaagcatatttaaatcgcccaatagaatggaatcaagggtacagaaacagtcccacatgtgtttaacagtaggcatctctgcagttcagtggagaaatgtatgttttttaaaaaacatagctgagtcaatttgatatccatttaggaataaaagaaggctcgcctcaatgcataaacaaattaatttgagatgacagaccagaaccagaaagattttaaaaataaaggacctagaagaaaatgtaggaaaatatcttcttgagttagcgtaggcacagatttgttaaacagcaaaccagaggaagtgatgggtaagttgaccttctgtaaaatgtaacgctgtttctcaaaagacagcattttgagagtaaaatgcaagccactgactggaggaagatgttttaatatatgtttctgagaaaggactcatccacaatacctgtctacaaatcaggcaagacaagaaagagatggggaaaaagacttgaataggcacttgaaaaaggatctccaaatagccagtaagcatatgacaagggtgttcagcatcattagccttcaggaaaatgcaaattaaatctcagtgacatatgactacacgcctcccagaacagccaacattaaaaaagactcagtggtgcaaatggtgaagacatagaagagctggaactctcatccattgcacgtggggctgtacatttagggtttgatcactctgaaaacgggagtggatctggagtggaatttggtgaagcttgttatacaaacagcctgtgaaacagcccttccactcctgggtctctatccaggagaaatgagtgctgtttctgtcagaagaatgttcatggtagctttattcatagtagccgtaaaaatggaaacaacctccatgtctgtccacagtagagtagataaattttagttcattcaaacagtggaaaactattcagcagtgacgaaacaaatgcctgctataagcagcaacaggtgactctcacagataccatgttgagtgaggagccaaaatcaagaaaacacaccatttatgtcaagttcagaaacaggcagaatgaaggaatcgagatgatggaagtaagaatagtggttatttggggagaacagggaactgtcaactgaaagtgtgggacccacaactgcagatttctctttctgtctgttccaggacacaacctcagctttagtttctctccgaagtccccctccgttttccaaaacaattgactcttggtgcaggcggatttccctgggccccatagatgagagtggatgcctcctctgggctcctggaggaccaggaacttccccttggggccacttaccactcccctcttacgtaccagtttggtctcttcctcctggcccgggtgcctcatggcagaaatcaagagtgatttagctctgtattcactcctaatacattgtaggcctcagtgaatatgtgtgaaatcaatgaaagatacccatttgctgggcctcagagacttgggggttctgagattctgttccactttcccagcctgctctgatctccctgtttggggccccagtccttgtttatcatacttctgacctttaagtaattggttggttggttggttttttgcagtttgtttggttttcctttgaggcagaatctcgctctgtcgcccagactggagtacagtggtgcgatctcggctcactgcaacctctgcctcctgggttcaggcagttcttgtgcctcagcctttcaagtagctgggattacaagtgtgcaccaccatgcttggctaatttttgtactttgagtagagatgggggttttcccatgttgtccaggctggtcttgaactcctggcctcaagtggtctgcccaccttggcgtcccaaagtgctaggattacaggcttgagcccccgtgctcggccttgagtttacctttttttttttttttttttttttgagacggagtttcgctcttgttgcccaggctggagtgcaatgatgcaatcttggctcaccacaacctccgcctcccaggttccagcaattctcctgcctcagcctcccaagtagctgggatcacaggcgtgcaccaccacgccctgctaattttgtgtttttagtagggacagggtttctccatgttggtttggccaggctggtctcaaactcccaacctcagatgatccacccaccttggcctcccaaaatgctgggattacagatgtgagccaccacgtccggcctgattttacttttaattgactcataattttatatatttatgggggtatagtagtgtttcaataatgtgtgcaaatgtgtaatgatcaaattaggataattagcatatctatcaccttaaatgtttactgtttctttgtgatgagaacattcaaaatcttctcttatagctgttttgaaatatgcaaaatgttattattaactatggtcacccgcctgtgcagtgatcagagatttctaattcctgtgtgtgccctggattcttgagactcctcccaccttgggtttggtgtatccgtgtctgtgtacactctcttgcccaagagccctgtgcccacctgttgccccagtccatcctggctcaccctctctctccctgtctcctttcgctttccagcaccttgcagagtgaagtcaagcccatcctagagaagctgacccaggaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagt

SEQ ID NO: 35642 - DNA, 64714 bp, Homo sapiens
cgcgcgcaccacaacgcccccgccccgccgcccggaaccagctgagcgcagctggacccagcagccgctgtctccagtgccgcagcagcaggtaggggaggcgcgcggccccggccccgggcatctgggggtcccgggctgatttgagtccttcctctcccttccttcccggtcctatctcgcccgcgcctggagctcggcccggccgcgggggcatcgctggaaaagggcttcctcgctcacttttcccgtcttccaagggaccaaagagtgtggatgggagttgggggatggggagacgccggagcaggagaggagaggggccaggcctccaccccgtgattccactgtgctgctagcacctgagctaataacctcgaccccgcccccgggatgggggaactggcccggggtcacccctgcacttgggttgtctgacccgggcatgcaggggaccaccagctacggtctgggcggtgactctgctggggagtccactcagaggacccttgcctcctggacgatacctgtgcctgctctcctctccagctgcttcctctttctggggactgttagaaagttcttccttacactgtctgaaatcttcaggcgcctgctacctgtaggtgctggcttctccccggccctgcagtgttcccttccctgactcacacggaagcttcttctggagttgaagacagtgattggaaccccttctccctgagcccccatgtcttctggggtccagccccccagaacctaaataacagcaacttccctctggtccagtgcaggctggctggtctgggcagtgcccagggggaagccccagtccttggaaggctgggggctgggggtgtgggtgagcaggagacattggctttcttcctagctccttgtctgcccagacatctgtcgctttatcctgtcttcacaccctcctcagagcatggaagggagctttaaaacacccagaactcattctgggctgtcctgagggtaattggactttgtggaaggcggggcctctggggaggtgcctttcgcttttgtttggcatctggggacttttcaaacacttaatcctgtgtgtcctgttctcccaggaccacatttctgaccagggcaccaggacctctcaccgctctgccgtttacagcgaccatagcttgctagaatcttaccccatctccatttcctccatttcacagttgagaaaagtcaaggacccagagagtttatgatgggctaattgtcacacagtgaggcagggtagggctgagacccaattccggtctgccgtttgcggactccttgctgggagggactctagcctccttcttgggtgttccgtttactaaagggacaagcattccctgtacatacacacttgggggtgctggttggtgtttcttggggctgttaagggggagaggcttggaaacagaggaggaaggatgggggtgggaacggtcggctttcagctcctttgaaactccatttttctttctggggccatgctatttataaatgccagggaaattgtaaacagccaggggagcttgggttggcactcggtgagttacacagcagcaaagaaggtttctgtgtgaatcaggggaggaaagtttactccagaattttccacagtccttttattagggactaacatgagcctggaaacaggctgctcccaggaggggtggctgcagggtttgccccgcatggcatttccttcctccccgcctccctcctttcagcacttctctgggcctgtgttctgtgccttgccctgcgaggggccaaagagccttggaagaggacagagctctctgtcctcaagatgcttgccatctatactgtttgacacttttgtgccatattaagagtgacttcagcctgcaagaggagtgactaattttgtctaggtgagccagacctcagaatgaataatcatttaccaggagaaacaggagttgggggaaaagacattctgggaagcaggaaccactagtgcaaaggcactgagattttctgagccatccatgtggctagagtggaggatgggagaagggcggggtggtgggaggttgagaatctaaatgaaaatggaactagattataagctaagggtttggacctcatcctgaaggcaatgaagagctgagaaagggttttgacagagcagtgatttttaaaaactcgttattctgaatggctgatgtaggggatgcattgaacgaggctgatctggaggcaggaaggccctgaggaggctgttgcatgattcaagtgaagtagattgcaggtctgaactagagcagtggccactgggatgggtcagagcagcagattctggaagcccagctgaaggtctcagaacctgctataaatttcatctaaaagcagacaacaggctagacctactggagaaggttgctaaggtattcagcattgtaacttttttttctttttcatgagttttaaaacaaacaaaaattgttaaagaatccctccaagcccgcctctttccccagaggtcgccactgttaacaatggtgtgtgcactcctgccaaacacgttgattggatgccttcacttttagccatccagtgacagtgggtcactttcccctactccatgtgaatagtttgggtcatttgtgatgtgggtcatagagatgatttctgcttggtctatggtacgttgctgagacactgagctctggttttctttaagaaaacttttacatcctgtgtctgcggcctctgggtgtgtatatttgcttatcagagaccacaggtgtgagagaagttagaagcactgacttggaaatggacccccagtcttggttctttgggtgaccttgggcaaatcctatctctctgagcctctggttcctcatgtgtaaaatggagagatgttggtttgcatgataataataaaaagctatcttttaactgggcatggtggctcacacctgcagttccagcattttgggaggccgagttgggttgatggcttaagccaggagtttgagaccagcctggtcaacatggtgaaaccctgtctctactgaaaatacgtgctgggatgctcctgtaatcctagctacttgggaggctgaggtatgagaattgcttaaaccctggagacggaggttacagtaagctgaaatcacgccactgcactccagcctggatgacagaacaatactgtctcaaaacaaaaaaagaaaagacaaaaaaagctatcttttaatataccaagcactggaacattaattactttattgattccttgcaaccattcctctgaggtagatactagtatcttcttttacagatgaggaaactgagtccgaggctgaataacatgccccgggttgtgtggctattgggtgatggtgcaaggattccagaggtctgacgacagagccatagctattaatgacagcactaaacattctcttgaaaattctttctagtcctggtattaggagaactggtaagggagtttgttatgcttttatgaggggtgggtgtcggtgtgcagagcttggagagctcagccctgcagcagagaggcctggaggggcctcccggggctgtttgtaaactcatgctttcctgtgccatccgcaggaccctcagtgcaggtcaatctcccctccatttcagggaatccaggctccaaaaggacacaggacttgcccagcaaggtcatgtggtgaggtgagagcccagccaggactggtccccccttttcatcaatcaagcttatgctctggaaatctatctggcgaagccaggaaaactggacactctcctgctccttggttattccctgagaaaatgccagcagaagcagagaaaagcacgtcccaggggttatgcattttggggaggaagggaaaaaaagagaccagtgtttaggcagccgggggatgttaagtaaaaatatctcctcgctttcaacggagtgagcgtgtgtcatatttcagcctgatgtggtttgtgaagttggagaccacaggcaggctcagttcctgctgctggccagcttccccttccctctgtccctcccctgccatatgcctgctctcgtctgccctgcctgggaccacatcagcaatttaagaatagggcagagaaaagcagtgggtgttgtgggcaagggtaggcagctgaaggcctgggcttgggtcctggctttgccagtgacaaagtactgggtgacttgggctaatgcatgcctttctctgggccccagtgtccattctgcactgtagggtggacagcataatgtcagccttcccagctctgatggcctctgagttggagggctttgtgctccccacatgtacttgggtccggcatgtctgagacacaaagtgagcccgcagtggtgcaactggtgattcagctactgttcttgaatttaatcttttcggactgaattgattgccccattttgcagataagggagttgaggcctaggatttgttgatgtatcccattccctgctctacaagcaacaataataagggccaccatatgtaacacacttactatgtatgttcaccttttgctttcactatctgctttaatcttttaacagatctacgaggggagagatagtgactccattttacagatgaggaaactgaggctcagtttagaaaaatgaaaggacttacgttctcttctttgagtctcacaatagtcctggggttgtcattatgtgacccattttaccagtgaggaaactcaggcctggagacgtgagctcctttgcccaggggtccccagggcccacacacagcctgtcaggttccttcccaggccctcctgctcctccctcctcccttgcttgctctgcctcatggggagcctcttcacctcttgcattcagtgcctgggttaagggatgagaacagttttcttcctgggctataaagtatccctgaaattgactcttcccaagagtgatccagaaaggctttaagccatggagcctcgcagggaactccagtgaaggggtcgcaccagtgggagtggattcgtttattctgctgagctggctaagcaaacagtcctgttattttccaacctcaataagaatatcatcagagccaagcttatttgccaagcaaagtatatatattctacatatgtgagccttcagggtggggcttggcccttaatttccctgctacagagactgtggctgagctgggttttggtgggtactaagtaaatactagttaacttgttgggtgtgtgttgatgatgtgggtggcatatgtacttttttctccccacctccaaggaccttttccccccacccttattatttctattacacttgtgatagaaaatttaggaaataaaaaagtatatatataaaaaagaagtgttcataactaaccagagaaaatcactgccaacacctgggtgcccttccttcctgatattttcagtgcatttttttttacccccacacaattatcctatatttataattgtctgttctgactttctgttttttctcaacattatatcgtaagtatttttctcatgttattaaggattctttttaaatttaatttttaaaagttttaaaagcatactatacctaagtagataaatgtttattctaatttaaatcttttattccaatagtcctagggattaaaaaatgaaataatgctttttatttattaacaaaaaggctgagagaaacaggatttgcccaagatcacccccaaagaaccaagactggggctccccagggctgtagtttgcatccataaatacagagagaataatgtttataatcttgggtataaaaacttctggtgaaaaggttgatcaaatgctagctgtatttctcccccttccatggctttctactgagtctctctctcctacaggaccctactttgctccataattaagcagcaaagtatttcaagagctgttcagattctagaaactcatagcagatgaaatcgacagataagtcagatatcgaatatagacattaaaagatctgggcactaggctgtaccctgttattgtcagtggctctttagtccttaaacaagggtcttgcctcctactttttttttgttatggtagaaataaatgcccacccgagttttcatcactcactattattctatctttggtgtgcctgtaccatgttcccttaacaatcctcaattatgaaacatttaggcagtttataaacaatactgcaatgaacaacctagtgcatactttttttgtgtgttcttcttttattatttcctagaagtgagccctagaaatggagttcctgagtcaaaatgacacattttatagctttttcttgttaaaaaaaaaattcagtgacacttgtgaaaacacggtaaggaagtctttattcaggaacattgccttgggcatagggaccactgcaacagggtcctacagtgagggagagagtttgggctcaactcctaatacagcatgggcgagtgggaattgatagctgcagagcagggtaggggtcagcggatggaaaattactaagaggaagctcaggaataagggatattcttgctaaaccgacctaacaaaattattgatgaagacaaaccagggtgattcaaacatcagtgggggcatggtggaggatgaggagcctgatcagatatcaaggatgaggggttctggctaaacagacttagcaggattcttttgctaaaactggattttacaaggaagtgcacaggtaggcctaggagaaggttcagaagcctggctaaagtttggccaagcaaataatctgtgtcatgctaaattttgccaaatttctgctcataaaggttacagtagtccttattcctaccagccatccgtgagaatggcagcattcttcaggagcatctgaagctggttataaaaagctcagctgtccttttatagaatagagtacagcgaccattttcctgaaacgttacatttcattcattcatttggcaaatacacttgcacaattcagcagcaataaagcataacaagttaagatcccaggccgaagaagtggagagaacttggttctccttctggtttatgttttgcacttgccctaagaccttgaggacatcacctcactgagtttcatttttctcagctatacagttagggcttcaatacccacttcacagaattctacaaagtacctaacacaatgcttggccagtgcaatcatgtggatgctgggaatttgtattatctcatctgactccaaagagccctggaaaggaagcaggtagggacagatccttcccatttcatggactcagagaagaaacggccatgtttcttggtgtcctgagcttcacttcaggaactggtagtccaaaggaactgtatcgttcagaacggaggtaaaacaggcttttgtgggctagcctgtatccatccccctcccacctcccctcccaccacagtacctgtttctcttggaaggcaagttcccagttccagtggcagccagaattctttctatgctcttttagaaggtgggagatgcctgcctagactgttcagtggtcttaaaaaagagaccataaaattcatggttgcataaaatatagttttcatagatttaaattgcattttaaatgcactaaggcttcatctttgagcttttcagaaatgtgggatttcagactccatctttagggttgccttatttagcaaataaaaaacagtgtgccagttaagcatgagtatggcccttggaatgtttggggcataattataccaagacatcttattgtctttctgacatttagatttaactgggcatctcatgttttatctggcaaccctacccaccttgggtctactgaatccaaatctggattttcacaagatccccatggaattcgtgtgcgaattcaagtgtgagaagcattgcattgggagccttgccatcaaagccctgaatgaatcctttttgtaacaaatctgttggtaaaatataatgcactatttataaagagcctgattattcccaaatcaaccatttgcacacatctgtgtgttcatgtgttaggttttcttaatacaggctacccttgcactgttgtcagttgaagggaagaattccttgctttggtaagaagccctagcccctctcaaggacctattttcctcatctgtaaaatgggctacatccttagcatccgtgccagcctgtggtgaccagctgaggtggccccaaggggatgcatggctagagcccacgccaggtccctcctcagcctcctcacaaaggaccgaatgacttggctctgtgatcccatcccccagagactttggtgtgactgtggtgacccttggcatagcgcacccccccgactgcctcctcatctcaaaactttccaaaccatgacttttatagcagggctttaggaatcgcctggctctaccctctcacttcatggctacagatacttgtgccctgagagagcaagtgaatttcccaaagccaacagcaagccctctgattgctgctctaccaaaccaaaatgatttcagttctcatgaaacctaaggcctgactaaggaagattaagaaacctggtggtggtcgggtcctgtagtggggtgggaggaggggggagggatagtattaggagatatacctaatgtaaatgacgagttaatgagtgcagcacaccaacatggcacatgtatacatatgtaacaaacctgcaggttgtgcacatgtaccctagaacttaaagtataataaaaaaaaaagaaagaaagaaacctggtggtggtcatacgcctagtttgtcttggttgtgtggtcttgggtaagtcatttctctctctaacctattccctgcccccacccctccataatatggggaatacacattttcctgttcccctaggtctcctttctacctggttaaggttttattttaagatccagtggtagatcttggtctgtcaattggtcctagagtggaatgctttatgaaatcactggtacatgtgttaggtcagagacttaataccatgacatcatgaaagatgtctttagaccctttctctcctcattgctaacaaagattttatgaactgtgtttcagctggacaaaaaagatgttctagagcattctaagatcgcctggggcttttgttaaaatgcagattctggttccacaagtctggggtggggcctgaggctctgcatttctagtgatgctgatgtagctggtccagggatcacactttcagttgcaagatttgaaaacaatctgttattagtgtagaatcaatacttatgagataagggacttaagaggcaagtcccttgttcagggctaaagacccagtgacagtaatagggtctagcctggagcccagatcttttaatgtcttgtctttgacatctgacttatctgtctattttatctgcagctatgagtttctagaatctgaacagcccttaaaatactttgctgcttaattatgtagcaaagtaggttcttctttaggaaagagagtgactcagtagaaagccattggaagggggagaaatacagctagcatttgatcaaccctttcaccagaagtttttatacttgagattataaacattctttctgtatttatggatgcaaactacagtcctggggaggccccagtctgtttttgtatgcctctgagctaagaatggttttatagttttaaagtgttgttaaaaaacaacaataacaaacaaacaaggaagaatatgcaacagagagggtgtgtagcctatggagcctaaaatatttacggtctggcccttttacagaaaaagtttgctgacccatgatctagagtacccaaagatttgcatgttcttttttttttttttctagtcagcaagaggcccagccttatagctttgaaatatagtgaggtcaagacgtaggggaggcagcctgcgttggtgggaactgcccagacatcttagctgtgtgaccctgagcacattacttcacctctctgagcttgtgtcctagcttcacaaaatgaggacaaagattgctgcctggtagagttattgcaatgatgagacatgcctgtagagtttaacgcttggaaggtgcacagaaaatgataactattgttattaggggtggccatttgaacgcttatggcattaatggacagatatcatgttactcccatcaggtctgaaggccctcccaatgaactgggagcagtcttttaggagagaaaaatactctgctccagtatccccccatcccacctccagagcagaaagctcctttttagccagctagacagacagggttccatggtggcttgcagactttcatcgggcgagctctctccccaaagactggcctttccacagctgagactattagaaggcgtcttctgttcctatgtcctaggatgtgattcagcaaacaggcacgtagtgagagccccaggctgggattgtgagtgctggaatgaaacccttctctttatggctccatctggagtgtgtgggtggtggactagaatcagtggttttgctgaccttgtttttaagctgctgcagccttaaggtccaaaatggaaaacagaccaacttggagttagctggggctaattctaaacctggctgagtttgaaaactcagctcctggggtgtgtctgaatctcagggagagtgtaatgcttttcttgcccatagatggcagcatctgcactctttgccggctctgtgaatgtgtgtgtgcacgtgcacgtatgtgttacacacgtgtgcacgcatgggagtcatagtttcttactttggtaaatcttgagctgcggtggtcccagccctaggccaggctctgggatacatgggagcaattggggaggctgacttgcaaatagactattacagtagagtgtgaccgggcagattagggggtgtggaggtctgtacggagactacacggaggactcaggaacagagtgccattgcatctggctggagcctggtggggtatagtggaagacaggaagccatgagggccaaggctcaaggagttgaaggggacaggtcatgaagaatgtggagagatttgttaaggatcttggactttatctggggccatagtggagccatggtaggtctgggcagaggagtggcatggtctgggcttgctctaaggaggatgcattgtaggagggagaggttgcaggaggatcagttaggaaggttctgcagtcatgcaggcaagaggtgatggggctatggacccagatgttggcattggggtggggagaaggggggacactctggatgcagtcaggggttgaactagcaagacatggtgatacactggaggggagagtgacagagcaaaaggggtgagtggtgtgttgaggagggtgagggcctggtgtctggactggtccaccgggtggatggtggatggtggatggtagtgctgtttgccgagatgaggtgcagtaggggaggagcacattgtacttgggaacaaatgcagcaccaccatgtgcatctgaggatgagagtgcaatttggggtgtgtagaaagaaggggggctggattcgaaaggctcatcctcacacagagttgacagagtgcgggaggtcattagtcatttgcagaaacaacagaacccaactctgctttggtctgtcccttggaaccaggaagtttctgccatagtctttgagaaagacccacagaggtgggcaccaggtcctgcagcccagataagtgtctggcctctgacctctctggttttgggtaccgtgactccacttccgtggctgtgtcccgtgtcagtcacaatgcacaagtcatcaggactgtctgaaccatttactgtcagcctgagaacagggcttgtttgtgtcttaatcccaggagcctgcacggccctgccatcttcgggatcttggactctcccctcggcttagggaagctggtttaggcagagaaattttccagtgtgggcaggagccagtttgctcagcttccctctgaatgtagatgactggaattcttagtggcgaagaacggtgaagatccaagttgtccctgagaggcgggaggactgagctgcatactccacgatgagctgatgtgggatggtccttcatccactcatctagcatatgtccactggcactgccatttgcagggcacatgccatgctgaagctttagaggtgaagcagacagaatccttgcctccaaggagcttacagcctagagggagagaaagtcctatcaccagacactgataatgcagtcttgctcagcagtagtgcattagaacaataatagactgatgctgaggtacagagctgcgaatatgacatatcaacagggtgggtccccaaatcgcacatgtgcaggatgagaaagatacaatttgcaggcaaaagacttagaaatttaattattaataatcagggtaataattagagtaaacacatgccttgtgcaaaaccctgaacatgttttatctcatggtaggttctaatattatccctctttgaacagcaaaggcaactgagactccgagaagtgatgtagcttgctcaagttacacagttaagtgagggcccagtttatataacttcagagtactaacgtacagctctgaagttgactgtaaactgaattcagccatgcaatagggctgccttaaatgcaaatgggattttaggctcaattaatagaagcatgatatctctaatgaaggaggtgagagtcctgcttgccctgtcctggatagagcttgactgattgtctaattctgggtcttgtgctgtcagtagggacaggtttcatctggagcagatcagggaacagggtgagcgaaccggaaaccctggtctcaggaagagctggaggaaagggggtgcacaatttgtagaagacttgaggggcccaggatcactgtcttcaaatctccaaagagccatcaggaaagagggggacagacctgttctggctgacccaaaaggaggcagagctaataccagcaggtacaaggcataagaagagagagattttagtgcatccttaggacaattcttttacgcagccaaaccctccagcagcaggtcttgcagccttggcaggtagtgagtgcggtgttgctggatgtgtgcaagtactgattgtgtgacccctggtggaggggaggaaaggggttgaaacatcaaatggggatttgaccagatgaccttgaactccccctgaggctgacattctgtgccctttgtttacaggtagtgctcatagctctctttgtccagtgcttcggccttggtcccagcgccttcccacggagcagcactcttcaccctgcacagccttgttaggtaggtagagcaatacagacacctgtcgtcctcttaaaccccgccctggctgcccagggaagcctggaggggacttcagtggtggaagcagccgctgtagccacagtggattcagtgggagtccctgaggtcttcctaataaggctcagagtgcgtctctgctcctttcctgtccttgagagggaggtcaggcgagagtgatcttgtagggaggaggccgggactgggctcggtgcccggatgcctggctcccaccctggctgtgctggttgcttgctatgtgactttaggagagttgctttccctctcaaggccttggttgctattctgtagaagagcagagtccccataaagaggaggtgcaggaattcttcccagaggctttggagaggtgagaaaaatgggggtccatttgccaagtctctggacttgttgaccagaggaggagcacctgaggtgtgtgagtcatggggaagcggatgagtcatgcccgctggggccagctggcagggtggggcccacctgactatcagattcacaggtgacctgctgaagtaggtggggaggtggggggaggagtgcagagtcctgggctggaagccaggagactggctcacctcccagcttcagcctcggtttctccacctgtaggatgggtgccttggtctccccctacccacctaacaaagctgctgtgtggacccaacgagcttgtagatgccaaagggctttgtgaccagtgagacaggaaggatcactactagggggaatcgcccagcttccaacacccaaacagaagtgaatttctaatgagcaattgtgcaagaacccaggaaaacacccctccaacccacgccatcccttttctgccaaaaggagaaggggatgaatgaatacaggacttacgcgtctgctgtggcccagctggcttccagatggtgacatgagccacccacagccggagctgttcctctttcccaaagctcaggtgaaagggctttttggtggtccccaggatgttgtgccccaaaagccagggattcccaaaaggtctgccgggcccagaaagctgactcaccccatcagcggctatccaaaggttctgctgacaaagaggtagccctagtgctgccctaataggaggacttgagggccgggtcttggctctgatgcatctgcctttgagactgagccctgataactccaaaagccaagttgcctcaatgtaatctgtcaacaaaaagaatgttatgctctgttgatgcttttggtgactatgacacaggggccctgtcttccgcagaccctgcagggccaggctggcatagacccagctgagcaaccgtcgcctgagagctttgcttattcatccctctttactcctctgccccctgcaatgtaccagccctgtgcccacctccacggaaccttggttcaatcagggaggccccagtgacctcctcgatgtccaatccagtgctctttcctcaggactccatgtgccagtctctagtgcagttccagaaactccctccttttgcttctgggaggctgcactgtctggtttatttcctcttctctttttagttagggccctgtttttcctcctgacttttttagttagggccctggttttttcagttagggcccctcctctctttttagttagggccctgtttttcctcctgtcttttttagttagggccctggttttctttttctttctttctttctttttctttttttttttttttagacggagtcttgctgtggtgcccaggctggagtgcagtggcacgatctcagctcactgcaacctcctcctcccaggtacaagtgattctcctgcctcagcctcttgagtagctgggactacaggcatgtgccaccatacccggctaatgtttgtgtttttagtagagacagggttttaccatgttggccaggctggtctcaaagtcctgacctcaagtgatctgcctgccttggcctcccaaagtgctgggattacaggtgtgagccatgacgcctggcccagggccctgcttttcctgcctcagtgttccctaggattctgcccaccttcttgtcttgatttatgtatataggttcattcattcattcattcattcattcattcattcatatattcattcatttgagagatatttaggctctgagctgggtgttgaagaatcagcaaaaaacaagactttcccattcctcataggtcttcagtagatcattatttacactgaagattaattcttgctgtgaaggaaacgatcaggttatgggagcgtttgggattgggtgggagtggtgaggtcttatctggacagatcagggaagcctcccctaaaaagtgagacctgaagagggagagggaggtggctgagtgagcagggaatggaggagccccctaggcagagaggcgacctgggtaaggctttagtgagggggagtccttgaggaactgaaagaagtgagggaggctggccagggaggggggcgtggcaagaggagggcctgggggccaggcagcacctaggttatgtgggcccttgagtttggattttatgctagacctctgggaaccattggaagttttaaagcaggagggtgacttgcccagatttcattatcagaacccttgaaagggacagacacaaggaccatcctgataagccatgagggtgcaatttttggttcttccacatcagggtatcctgatgctgtgccttggtacggggcttgtcattgggcagtcctgggaaatgtgcactttcccaggattctctcagctctttgcattttttagtttacccggccagtccttgctaagctgctgcagtggagagggaggtgaagcagacaccaccgggccctctgagatccactctaatccaagacggagacagtggaagttaacgcccagagtgctctgtgataagtgccaaggggctcagggagacaaagagtgcttttccttacttgagagtcaaagaaggctgagaagggggagttgggcattccaggcaagaaggcaccgtaggcacaggcttggccgctggaagagcccactgcgcctgggggctagtgagcaggagtgtgagggttgaggtggggagctggttagagaggttttgaatgctgggtttctatcctctgggtaccagggagccatggacaggtcctcagctgaggagtgacttgatccatgggatttcagaacaattagtccatggcaggcagagcggagggtggatcagaggacagcagcactgggagctggttggagagaatgagtaccattgctgaagccttgtcactccccccaccgcacacacacagcaacatcctcaacgcccctttctgttccatacctctgttcggttatccccgaattggccggccagcctgagctgtccagagccctttcacagcagcactggggtgtgttaaaccctgggctccagaggcaaacaggtctgggcctgaaacatcaccgtagccctgacttgctctgtgcccttggacaagtcccttactcttctcagcctcagtttccacatctgtgaaatgggggtgataatggagttggtgatgattaaacaatggggaaatcaagtccttagcacatgtctggtgtataacgatggctgtgttagctttgtgtccttgttgattgtaatggcccagtccatgttgtaatctgcccctcagggagttcttgtctttggacataaatctgaattctcaactagaaacaagatgtccccagcagccccaaaggaagcctctagtgggacactgaggggattggacatgctgttacccactgggacccggcacagggctgggcacacagaagcctggactgggttttatttgttcctttatccccagcactcagcacaaggctggtacagcatggccaggtggctgggttctcaaaaatactaaacaaaaaaatgaaattaaaaaaaaattattaatcttggacatcatcccccagcacctttattttacagctgaggaatctggggcccagagaggaacagtggctcatccaaggccactcagctcctcagtggcaggccctgaacctgttcatttctccctgctcacatgtttattacaattctaatttttgaaatcctggtaagttaaaaatggcatcatgtcccacctccctaatttacctttggggaaactggggcccagagaatggtagtgactccttcaggtcctcagagagggagaagcaggaaaagggcctcctctccacaaagcatacccccactaatcagcagtaggcaggcaggttcttccccccaaaattgacggccttgtgcttaaggaagcaaagtggagtgtgaacaatagtttcctgaggaagtgttgggttttaattgtgttgaggagaagaaccatttccggaactgtgtgtgcctgtgatgcctgcggagttggcttggcacagctatttccagactaatcctgagtcctatttataggctgagatgattaggttggcctgtgtcaggagaggcccacatagctccccccagcctcgcgatggccgaggaagaagccctcaggggcaattctgacccatgggtgagtagcacgggatctggggtggtccccgaagccagctcagaggagggacgccagggagacccgagggaaagtcccgctcctgactcctagttcaacaccagccaggccccctgcagagatgaaaccagttccaattctattctctccctgcttaaaaatcctcagtgtgtccggtcaggccaggactccgtagcagtcagaccccttctccccgaggtatccactgtctcaaccccagccatgcttctccaaactgtttacgcttccttgtgcaggccacacccccaagcctttgcgtctgttgttcccaccttcccaaaagggaaactccatttatcctccaaggctctgccccaatgcccctcctccgtggctctgttgggccatgggtgctccctcctttgtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccactgtgtacagtaggtattttttaaaggtgtgtagaagtgagagtcagacttcggacttcagagtcagacagccctgaattcctaatggtgtaaccttgggctgaacctctctgagcttttgttcctccgtctataaaaggagacaatgccagccatgggttttggggaggattcaacaagacaatgcttataaagtacttatcatcacaatgggcttctatgagcataggaggtgttatttgcagatggggacgttcattccggggacgtccctatctagggccccacacaagggagtggctgagactccaagtcttggagcctccgactccaccctgtgttctccctcccctccctctcttggccccctgggcctattctcttccccagatcagggaaagctttgtttggcgattgtttttcctaagaagtttcctctgtggggcctctgggtgactcagccctgagtcaccgggaggctgaggacagggggaggagtgggagggaggcggagggaatggagagacgagaagaggaaagggctctaattctagccctggctctcccactgtttgatcaactaggtctgaccaggcccctctcctgcctagcctcagtttccccaaatgtgaaaggaagatgtgggcccagtcctggctgagcctcagaatcagaggttcccgggccccaccctagacctacagactcagaggctaggggtggggcctgggaatctattgtttcctgagctccttgggtgatcctgctgcacacctggtccacagaggtgttagggaactgctcggctcaaactggctcccagctgggcctcagagcagctcggcctctgattgaacttcactgacccacagggagcgcccttctcttgcagaatgctttggcagaatagtacacaggaagcgtgtgggctttttttttcttttttttttaaaaacagctttattgaaatataatttacatgatttattggagtaaatttacatataatttacatacacataattcactcaattcaataatgtttagtacatttacagagttatgcaaccatcatcacaatccagttgagaagattttcatcatccccaaaaggatccctcatgcttgcttacgtccatctctatgcacaccccatagctgaccacgcatctgctttctgtctctttgttgttttattgttgtattttttgtcacccaggctggagtgcagtggcgtgatctctgctcactgcagcctcaacttcctgggctcaagcgatcctcccacctcagcctcccgagtaggtgggaccacaggcacacaccatcatgcctggctaatttttgtattttttgtagagatggggacttgtggtgatgcccaggctgatcttgaactcctgaactcaatggattcctcccgcctcagccttccaaagtgctgggattataggcatgagccacctcacctggcctgctttctgtctctccgaagatccagagctgtgttcattccagctggccctgtgacctcatgcaaattattgcccttccattactcctctgtatgagagggaataatcctaccctccttgtagggggttgtttgaatttcactaatgtgcacagtgtctgacgcacccgaggagctgggcacgtgggaggctggtacgcagggcacaggacataacacagatgcccaggtacggttggcacaggcctagcaaacattttaaagcactcactctgtgccagcttcttagattaagcatcttacatgcattacctactttaatcctcggtgaatgtgagtatcagtttcattttataactgaagaaacgggcactgagacgggaagtcacttttacaggctcacatagatgatagttgatagggctgggagtccatctgagagcctgtcctccctaaacatcatcctgtccccttcctgatgtgaatcaccaagcaagggacaacacaattcatagatccaggacaaggtttatggcacatacttctaaggggtgggacctggtatcatggacacggcattcaagagatagtacatggtatagagtctgtcacaaaacagacatcacatggtgcatgaagcatgacccaggggtaagaggcatgggatgccgctaaagggagacacacaggacaaagcaagaggaacgcagggcctgctacgtggcacagtcacagggtatgtgacactgggcatgacaaactctatgatgcagagacatggtacttaggatttgagacttgagctatggcaactgggcaggctcttggccacagtgggaccctttgtcatcagggatcctccattatgttggtgcctggggccccagcaagcaacagcaggaaccaagttcctcctcctcacaaaggcagtctgttttttttttcttttttttctttttttctccctcctcctccctgtctctttggatgccaaagagtgggaggggcccagcggagtggtggccagagtaaccccccgccatcccatcagctcagacaagggtcaaagcttggggccaagcccacggctcaggaagggtttgccaggcccccagatcccctctctctgagatagctgtgagcaccagtgttggctggggtgaaagccgggtaattttcctctaagctgtcctccctccgctcccctccctgcctgctggtgctggctgtgagcacgtctgcattccagagcttaggagagagagaacctgctgctgttaaggttgaggaagtagattgctaacagctgctgtaggaggggttggatgtgcggaagaggaggccgtggattgcaggctaacatttcttgagcctcttggcacctggcactcactacctcatcttgtctcatttgcataaagccccagtagcccggtgaggagacaggcccagagaggcaaagaacttgcctaaggtcacacagggaggcagagccaaggctagaccttggtctcccggaggcaggcaggtgaggttgtatagaggtgatggcacaggggatgttgttggggggttagtgggcaatgagactgcaagggcttgtgggccccatatcacagaggaccgaactcaggagtcctgacttctttctgtctgcaccgaggtctgcagaagggatgatgcaatctgtatgagtgacaggcccagtgcagagagagtttaagggagtgagggagctgatgttatgatcccagggaaaagatggggacaccaaaccaggacagtggctggagtgtgggggtgagaagtgggtataaagtggagaggagatgagcttggtctctgctctggtctcagcctttatgtactgtcttggtgggatgaccgtggttgggtcctgcctccaagggtatcccagagggttctagaaactcccacatggacaggcacttgaaggatagtgctggtgattgggcaggtgcctggatggaggtgaggcctaaagcacacccggggacagaaggcagcacccacacgggagcccagcttcgtgccagggactgtattttaggtgctggatcttgtttaaatcttccggctggctatgattatcctctaagctggggaaggaagaaaagcattccagtactatacctctgtttgggttaaaggaggggaaagtattttaaataaaacctattagagttaaaaggatgagtagcaataaaaatatctttgaatctctgatggttctattgtagtcaaaagttttagataaattgtgaagaatctctaatcatgctatgtggagtttttctcttttaaaaaatacaagttattgtatatacttaaggtatataacgcgatgttatgaatacatttagatagtaaaaaggttactatagtgcagcaaatgaacatattcatcatctcagctggcacaaaagtaattgcaatttttgccattactttcaatgacgaaaactgcaatacttttgcactgcactaataaaatctgctcatttagcatgaatcccaaaatacagtacaacttattccctatagtcctcatgttgcacattagtgctcttttttatttttaaatttttatttttgttatttttaatatagagagagacagggtctcacgacattgtccaggttggtcttgaactctggggctcaagtgatcctccctcctcagcctcccaaagtgctgggattacaggcacaagctctctacacttgttcattccacgtatctgctaccttgcaccctccatatcctcattcgtggattcaaccaaccacagatcagaaatattaaaaaaaaataaaaattaaaaaaagtaaaaataatacaaattttaaaaacagtgcagtgtaacaactatttacatagtttattgttacatagaaatttacatttacatttttatgtaacaactacagtataacaactatgtaaatagcatttacattgtattaggttttataagtaatctagagagatttaaagtttaatacatgggagaatatatgtaggttgtatgcaaatactgtactatgccattttatatattggtgtacagcatctgcagattttggtatctgagggaggtcctggaaccaactgatcccgcgtggatagggagggacaactattctctgatatgtctccccactggacttttttttttttttttttttgagttggagtcttgctctgtcacccaggctggagtgcagtggcgcgatctcggctcaccgcaacctccatctcgtgggttcaagccattctcctgtctcagcctcctgagtagctgggaccacagatgcccaccaccatgcccggctaattttttgtatttttagtagagatggggtttcaccatgttagccaggctggtctcgaactcctggcctcaagtgatccacctgcctccgtctcccaaagtgctggaattacaggtgtgagccactgcacctggcccccattggactttttctctaactgatttgtacttgtatcaagttctggtgagtccgtgagataatatggccattctatccctgtggacactgaagctcagagaggttgtgtcccttgctcagcatcactcagttgtaagtgctaggactgggatccagagccctcacttttttgtttttggttttttgcttttttgagtcagggtttcactctgtcacccaggctggagtgcagtggcacaatcataacttactgtagcctcgacttcccaggctcaagtgatcctcccacctcagcctccccagtagctagaactactggtgcatgtcatcacgcctggctaattttttaattttgtgtagagacagggtctcactctgtttcccaggctgttctcaaactactgggtttaagctatcctcctgccttgggctcccaaagtgctgggattacaggcatgaaccaccatgcccagccaagagcccttgttcttttgggtgaggcagaacaggcaaagtcagagaggaggggagggggtgtcattaggagtctcatggaggggattgggtagcaaggctggctctgtaggtgttggcttgaggccctctcctgagatgcatccccatccctggtaccagccttgtttggaaccctccctgtctcccttgctttgtatgcaaagacacagaggtagagggctaggtatgaggtaggtatagggcaggtataggggccagtgagctgtatgtgtgtatagggtctggacacatgctgtaggtcatctttggatgttatgcttactgagcacctgctgtgtgccaaacacagtgccagggctccttcagtcctaccagacaccccaccaggttggcatcttcacctcattttacagaggaggaaattgaagtgccgcagaaggtgccactggctcaagttccctggtggtagggatttgggctctgtccagattcatccctgtacattgcctcatattccttaggttggaaggtcacttgtcctcaccctgttggtcatttttggtatctccagcccacagagactccgcaggcactcctggatcccattgtcttttccctcttccccgcacctgcccccttttgtctttctcagggagttctccctgcagagtgcctttgcggggcatggtccacggatccctcacatttatggtctcatttaatcgtctcaactagccttcaagaaaggcactttgaccccgattttccacatccagacaatgggctcacacttcctgccagagcccagcaaggaggaaatcttggccatagttggtatgggaggcttggggacacagaagggctttgtttgaagccagcagcaggagggatgtggcaccatcatctgatgtgctgcatcattcattgtccccatcgggaaggtggttggcctggggaagcttccagcattcctggtagatcccagtgaaggatgaatctgatccctaggcaggcaggaggggaccctggccagatgcacaaacttgtttgctttttgctgtgtgtcttttagcatccttgagtcccagggcctgaagggttcttggacatgggccgattttcctgtcacctatgtcccctcaacctcatcaccactgggcagctcattatctctctggaaaaggggaaggaaaccagcatttgtctttccatttttttttttttaaactgtggaaacatacacacatcataaaatttgccatttaataggccgggcgcggtggttcacacctgtaatcctagcactctgggaggccgaggagggcagatcacttgaggttaggagttcgagaccagcctggccaacgtggtaaaaccccgtctctactaaaaatacaaaaattagccagaaatcacttgaacctgggaggcggaggtggcagtgagccgagatcacgccgctgcactccagcctgggtgacagagcgagaccccatctcaaaaaaaaaaaaaaaaaagaaaggcatttttaaccctatcttacatgtaaggaaattgaggctcagagagatagaaacttatccaagtctctcttttaacaataaaagcagcctcctttatatgtgcttattctgtaccaagcactgtgctaagccccaaatgttctttaccttattaaattcacacaactaccctaggaaaaaagtattataatccccgttttatagatgaggaaacggaggctcagagagccaaaacaacttgctcaaagccacactgctaataagtgatagaccggggacttaaatgcaggcatttctggtgggagctctttccacgatcacataacagaaggttgctctctgtttttctccctcttggaaagtccttcctctgcagagcaggaagctgcctcctgtggcttctcctgctcattctggcttgggttggggcattgtagaccctgccttcccctgcagctctgcagagcctgtgactctccaaagtcttctgctggttccacggtcccagcatctgcagccaggcctccctgtcttgttgtggatttgcgtttgtgcctgggcttcccaggggtgggtggtggggtgctgaaggggctaggacagttatttgcagccctggctactgacccaccacacctctcagggccatttcctccccgagagaaggggagacagactgctgaagtgggtcctagcaagaagggcccagagctcatacccatggccaaatctggctgcttccaggacatggggtcaggaagtagcagggccaggcccctccagatgtccagccctgggtcccagcactaggtggggctggctccggaagctgggaaaggaccatggctttggtccctgagacagttggtctcctggagttggcttcagccaagccccgctggccatctccccaacagctggccactcccaggatggacttggccaaagcagaaggccagccagccccgatggggagcactgctgtgtcatggagacccaggcctcagttctggcctggttgttgagagacctgagttctagatctactctgccaggcacttgtttgactttgtgaccctgaaaagtcaccctcttgttcttggtgtgatcatctacaaaagagaagacagactaatgaacactgctgctaataagtcctgctctgaacaacatactccaacagtctcacttctgttcccccaaaagtcctgcaactgggcatcactgtccctgtttacagatgagtgacctgaggctcagagagggaaggtaacttgctctgccttacacagcccagacctgaactctagcgtctcaccgtgaaatctgtaacgtttctcccgcaccatcacataccgaaggcaggcgtctgtgcagaaaacaggctgctcagaaagaagagtgcttacttttggcgagctcctgtgcgtcacatcctgggcttcctcactgctccatgctctaggtaccattctcccccttttagagatgaggaaactgaggtctggattgcagaagctgagtccagattcgcaaacctgtccacagggcttgccggaacttttccaggccctgttcagttccactgggtttcataactggcttctctgtttactgaccattgtcccaattagcaaaatccctggtcagaagggcgggtgctcctaggaggacccagagaacagcagtgagccaaaaagtaaatagactccaagagagggctttccatgagtggctggctgcctggaaaatcaagaacaacagtgtttggagtgaagagaaaagaacagggtggtgtcttccaggcccagccaaggcctttttgtacactgtggctggggatggaaggggcgggggaggccacctcctctggtctctggtagggggtcccgcagacatacagagaccaaggttacagaggaaaggagggcccagagctggttgtgttgtggaggtcctgggtcaactacaggggagggaggggtcccccagggggacatgggctgtacagcccccatcctgtggcagacacagagaatctgcctactgtgtgcctggagctgggcaggatccaggaatagccgagatcagaggtcaaggagatctccgaggtgcacagaagcagagaccaggacatgctcatgtactgagttggtagcagaagggctgcctccaaatcaaagaaaccatgccagacctgagtgccatgtggctcagagggcaggtgccacagccagtcctgcactaaatggccacagcctggggatcttccaggcctttggcctgggcagtcacatcaggtgtgtgaaaggctagagggctttcccggtgtcacctcctgccctggcctgggaagtgtcgtggggacagctgctccggagactcctggctgccaggcttgacttgggcttgattgatttagcctgttacctggaaagggcactgctgctccctgcccaggtcaggtggtgctaggagctcctgcttggtctccgcagacagagcctgggctctgaagccagtcagacttgtgtttgaatcttggcaacacctctttccagttgagtgacttgaacctccctgagtctcagtttcccaggctgggcccagaggtgaggtggcatgctgctatcagtgactgcagtgcctccttcctcaagtcaggggctgtggactgtctgatccagaacggcctgcagaggtgacctggccgaatgtacccattttacagatggaaccctgaagctcagagacttgtaggtcctggatttggttgtacaaccagtatctggtactgcttgggctaggaaagaggcttcgagtcagagcatcaggccctaccctgtattttgcatatgaagacactgaaacccagaaaggtacagtgacttgcccaaggtcaccaggaagtcagtgtcagagccagccctagcactcgggcctcttcctttccacctaggggtccttctcttgtacctgaattcccccattcccttgaactcatacatcttcttccaggctggaagcagagtaagacaatgttgcccgcatcatggtctccactcatcagtgccctgtagcaagggctccagggtctgtagtgagggctcccagagggcaagggtggggtctgttcaccagctctcctgtgccaagggcctgggctccagagctatatggcaggcaaagctgcaggccctttgtgatcattaacgtggtccctgggttgatggccagtggcctctggggccaaggtcaagccacagcagcccctctattaatcaccaactatgcaggtcagagtcacactgctctggaaggggcccctcagctgggcagttgctggcccaggttcagtctgggggctgggcagctaagaaaatttcttcctacttgtttgaattttccaaattgtctaatgagcaggcatcactataagcatattttaaaagggattgtttctggatttgtgttttataaaagaacaaaactatattggatatacacttgtaaagtttcaaatgctacggcaatgcttttacaattttttcggctagtatattaaggtataatttacatatcatagtgattcacacactaagtatacctatagttctatgaattttagtagatttaattggttatataatcttcaccataatctagtattagaatatttttatcaccccgaaaagttccctcatgccaactgcagtgatctaggcacttcctccagcctcaggcagccacggcaatgtttgaggatgaaattctcctccttcttccctttccagcaaacggccttaacagtttggtgcttaccctctgattttttaagggtatatgcaaaaacaggcaccattgtaaaaaggagaagaggagatatactatagccattgttgtgcaattgctttctgcacttggagatctccctgtgtttattgagtgcctactatatgccaggcacaatcagacgtagctcattcttttttcacagctgcatagtgtctattgtaatggtggctccatcatttatttaaccaggacttttgggtcctttccagttttcttcaaacaatgcttcagtgaacatccttgcacatatatttttgtgtttgttggtaagtaattctgtagaaagtggaactgttgttgcgttgtgtgttttgagtttggataaattttttatctagagaggtgaaactggtttatgcttccattaagagcctatgggagctgtggggttttttataatatcatcctccaaatggctagggggaagggagagctctctgaatttaggccagagctggcccactgcaggctgggcaggcccaggcctggacttggagcccggagaactcaggtatccctctggggccccccacagacaccgagacaaagttcagactcttcagtgtggcacacaggcctcggtgacccctgctgccctctgcagcctcctctgctcttgctccctgtgtttcatactggacccctggtaattcactggatatggttatgtttgcctgccctttgcctatgcgtcccctccccctggaatgtcttttcttcttaatctccgtcctccctgtccttcaaggcctgggtcacaagtccctttctccacgaagccttcttataatctctccagcctgaattgtcttctctgtgttcctttagtcttttatctgaaccatatccccccttaggtgggagcaagttgtgggtgggagagggcaaacttcagcctcattagatagaggctggacttccggaagagctgggaagggggaccatagtttctggggaggggtggagaactcacatttacctagctgctggccaggctattttcatacccacagaccgatttaattctcaactactgtactcatttagtagatgagaagaatgagacattgaaaacatgcacagtggaggtgggaatgaaagccagctctccaactctccagtcctctttcctgtcactgcatcaggctgcagggtgaaggggaggtctgggatacaaagagaacttagaggtggagcagttggattctgtgcagtgctaggagggaggagaggggttggagtaggtgggaagtaggcctccttcagtttggatagcacttcccttaacccaatgactctagtgggagggtggagggatggggatgggaagggagcctgggagtgaggaggaaaggcaaactctgtcttcccccaggggagtcaatgaatagtacctaaaatggaaaccaaacaaaacaacttcaggaagtaacaagggcttgcttagagacatgacggtaaaccctgaaccatcagctaaaagaggtagatagcagtggttgcccctggggagaggtaaatgtgatggagagggaacaactgtgtacaaacatgtgactttacgttttgatcaaaataagacttttaaaaaacaaacactttttaaaaagaaggaaagaaaagtaggaggggctatcccaggagctgagcgttctgccccgcccctctgagtcctgccggcttcacctgcccacgggagccgggtcccctgccctgctgcggcgcatgctgcctggtgggggttctgcccaggcccactacggcctgagttcaaatcccggcagcaccatttacaagctgtgtgcaagttgcttcaccactctgcgctgttcccccctctgtaaaatgggttggccgttgtaccctctctgaaaaggatgtgctgatgcctcggtgaaaagctttcaaaaattgttagttcatgttatttttttgctggaggtgttaggtgcggagaggcgagggggctcgcgtgcgtcgcaggaggctcagctgggctcgccgccgctcgtgcctgcgcccatttagtgtgcacacagctagcgcccgccgtatgtcaggcctggtgctgggtctccgccccggagctggggtgcaggggctgccgcgccctgtcgggtcgatccgggtgggaacccagatgtctccaagatccgagacagatccccgccccgcgccctccctggggggcggtccccggcttgggcgggatgggcgggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctgtctgcagattggggttggataatgagctctcagagggccctttggtttcaagagccattgaagatgctggaaggaagcaagctgaggccctggggacccttagatttactattgccatctgaggggtctacccatcatcccagagcttgtgatcttggagcctggggcaacccctgctacactgtttcctagctggaggtccctggcagagtcccttcatctctctgtgcctcggttatcacatccaattggcaataagaaaagaagggaggctgggcgcggtggctcacgcctgtaatcccaacactttgggaggccaaggcaggtggatcacctgaggtcaggagttccagaccagcctgaccaacatggcgaaaccctgtctgtactaaaaatacaaaattagccaggcatagtatcgcatgcctgtaatcccagctactcaggaggctgaggcaggagaatcgcttgaacccaggaggcagaggttacagtgagtcgagattgcaccattgcactccagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcagagtctggatcaagacagagctcttttcccaagctcctagccaggtggggcagagcaaggccaaactgggagctccaagaggctgcaccctaatatgctggtgacttcctgcaagccacttgacctccttgagcctccctttcctctctggttacctgagagccagttgtacctgccctacagggctgggagaggatttggtgtgggggtggctgggaaatgccttgcgtggggcttggccatctggaagggctatggaaacactgtagttttacaaagctggggttttccttggtcaggatagagaaggggatcacaggctttcacagccaggtgggccttaatgtcagagtccaaatctcattttaccaggggagaaggggaactgagacacagaaagtcttaagcaattggcccagagtcacacagcgaattggtgccagacccaggactagaacccagatgttctgactcttagcattctttccactaaaccaacatacctctaatgaccagggtcctagggtagggtccaagcctgtctgtgctgctgatgtgctgtgtgaccttagagaagtcactgttcctctctggacctcaggatcatctatgtcaatggagtggtgaccttgtctgccctggtgaggcataagagattgaatgatgggaaagtgccagtgagactcagatagcaatgggcagggtgtgtcctgggaactcacagtccagggctgggcagggctgggctggattccctggagccccttgtgcccttgcactgagctcctcctgctgaggtgtccagctctgccttcttcccacagccctttctggggccttgataccttgcagaaggagaggtgagaagtttgggagccagtcccctgagctggagaaggaccaggtctttttgcaacttctggagcaagaaatggaacgaacacttgcccaggaatcacagagattgggattcaggttggaaggctaccttctgtaactgctgtgagactttgggcaagtcttgtatctttgggcgggtgttctcaatcatcctccattcatcattcattcagcaaatatttactgagcctcaataacagcagcaccagctcattgttgctacactatggcagatatggtactgggaatgtaggttatctcgtttcagcctcacaactgtcctgggaggtaagtaattcccattccattttacagatgagactggaggctcagagaggtcacataactatattcaaaccaggattgtgttcccttaactctgccaggccctgtgatgggtgctggggtgcccaagtgaagaaggtgggtccctgcccttgagagtgttctgaggagttggggagactggcaggctcacgaagagttaatccattgcctccaggtggggtgatgtgggatcccagggagtgctcagctctgagaggggttcagggatgagatagatgagtaggtgtttgctaatctatcttgtcctagtcactgtttcttagggcataacctgacagtctaacatggttacaaatatgagagttctcatatacacagaaagggtgattttccaggtcagagaatgttgcagagcaggtcataggctcccggatttttaggaataaacaaggatgataataacccttaccgtgtgttaagccttgactacaagatctcatttaattctcactgtagcctttagggtggatggtaatgctccatttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaaggcgctggctcctggtgtgaatgggaggcccagggctggtcttgtttaccaccttctgtaagtcctcagtctgcccccgcacttggcaggtccagcccaaggttctcgccccggcgccctcatcaattatagatcccggaggagcagggcttgttatgcaagacttgttcctgtgaaagcctcttcctctgagccaattctgtcctcggagtgtgagaaggggcagggaggggacagcaagccactagaaagggctgacatggggcttggccctcttgttctatgacccccaaatccttagatcactgccctgcaagagagttcagaatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaacttcaaaaaacttctttcccctgcccttgtagatccactaatgtcttctaagagcttgctttaatttatttttgttaattaatctttccaattctaattccctagaccagtaaaattagaggagttaattaatcaggcagctcatggctgcaataattcaacatcaagagttatgttataaggccgggtgcggtggctcacacttgtaatcccaacactttgggaggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacatgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaaccctcctgtctttctgcgcttcccctgcctttctgcgcttcccctgcattgccctgacctatgtcctttgcactctgcctggctctccaatcccaggcctcacggccatccagccttcggaccccctcagttgtgactgcagttgtgactgcagctggtcagtccctcaccccagagtcccaactcactccttcctgatgatggaaaaatttactgtcttgcttcccagttttgggcagcaaattcaggagcagaagtcacagtcttaccccttgctccacaccgaggtcagtcatagtgtggccaacccacagctcccttgaaggggccctggaagcagggtggaaagataggttgttagctctgtgagcactggccgccctgctagtcccaagggactcttgaaaggccttagctgagaccaagaagggacaccagggagtcctccagccactggcaacccaaaaacatccattacttgaaagagggctctgaataatggcttgttcctgcctcccatcctggatgactgagtgatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgatcagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatggcaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggagcaagggagatcagtttcttgcacaactccccgactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgcactgtctgcctgggcatggggtcaggacagggaggtggaagacttggtcttccccactccactgctatgggaccttgagcaaagcacccctttggaggggggcctcagctttctcacgtctccagtggatgctcgtgtacttcctttgctttcctgcactaagagcatgcgatcaactccgtacatatctgtgtcacgctcatacatgaggtctctctgagtctcagtgtcctagtctgtaaagtgggaagaagagcagaatggtcgactttgtaggatttctgggagtccacagataaaatggatgtgaaaacagcttagaaaatacttggggaaatactacagaaatggtgtgtatgtggggaggttgggggtgtgggttatagttaatgactttatttatgatttctttcttgtgattttcacaactgaattcaggcttagcttcagctagggaactctcttggctgagctctgggagaaagctcaatcacacttacgttgtgccccaagtattttcagtaaaacaacaaaaaggggatgtcgattttcaccactgccaaagaaaaactactacattatcgattttttttctgattatgaagtaatacatgtttattgtaagaaaaaaaagtattcaaaatataaaaagaaaataaaagtccatgcaatttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtacgccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaatttaagcaaatcctgattgatggacattaggatgttccaccttttccagttgcagacagtccctcttggtgcacttgtgctaagtacagcatagcactagggcaagttcctagacaaggaactgctggtcacaggccgaagaatgagtcagtagttgaaaatactggttctgggccaggcatggtggctcacccctgtaatcccagcactttgagaggccgaggtaggcggatcacctgaggtcaggagttcgagaccagcctggctaacatggtgaaacactgtctctactaaaaatacaaaatattagccaggcgtggtggcgggtgcctctaatcctagctctcctcctaagggaggagaatcacttgaacccgggaggcggaggttgcagtgagctgagatagtgccattgcactccagcctgggcgacaacagtgagactccgtctcaaaaataataataataaataaaataaaaaaagaaaatactggttttggagtcaggagtcagactacctgtgtttgaattccaggtcagctatttctagctgtgcaagttccttaaccactctgtgccttggtttccttgtgaatgagacagggatagtaacagaactatcatatgcaaggattaaaggggttctataattatacaagttatagaaattgcttagaacagtgactggcacagagtagtaagtactcaattcatgtagaataattattatttaaaggactgctacctcacagtcaactgtactctggaacagctcccaaattactgtcatcagggatcttaaatgcctgtttacccagagccttgccaactggatattgttaaacttttgaattttgactcttaagatagaacttttttttgagcttggttgaactttttattttagaataatttttaagtttacagaaaaattgtaaagatagtacaaagagttcctatataccattcactcagcttctccttagcatcttagcataaccaggtacatttgtcaaaactaagaaattaacattgcttcagtaccattaactaaactatagactttagccagatttccccagttttttattctaggttccaatccaggataccagattgcatttagctctttttacttttctttttcttttcttctcttttatttacttatttatttttgagacagagtctggctctgttacccaggctggagtgtagtgacgcaatcatagctcactatagccccgacatcctgggctcaagtgatcctcccacttcagcctcccaagtagctggggccacaagcaagcgccaccacaccttgctactttttgtattttttgtagagatgggatcttgccatgttgcccaggctggtcttgaactcctgggctcaagccatccacccacctgggcctcccagagcgctgggattaaaggtgtgcgacactgtaaccggcctcttctcttttttttgaatagtaaagttgaatacattttcagcaaactatgcagttcccctctgcacccaattccccaaattttatcccgccctcccttcccatgtgcagtttgtgttacccctgcgtgtaggtcagcagatgtggttctgacaaagcagaaaacgaaaaagaacctctaaatgtgtgcgagaggaagcccaggtgttactctacagggccatttgggacagggggtggggcaagatggtggaagtctcagggctgggcggccacagacactcatgtgctggttccttctgcttcgtcccctcaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattattactctctaggccccctgggccctgggccagctgatctggaccttggccttggcagtgagaaggctgggactgaggcccagcactggctggccaggagctccttggcacgggaatgccctcagggtggcagcttctcactcactgagtaacctaggtcaagtaatttaatctctctaagaccctagcttccttatagatactcagaaaaagataacaactttttttattacttaagactattctgtgaattaaataatctatgcatagttctaagcacaaaatacatgctcactaaatggaccacagtagtgttgtgattggtgtcactggccagccccaggctggacaccaggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctgtttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacaggtacgtttagggcgtggggtgggtgtgtccaggcccctccctcactttccccatgcactgcctcttgcttccccaaggaggtttctctctgaggtttgcacaactttggtagctgagattctttggtgttacttagtttttacagccaatgcaccctgtgtatcaggccctgagccaagtgtcttggccccaccttgccccgaggagtgcctggtctgggaggggagttgaccatagccacagacctgtgtgatcagtggaagatgggagggagcacaggggattgtgcagacacaggaagcagtgggggtggttggtcagggcagcctgcacagagatgggaacctttgggttgggtctcagaggaggagtagagctttgctgccggagaggaagagcggagagtgatgggcattccaggagggactcgctatgttcggaaaggagggagctatcccagggggctagtgctgatggcatccccagggaggggccttgaatgccaatttcaagggtgtagacttgatcctctaaccagtgggtgctagtgaggggtttttctttttattaaatcagacatgcaacaggctcagatttatgctttatctttttttttttttttaatagagacagggtctcgctatgttgcccgggctaatttcaaactcctgggctcaagcaatcctcctgcctcggccccccaaagtgttggaattacaggcatgagccactgcgcccggccacctgctttagaaactcactgtgaaaatgggttggaatatgactccaggatatcattagaagaaaaaaatcagttaaaaaataaataaaagaaaaataaaaagaaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgcaatgaaaatatttcgggtggggcggtgtggtaagacccctggcagcctgactgtgagactttgggcaagttacataacctctttgagcttcactttctcacttgtaaagtggggtttcatcccactccatcaccttcaagaatgttcaaaatccagagattctaggattctgtttcccaggacttggacgactccgtgtctccatagctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaaacaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcccatggcctaaccacaacctaccacactgcggtttcctggcttgcctgagctggggggtgggggtgctgcacagcatctgactccagctttgctcctgcagatctggagaatcgaaggttccaacaaggtgcccgtggaccctgccacatatggacagttctatggaggcgacagctacatcattctgtacaactaccgccatggtggccgccaggggcagataatctataactggtgaggttctggggccattggtgtgtgtcgtgggggtactggctgggccctgagcagggctgaagacaaactgagggtgtgagggcctgaggtgggaccaccactccctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttatttattttgagacagagtttttctcttgttgcctaggctggagtgcagtggtgcggtctcgctcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtatttattgagaaatcttattcccacccctgtccctctctaccccattctccagaccccaccccttcttgggtaactgctttactctcttgcatatccttccagtaactcttcgtgaaaaaaaatacatatgcaaataatttatagcctggtccctcccttccttacacaaaaggtagcatactttgtatattgccctgcaccttgcttttctgactccattcttcctagagatcaataatgtcagtacatagagacagagagctttctcattcttttttacagttgcataatagtcctttgggtggctgtactatagtttatttaacaaattccttgatgatgcatacttgggttgattccagtctttctctattacaaacattgctgtgattagtaaccttaaacaaacatcactttgaacatgcagagacatgcctctagagtaagttcccagaagtcagattgctgggtcaaagagtaactgcacttgtcattttggtagatagcccccaatttccctcgatagtgttcgtagcattttacattcccaccaagcaacctgtgagagtccctggttccctatagtcacactcgtggattgtgtggtcaaacttttgggcgtttgccaatcttatggtttataaaatggtgtctcagtgtatttttaacttgtatttctcttactatacagtctaaaactttttgtctgattattgactgttggatttttttttttttttgagacagggtcttgctctgttggccaggctgtagtgcagtggtacgatctctgctcaccacaacctctgccccccggggctcaagcaattatcgtgcctcagcctcctgagtagctgggactacttgccactactcaccaccacacccggctactttttatactttagtatggatggggctttgccatgttgcccaggctggtctcgaactcctctaagcgatctgcctgccccagcctcccaaagtgttgggattataggcatgagccaccacgccaagctggattccttctttttttaaacttattttgaaataatattagacacttgctgaaaagttgcaaaaatagtacagacagttctcatatatccattacccaatggaatattcacctatgttcacatcttacataacccttacataaccatagcacaattaacaaagccaggaagtgaacattgacacaatactacttactaatctataggctttacctaaatttcctcagttttcccattaccgttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagtttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctctaagagcaatcaccatggacctttttggtgaacatctgtgcagacctctctgcacgtgttcatgggaggcttaatcactgacatcttttcccacaaataggctctcgtaacacttgctattctgcgacctgcttttccgcccagagaaatgtcctggccacttttctgcatctcagatttgagtctcagagcatcttctctgtggctgttcagcatgggatgacccagccagtctcctgtgggacacatttagcataaggaaatccatgcgttgcactaagatctctgtaagcgggcaagatgctaggctgagagtggaagtgttggtgtggttcctggctctcgttgttctgaaagagtccccttccctctctatctgtttcattactggtaacagggagatgtgtaggtttctcagactcagggcaagggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccatggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctgtgtcctcaaaataggggtaataacagtaccatcccacaagattgctgtgaggattaagagttaacatttgtaagcatttagaatcatgcctgccatataagaagtgcccccttatacatatgtgttaagtacaaggaggtaaatcctaggtaggatcctattggattagaaaagcccacccctgtcccaggaggggactgttcaactgggacctgatgcacgtgtaggagttgcccaggcagagtgaaggaaagcacattgtgggtaaagggtggtacacatgcaaaggccctgaggtgggagggggcattgggtgttaaagcaaggggaaaatgccatgatttgaggctagagaggtgctcagaggggccagaccaccagaggccatagtgacgatgttgaccttgatgctgagaacaacaggaagttgctgaatgataagtctgaggtgtagggatttctggtttaaaaagtcactctggccaggcgctggagggcagcagagctggtttgtggaaatataggggaagcggacaacaactgtgcttcctccgtcctacggtgggagtgggcagggctctagattggcatcgggggttcgtgccctgacctttgactatgatagactgggtgctgggcactaaatgagatgatgaccatcttagctcagtgcatcctgacaacagccttgggagtagcatccttggctgcatttttcagaggaggaactcaagaggttgagacacgtgcccaagttctcaccatcagggtggagttggggtctaagccctaactcagcggtggtgggtcgtggtgggaagcgactgccatatgcctgacgtacatgtgaggttttcttctggacatagttagccggggccacggtaaggtgccgcacacagggcaggagcagatgtgagggtgtacatcttccctgcctcactcccaccaccaagcccctgactgctgcccgcatctggggtgcactggctctgcaggagggggttttctggatctagaatgctctgttcttaccactccaccagcagtcatgcccaggcctgacgtcagcattctggaagaatgtccaccagcaatccctgtgcttctatttaagggaacatttgcaaacacaggctctcctggttcttggaccaggctgaggatcaggaaggcatgtcgtcatggagatggagagcagcccagcagcagtgccctggggacctcagacaatagcactgtctccacccttcctggaattctggtgtccctgcctgtgtgttgtcgggtcacattccatgccacacacagacacaagcatgatggcttcgtctggagggatgggcccagtgcgacatagaaggactgaagcctgcccccaaggtccctgacttgctctcctgtctccctgccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtaagaagcagctttttgtattttcctgccgtggccacagggttgtctgtcttagactcccccctgtttcaaggatacccagtgtcccttgcacactttgcacagtggacagctcactacctaccattctgtacaatcagcatgccattcctgattacgttccagttgcctactatccctttcacggaggaaggcacagatctggacttgattcccaggatggtctgagcagcctagaggggaatgggactctcacctcctttgttctgggcattcaacttctgttaatgcagccctgatttttagaatcatgttggctagtcacagtgcattagtgactcatgggagtcaaccaaggccatcagggtccaaagtctgtgccctcagctctgatgggctgtgttcctccaagtccccacctgagagctagtcctgctgcggggtctcctgggctgtgaggagggggctgagggctttttgtctggttcctgattaaccaagctgtaccctcccaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccaggtaggagccggggtggggggcctgctgctgtccggatgcagctattaagtttcccccttctttccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatgcctgtataatcccagctactcgggaggctgaggcaggagaatcacttcaacccgagagttggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgccaccagcctgctctgtttccagaatgtgggccgggcagctcttccttctgccagcctgcagtctttatactgttactttgagttcattcccacctgcttgatgcttaacagaaatggtgaagagtgacttggtctaaagcagctctgtccagcagaaccttctatgcagatggacatgttctgtatctgccgagtccaatttgacagccattagtcacatgtggctgttgagcacttgaaatgcgaccagtgggaattagtgggaatgaagaactgaacttttagtcgaatttaattttaatgaatttaaatttaaatggctgcacatggacagagcaggtatagtggaaagagtataggtgttagaatcagacaagatttgtatcctggtcttaacacttaccatctgtgtgaccttgagtgagttgcttaacctctccgagccacaactgcctcattagctgagtggagctaatggtcctcatcccgcaatgctgtcgtcagcctcaagccaatagtggtcctggctgtgtgactactgccaagtctgccctctctgggcctctatttcgtcaccttccaattccctcaggcctcttccctctggatctcctgggatttttaggatggagggaggagagggagagcagttggttgcgcttgggcagggctggtcccagggtccgatgagatgggagagaggggtgatggcgtcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagcttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 35643 - DNA, 21431 bp, Homo sapiens
gccgccgccgccatgaacattttccggctgactggggacctgtcccacctggcggccatcgtcatcctgctgctgaagatctggaagacgcgctcctgcgccggtgagcggcgggggaaggcccggagaggctcgggcgtgggggccgggtctcgccgaggacccgccgacctcggccaccccacggctcgcggggcctgcgccggcccgacacaccccctcggccggcctaacgggtgcccggacccggggggcagcggcctgcgggccctcggggtgggctccgggccgggtgtcgcagcgcgggaccccgctctgcagtcggtccccgcgtgaacttgagctgtcggagcgcacccggctgcgcggggccctgctgtgtctgaaaagttggcgtgggacggggggtccgacaggcgtggcccctctctgggcttgaatgggggcgcttctccggccgggatctcccgtgggggtcccggggttgcaggaaacccgcgaatcaatgggacgggcgggaggaggatgggcaggatcgtggccggctgcgcctgacgtggcagcccagccagctcgggaggtggggcgggcgccgggagaggtcactcggctccccaccctgcccgtgcaagaccgggctctaggtgtggtgtagtggggtcgggtcagacctgtccttaagtgttgtgtgggcatcacccaagcccttgggtccaggatcacaccgctggggaggggcttgccgagaggtcgtcagtgattttcttggcgtaattaatgctgctttgggaaacgatctggtttttaagtgcctccatctaataatgggttctcttaaaactgcggcgcccggggaccgccgaggcctcctatgggctcctgcaattcgttgctccacgtcaccagtgagctggctggttccctgatcaagagtacagatttcatgcaggcactgctaggcggcagtgaaacgagtctttcccagataatagttttggacttttacatttcgttaattttaaaggtataataattgagagtttttaacttatttttttttttttggaggcagggtctcgctctgtcacccaggcttgagtgcagtgtgtgatcactgctcactgcagcctctacctcccctggctcaggtaatcctcctgcctcagactcctgaatagctgggactccatgcgtgcaccaccatgcctggctaacttttttttttttttttttttttgctattttttgtagacacaaggtttcaccatgttgcccaggctttaactttcttaaaaatcccttaaacttatttttgatgctcggcaaaataatttttgttgaactcaagaacttaattttttcagaggcagtaaaagatgatcctgaattatctgggtgcagagactctatttacctgatttatttctaaaaattttggcgtctaaagtcacacttacatctctgaatctgctgtctgcaggcctcgcctgtctccttggaacataactgagatccgggaagtaagcaaaaccaaaaagacctttgaacagttaagatgggtgttacaaagtccatgtgccagtgtgtttgacttggaggttatctctcagttgatacatagttctgagaggttcaactgtatgatttccagtgacagcaaataactgctgcagtttgggtaagtgatgtttaggcacttgctgtatatcaagtagtcagccgagtgctttatatggcttatcccaggtagtcattaaaataaccttaggagggccggccgcgatggctcatgcctgtaatcacagcactttgggaggccgaggcaggtggatcacctgaggtcaggagttcaagaccagcctcaacatggagaaaccccgtctctactaaaaatacaaaattagccgggcgtggtggtgcatgcctgtaatcccagctactcggtaggctgaggcaggagaattgcttgaacctgggaggcggagattgcggtgagctgagatcgcgccattgcactccagcctgggcaacgagagcgaaaccgtctctaaataaataaataaataaataaataaataaataaataaataaataaataaacgaccttaggaggtaggtgctattgttcccattctgtggaggtgggatctgagtcttagggagtggaataaattagtgatagagccaggattgaagcacaattagtaactcaaaggattggatagatgaatgtctaagggagcctaaataaacatttgataccaaaccacgatgtttagatccttttttgttacactcagatgatgttagtttttttgtttgtttgtttgtttgtttgtttaaaacagtgggaccgatgtctcactctgtcccccaggctggagtgcaatggctgtgtcacggctcactacagccccaaactcctgggctcaagcgatcctccctcctcagcctcctgagttgctgggtacaggtgtgagccacagtgcccggcgatgttacttttaatctttagttttgcttcaaaatctttgtgtgagtctcttcattttcttccatatgtttttcagaatcccctcctctggcaaatcattaagccttgaagtgtgctgtctcctaaacttttatccaaactaagatatttgggagaatttagtgcaacttcagaataatgatttttttttctttctttttttttttttttgagatgaacttttgatcttgtgtcccaggctggagcgcaatggtgtgatctcggctcactgcaacctctgcctcccgggttcaagcgattctcctcagcctcctgattagctgggactacaggcgcttgccaccacgctcggctaatttttgtatttttagtagagacagagtttcaccatgttggccaggctggtctcggtctcctgacctcatgatccgcccgcttcggcctcacaaagtgctgggattacaggcgtaagccactgcgcctggccgtttgttttttactattcactgttttcatttgagagattcaggagcatataaggaaaatatgaaatacttcagctaaaatgctaacgaaggaagtgaaatagatgagttaacttcgtgtgtgtgtgtttgccaagtattcccgggacattattaaattgttcttgttctcagacttaggatgatttctgtcctggtttgtgtgttttcctgattttaagtaaatcacccagatcatttattcagaattaaatgctaactttgacaagctgctttatttttccatactaaattataaaagttgtttagagtcttttgaaagagtaagaatttgatatgagtttctcaaatgactggaataggagaaacgtgcatccagattgtgtttctcattttgaaaatactcataccaaggttcatttttaggattttagcactgattttgaaaatgctgttttagtctcggaaccatggtgctttttaccccataaggatcagggatgaggctgactcgtgtggaagctggagattctgtgttcctcataggcagattccagaacagctgcctttaaggaccgttttaaagtgggggcagtgagttgatcatgtttgaggctgcattctcttgtggctgtatctgctgttgtcattacagaagggtgtcaacatggaatgtgagtttctcctattctgaattatcattgcagctcgatccacggtatgctcaagttgtcactttatttttgtcctaaacactgacctacataacctcggaagaacaagcggtggttttagatgaagggcttcctattcaaattttcctgtaggccaatggttattagtgctgtatctactgtagtgctgtgtctattagtagtgtgtattactgtagctagttatcagtagtgtgtatctactgtagctagaggagtctttctgagatccacgaccccgggccttccccctctagtctgtctccttccctccttcccctgttgcttagattgttgttagctgttatgtaggttgtaaacttttcatcctaccaaaccccatactggatcttatggtgtccatacatttcagatatgggacagttgatatttttggagtaatatagtgggtaagatgtggagtactccaagaagcttttgcttcacatatgcagctccctctgtagctgtttggcctgtgctcttttgagtgccagtctctgagtaatcattactctcatttattgaccacccactatgtgcaaggcactggcacacaattcagagcagcagcttgtagctattaaaagtttttgttcttggctgggcgtggtggctcacgcctgtaatcctaggactttgggaggccaaggcgggcggatcttgagggcaggagatccagaccatcctggctaacacggtgaaaccccatctctattaaaaatacaaaaaaattagccgggcatggtggcgggcggctgtagtcccagctacttgggaggctgaggcaggagaatggcatgaacccgagaggtggagcttgcagcgagccgagactgtgcactgcactccaacctgggtgacagagggagactccgtctcaaaaaatcaaacaaacaaacaaaaaaaaagtttttgttcttggccggtcttagtggctcatgcctgtaattccagcactttaggaggccaaggtgggtggatcacttgagcacaggagttcaaaaccagcttgggcagcatggtgaaaccctgtctctaccaaaaatacaaaagttagccagccgtggtggtgcgctgtggtcccagctactcagaaggctgagtggggaggattactggagcccaggaagtcgaggttgcagcgagccgtgatcacaccattgcacttcagcttgggtgacagagtgagactgtctcaaaaacaaaagacaaacaaaagagagaaaagtttctattctcaagaaagctgcaatgtagttgaaatgataggaaaatgtacaaaagatggccgagcacggtggcttacacctgtaattccagcactttgggaggccgaggtaggtggatcacctgagtcaggagttcaagaccagcttggccaatatggtgaaacccatctctactaaaattacaaaaaagttacccgggcgtggtggcaggcacctgtagtcccagccactagggaggctgaggcaggagaattgcttgaacccaggaggcagaggttgcagtgagccgagatcgcaccactgcactccagcctgggcgacaagaatgaaactcttgtctcaaaaaaataaaaataaaaaataaatattaaactttgctgatggacatagaagatgacctgcatgtatgttcatactacggtcctggagagcacccaggaaggctggtgaggaagcaagatgacatctctccaaattgatttcttaattcagaatagtatcaaagctaaagacaataaactgagtgaaataatctgtaatatacctaagtgacaaaaggttaatatctataataaagtactcctacaaataaaaacccagctgaaaaatgggcaaagttggcaattcactgaagaataacgaaagaccaatgaagcatgaaaggatgcttagtcttgctaggagttaggaatttgaatatgaaaatagcagtgcggccaggtgtggtggcagcgctttgggaggtcaaagctaaaggatcacttgaggccaggagcttgagaccagcctgggcaacatagtgaaaccctgtctctacaaaaaaaatgaaaaattagctgggcgtggtggcgtgcacctgtgtcttagctactcaggtggctaaggagggagaatcgcttaagccccaggctgcagcgagctgtgatcatgccattataccctgggttgggcaactgagtgaggttctgtctcaaaaaaaaaaccggggggcgggcaagcaaagaaaaaagaacagcagtacataccactgggtaggaaaatgttggcaaggatgtgaagaaagggtctttgcatttcgtgttagtagatacgtaaattggcatagcctttctaggagaaatttgacaatatcaaattttaaaatgttcatgtcttatttttggtttatgtgttttaatttgcattatttggggttacggattaaaattttttaattgatacattatgattggatctatttatggggtacagtttgatgtttcaatacatgtgtatgttgtatagtctaatctgggtagttatttccgtcacctcatgtgtttatcatttcttcattcgaaaacttctaactattttgtaatatataatacctcattgggaagattgcttgagcctaggaggtcaaggctggaagctatgattgcaccagtctactccagcctgggctacagagagagaccccatctcgaaaacaaaacagaaaacaaaagacatttaacctggcccagtaggataagacaagaatgatgttgtttaatgactgatttccatttaacaagttgtactccttaatatagatgtttggtgtatttggtaaggggatatcagtttcagaaacatttacaaaagtgagtattctgggagatcttattacctggtaaccttagcatgctttgatctcaaagtggagagaagccgactaggagctgctctggtttaatagcaggtattctactcccaacccctccaggagattcttgccccacccccttctgtcttcagctaggattcccattttcctatgaagacaggacagttttgttgttttaaaggaagaagctgctacttcctaatcaggatctcaggctggggaagaacagtgtgggaccacgttagcatccgcagatttccagcaaggctgtcctgcgtggacgctactccatggaccggcttcaaaccacacactgccctgtgcgcacctggggctctctcaccctctagctagtagttaattagggcagagccctatttacagtcacagagacacagtatgacctggacattcttcagaagtgttctcccaaaataccacaaaatgagaatttgaccccatgacatgaagataaaatgaatcccattttcttttgtccatttattcattcagcaaatattttctgagtcctgctgtgtgtcagggcccagtgtcccatgcagggaatacaagatggaataaggcatgaccccagcctttaaagatcttggtactgagtgaggtttttggggagaggagaggcaggaaccacatcatcacagtgtatttttataagtactgtaattggagctagggcagcagctggcatgaagcagttccccttatgtgcttgctgaatgaatcaacagtcctgagggagggtatcttcagagatgacatcccagaggaggtgggatatgagctgggtccccacgggggctggtaaagacaatatgatggtccctggttttcagtataggaatgctgggaatgaggacacaatttcaaatctgcctggcttccaaagttctgttagagtaaaaccctttcccacaaaattcacctacttgtatcctgtatgtttatatttaaaatattggaaagaaccatataggaaataagctggaaattgatttctcaaggcttcaacaaacaccaggtatggtctgactgctccctgttctttcttcttccccctctgaaacctcccggtttcttggttagcagcagccttgtcatttcccctttggaacattggtctctgtaggaagaaatcagttatccgttacggggaaaagactaagagcagattcactgtccgtgtctcctcctttggccctttggtttctattgatggatctggaagggtggcatcaacatttttttccatttctatttagatgtgtatgtgaataggctgagactacagttattcatctgagaaagtaacattcttacattcaggttttcagtttcagcaagctgcaaaatgattgttcataaaatattgaaaaacaacatgtaatacaaatattagccaggtgtggtggtgcacccacctgtagtcccagctactcaggaggctgaggtgggaggatcacctcagcccagggaggtcaaaggtgcagtgggctgtacttgtgccaccgcactccagcctgggcaacagagtgagacccagtctcaaaaaaagaaaagaaaaataatgtgcttttcacgttccagaggagtgttgtgaatgatttgggtgaagtgacttttctgttaaattcatacttactaaaatgtgtagtggtgtgaagtatgcattatagatgagggtgggtgggttctgacatttagtcagccttcagtttctttaatgcatttgctcagtctccagcatctgaaacccatagtttgcgtcctttgtcacataaatatttggccaaatatagatgtcagaaaagctgtgtgcacaccacataaatgtccagccttcctggctgagtgtggctgtgccatgcagtgctctggaggtgggttggtggttggaagtggaaacacagtttcaaggctttaaaaaagacagctgcttttgaagaccagctgtagttgtgggttcataccttcatgttgtcctagcattcaggaacatttttatacaaatacaatggaatttctattttattgtaattaatttattttttgagacagggtcttgctctgtcacccaggctagagtgcagggatgtgaccacagctcactcagcctcagcctcctggagtcacgcaatcctcccacctcaacctcccatgtagctgggaccacaggtgtgtgccaccttgcctggctatcacttttctatttttcgtagagatggagtctggtctcaaactcctgggctcaagcgattctcccgccttagcccccctatatgtggagattataggcatgaccactatgcctaactgagagggaagctttaaaaatcttaacatatccaagtaattgccgctcttagcaaagaagtcaccatgggatgcgatgccattattccagcgggagttcctgcccaactcttacctgagtcggtgcttctcatctactcctcatcccccttaatgacagtagactccatctccgttctcaaaagatttctcaccatggagatactgttttaccatacaaagaagggaccaggcgacatggctcatacctgtaatgccaacgctttgggaagctgggcccaggagttcaagaccagtgtgggcaacatggtgaacaaaaaatttgtttaaaaattagctgggtgtggtagttcacacctctagtcccacctactctggaggccgaggtgggaagattgctgaagcccaggaggtcaaggctacagtgagcttgatcgtgcctctgcactccagcctgggcagcagagggagaccctgtctcaggggaaaacaaaaaagaaaaatctgaatgtaagagacaagttataacactaaatgacagcagaattattgagaaatttgttcctacttaaggtgatatatttgagaagtaaaaggttcgtttgaatgatacacatcctggcataataaagcccctttcctgtggtcgccctttatagtgagacagaaaagcctgttagagcctcccaaaaggagcatgtttgggaatgggaagggatagaaaaactacaactgctcttgttcattcagagccatccctagacctgggccttgaccccacgcacccctccttccctgtctgcactccctgcacagtgtgatccacaggaatcccaaagctcttcaggcccttctaatacttcccttctgtttctctaggtatttctgggaaaagccagcttctgtttgcactggtcttcacaactcgttacctggatctttttacttcatttatttcattgtataacacatctatgaaggtatggtatgccatccacaggaatgtatttcatctacagtgcacaggtctatggacacttaatttatgtcagctgtgtatttttaattaaaatgctccaaaaataatgtcttaatatgctgttcttgactttaaaactttcagaccaccttgtatatataactgggactaaacgagctatcagtaagcatacatttttggtttcaaaacagtagttaattaaaatactttgaagttagaacttttttattttaggttccttaagtatgataaatctaaagctcttgataactctgtaagtaagagcggtaactattatattttcaagccgtgggaaattacagagtccccagagaaatccagcaagttggtacataacaaggaacgaaagcaggactcctagttgcagtgtctcatttcgctgctgtgtgaggaactgtctataggcttctatcttttttctttgccactgagtcagttttacttaaactgttgtgtgtgtgtcatttttattacatttgccgtgcttaaatgatctctataccatcatttacttagtaacgtatttttttaaacctttcaacttgtcctaattattagtatctataacacctttgttgtctttcttatattttttctaattcacattaaaactagtgtataactattaaaatacaaaatgtttgcacaccacctaacactttgtgtagcactggtggcacacaccccacactgggggaagttgtggactacgtgagcttcagttctttcgcacagtgttgaattcatgcttgtgaacacctacagagctgggaactgaggatgcggcagaaaataagcagaagtctctaggctggtgtgggagagtacacagatcatggcagtacaaatgactgcgatttatgatgggtgccacaaaggaaaagtataagagttgcgaacctatggatataaaaaacatgaaacaggcccagtagctcccgcctgtaatcccagcactttgggaggccaaggtgggtggattgcttgagccaaggaatccgagaccagcctgagcaacatagttagacccctgtctctaaaaaaaaaaaaaaaaaaaaaatacaaaaattagccaggcatggtggcatactcctgtagtcccaactactcaggagggtaaggtggtaggatcgcttgagccctggaggttgaagctgcagtgagccgtaattgcaccactgccctccagcctggcagcctgggtgacagagcaggatcctgtctgaaaaaaaaaaaaaaaaaaaagaacaggggctctcaggatatgtaataggagtctgatttctttctttctttccttctttctacaaatactgagcacctgtgcaccaggcactattctaggccatttggttattagcatacccaaggaagtaatatttcaactgaatcctattggtatggcacctaaacaacctccccccaacattttgtgttcaagagcattttcataagcactgttgaaaggagacaaagcagtatgtgagtctggtctttactaaaaagcaaatttgagtcacttataatggattcttcattaccaaatgatgggaacctagtattcaggaaataatgagcttacttaaaaatggttaggtccccacttgtctaggcaagttaaaactgcaggcattagaggtgtgtgagcaagaatcctctctccccctcaggatgcccaggtttcagaggaatccatgcttgcttggttgtagtttctaagcacgatgtcctgaaagtctggcgtgagacccgaggtgctcgtgtctttttactttaacttctgtgtgctggtgagaggagagaagcagctgttcttctccaggtgctgctaaggccttagtggaaataacgcccatcaagtttttattaatgttgagctggccacagtctaggtcctggtgagaggcctctctgctgtgagccttggctagatgcgctgagggggctcagtgcatgtgtagatggatgtgtgtcttgtttatgcatgtagattttgttttgtatttattcacatacatggtgaggagatcgagaccatcctggccaacatggtgaaaccccatctctactaaaaattagctgggtgtggcggcatgcgcctgtaatctcagctactggggaggctgaggcaggagaattgcttgaacccgggaagcggaggttgcagtgagccgagattgctccactgcactccagcctggtgacagagcaaggctccgtttcaaaaaaaaaaaaaaagttaaacttacacttaacatatgacccagcagtcccacccctaagtacatacccaagagaagtgaaaacttacattcacacaaacacttgtacgcaaatgttcacagcagctttatccactgtcctcccaaattagaaaccacctgtccttcaactggtgagtgaataaacaaactggtgcatccatacaatggaccaccaatggacgcagctataaaaaggaacaaattattaacactaggccctcacttaatgtcattggtaggttcttgaagtgaaacaacacacactgcaacttgaagtgaaacaacatacactgaagccagttttaccataggctaattgacatgagtaagagttaagttcctacagcatatttccggtccccaaaacaccaccagacttttaaataaagacccaaaacaggccgggtgctgtggctcacgcctgtaatcccagcactttgggaagccgaggcaggcagatcacctgaggtcaagagttcgagaccagcctgaccaacatggaaaccccgtctctactacaaatataaaaattagctgggcatggtggcaggcgcttgtaatcccagctacttgggaggttgaggcaggagaatcgcttgaacctgggaggcggaggttgcagtgagccgagattgtgccactgcactccagcctgggcgacagagcgagactccatctcaaaaaaaaaaaaaaaaaaaaaaaccgaaacaaatgtgagctatacatttatttatttatttatttatttattttttattttttttgagacagagtcagtctgtcacccaggctggagtgcagtggcgagatctcggcacactgcaagctccgcctcctgggttcacaccattctcctgcctcagcctcctgagtagctggaactataggcacccgccaccacgcccggctaattttttgtattttttttagtagagatagggtttcaccatgttagccaggatggtctcgatctcctgacctcatgatccgcctgcctcggcctcccagagtgctaggattacaggcgtgagccaccatgcccagccaacatgagctatacatttaagaaagattaataaaagcaacataattatttatccagtttttggtgaatccgtgcatgatggtggtcatagtggtggcggattaaatcaagaagtatatgtttacaaacaaaaattataaggagtacctcctactaccataaagttcaaaaacaaacaataacaaatatagcaggctcactgagtgcttttgtactacattgtttattgtggtacatatgtataattattgtatactactttatgaattattttaccatagtttgtattcattttccaacccacttacttcatttcagggtcccaggtggccagagcctatcccagcagctcaggttcaaggcgcgaactttcccccaactgcataggatgccattccatcacagggcgcgctcacccacacccactcacactaggacagttcacacatgccagttcacctaactggcatcgttgagatgtaagaggaaaccagagtatctctggtgggagattctccaagagtatctcttggagaagacccacgtggactcggggagagcatgcaaacgccatggatggcggccccagccgggaaccagtttcttttctcatcagtgttacaaccaaaggatgttattggcagacctgctatacacacaataagtttggttgcctctcagatgcattaggctaactgaaattggacccagaaggcaacatactatgtgactccatttatgtggctttctagaaaaggcaaaactatggacagagaacataagtgtgattgcactgcaggaggtgaaggaagcctgggggagtttgactgcgaagcggcagcatggcagaattttggggatgatggaactattctgtgtcctaattttggtggtggttatgcctcagaactgaacacctccaaaaaagagaattttactatatttaagttttaaaattccaaaaacaaagctaaggaaaaaaatcttgcctttccaaatacatgggtgattaaaaaagctggggggtgctggaacagtggcaaggtattgacacctggtgttttttcttttatttgtaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgaggttagtttaaaaggttacttagggccaggcatggtggctcatgcctgtaatcccagcattttgggaggccgaggcggagttcagcctccactttgggtggatcatgaggtcaggagttcgagaccagcctggccaacatggtgcaacaccgtctctactaaaaatacaaaaaattagctgggtgtggtggcacgcacctgtaatctcagttactcagaaggctgaggcaggagaatcacttgaacccaggaggcggaggctgcagtgagccgagatcacgccattgtactccagcctgggtgacagagcaagactgtctcgagggaaaagaaaaaagaggttatggctgggcgtagtggctcacgcctgtaattccagcactttgggaggccaaggtgggcacatcacgaggtcaggagatcgagactatactggctaacatggtgaaaccccgtctgtactaaaaaataaaaaaaattagctgggcatggtggcgggcacctgtagtcccagctactggggaggctgaggcaggagaatggcgtgaacccgggaggtggagcttgcagtgagctgagattgtgccactacactccagcctgggcgagagagtaagactccgtctctcaaaaaaaaaaaagaggttatttaggtctgggcctggtggctcaccacacctgtaatcacagcattttgggaggccgaggtgggcagatcacttgaggtcagaggttcaggcattcagcctggccaacatggtgaaaccctgtctctattagaaatacaaaaactggccatgcgcagtggctcacgcctgtaatcccagcactttgggaggctgaggcaggtgggacacgaagtcaagggattgagaccatccagctaacacggtgaaaccccgtctctactaaaaatacaaaaaactagctgggcgtggtggcgggcgcctgtagtcccagttacttgggaggctgaggcaggagaatggcgtgaacctgggaggcggagcttgcagtgagccaagatcgcgctactgcactccagccttggcgacagagcgagacgctgtctcaaaaaaaaagaagaaagaaaatcaaaaattagctgggtgtggtatcgcacgcctgtaatcccagctactcaggaggctgaggcaggagaaccacttaaacctggaggcggaagttgcagtgagccgagatcgagccactgcactccagccttagcgacagagcaagactccatctaaagaaaaaaagttaatttcatggtcatgtctggttatctagaatggacctatttgcatgtttgcagatcgtgtaggttttcatggagttttttgtttttattttctggtttggcaaactctagtgcaatgttcatgactggtgtaaaaaaatcgtagatgagaattaagcacccacatatttaggtgtctgctgacagtttactgtctgattcatttgaaatagaaacttgaaactgtatttcattatcttgacttcagtggtaccaaacacagagccctgcctgtcccagtgtgggaagaacaaggtctccctcctgtagcccacattttgtttgcttttcatgtacagatgtgcactgatgtcgtgtctgtgaccctgcttagcagcactctgcacctcttgcctttaggaaagctggtttgtggtgcccctagtactgtgcagtgagctgatctgctcctgagtgcctcttctttccctgctgaacaggcaaacggtgctgcttcacatcctggggccgatcaagtcactgtgctaccctgggtgtctgatgggtgctgggagtgcctggacttttctttttttttgagacagagtctcgctgtcacccaggctggagtgcagtggcatgatctcggctcactgcaacctccgcctcctgggttcaagcgattctcctgcctcagcctcccgagtaggtgggattacaggcacccaccatcatgcctggctaatttttgtatttttagtagagaccgggtttcaccatgttttccaggctggtcttgaattcctgatctcaggtgatctgcctgtctcggcttcccaaagtgctgggattacaggcatgagccaccacacccagccatgcctggacttttaaaatactcaaggaccctctgaaagtccttctatcatcatcgtgaataaagtcatacgctgggcagagaatttccataattacagttgtgacttctacccctttgatttaaccacaccagaaagcttaaggaataagaaaaatagtgaaaatatttcagtagtttggcaagatcagtcagtgaggaaaaacagcagtgaggaagtggaaggagcttatcaattatcagtattgtcaatcctggcggaaagcagggttgatttggtatcccagatctggagcaggacaagcttgtccaggagaaacctctgtatgtagattcatagaaaattgaagagggaagaataaacctggagagacaaggtgatgaaaattcaaagaggtagaggtgtccaggttacccagcttgtcacactggcagtgccttgcctcttaaaggttgcttaagtttctgtgatttatgccaggagtcctcaacccctgggccactgactggtactggttcatagcctgttaggaaccaggccacccaggaggagatgagccgtgggtgagcaagtgaagcttcattgtatttatagctgctccccatcactcacattactgcccaagctccacctcctgtcagataactggcagcattcaattctcataggagcatgagccctattgtgaactgtgcatctgagggatctaggttgcatgctccttatgaaaatctaatgcctgatgatctgtcactgtctcccatcacccccagataggaccatctagttgcaggaaaacaagctcagggctcctactgattctgcattatgacgagttgtataattatttcattgtatattatagtaataacagaagtaaagtgcacaatgattgcaatgtgcttgaatcatcccgaaaccatccatccaccctgctggtctgtggaaaaattgtcttctatgaaaccgatcactggtgtcaaaaaggctgggaccactgggttatgcagttgccaagctgttgttctattttgggccgacatgccccactccccactcatcttaggctgctttgtggtaaagaaagcaagagtgtttcctctgagctcctggtgggcagtgggtcgtgatggaagcttgccatttctcttccagatcctctggaccttctccatctacctggagtccgtggctatccttccgcagctatttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaaggtatgttgggtgcgacctgcgttgtttctagagtgacgtgttcttttaggagtgcccttgcccagcactcttctaatctggcactctctcataaactggctccagagaaacactttcatgattggccaataacattctggatcaggatgttgtctttttaaatataagaaccctttttcttttgcaatagcttttcctaaagtgacacattttcactgtaaaagattcatctggtgtttcagtgaacattaacaccagatacctctctatgcatacacagacacatgacttaaactgtacattgctgttctatacactgcttttatcccctcacatttttcatgtcactagaaatctacataattttcagtagccacagagtgtttcattatgtgcatgtaccataatttatttacccagcccccattcatgggtggtcaggccgttactggtttgctgttaaaatccagtcattaaatcagcatccttgtgtatatgtgtttttgcatttgtatgaacataggacgtgtgaactttacaaatatttgatgaaagctatcatccttgttcagaaaaaaaaaaacatttatgccaggtgcagtggctcacgcctgtaatcgagcactttgggaggccgaggcgggcggatcatgaggtcaggagatcgagaccatcctggctaacacgtgaaaccccgtctctactaaaaatacaaaaaacttagccaggcgtggtggtgggcgcctgtagtcccagttactcgggaggctgaggcaggagaatggtgtgaacctgggaggcggagcttgcagtgagcccagatcgcgccactgcactccagcctgggtgacagtgcgagactctctctctcaaaaaaaaaaaaaaaaaagatatttacgcaaatgcacccaaatgcatgtatatagttttgaggggttcaggagcccctgaaacccaaccacagatcccaggctaaaaatccagctatacaataaaattcctaatggtggaattgctaggtaaaaagcatatataggtcgggtgcgatggctcacgcctataatctcagcactttgggaggccgagatgggtggatcgtctgaggtcaggagttcaagactagcctgaccaacatggcgaaaccccatctctactaaaaatacaaaattagccgggtgtggtggcacatggcctgtaatcccagctacttggggggctgaggcaggaaaatctcttgaacccgggaggcagaggttgcagtgagctgatatcacgccattgcactccagcctagggaacaagagcaaaactctgtctcaaaaaaaaaaaaaaaaaagaaaaaaaagagcatatatgtcttatctctttccttttgttttttttgagaccgagtctctctcacccaggctagaatgcagtggcttgctctcagctcactgcaacctctgcctcccaagttcaagcgagtctgctgtctcagcctcccgagtagctgagattacagtcgcgcactaccatgcctggctaattttgttttgttttgttttgttttgagactgagtcttgctctgtcacacaggctggagtgcagtggcgcaatctcggctcactgcaacctccaccttgcagcttcaagtgattctcgtgccttgaccaccctagtaactgggattacaggtgcgcaccaccacgcccggctaatttttgtatttttaatagagacggggtttcaccttgttggccaggctggtcttgaactcccaacctcgtgatccgcacacctcagcctcccaaagtattgggattacaggcgtgagccaccacgcctagcttttttttttttttttttttttttttttttttttttttttttgagacagagttttgctcttgttgcccaggctggagtgcaatggtacaatcttggctcaccgcaacctccacctcctgtgttcaagcgattctcctgcctcagcctcctgagtagctgggattacaggcatgcaccaccacgcccagctaatttttgtatttttagtagagatggagtttctctatgttggtcaggctggtctcgaactcccgacctcaggtgatcctcctgcctcagcctccccaagtgctgggattacaagcatgagccactgtgcccagcctaatttttgtatttttattagagatggtgtttcaccatgttggctaggctggtcttgaactcctgacctcaggagatccgcccacctctgcctcccacagtgccggaagtataggcgtgagctacctcaccctgccatcctttgtgtttttttttttttttatctttttaaagagacagggtctcactctgttactcaggctgcaagaatgcagtggtgtgatccttcctcactgcagtcccaaactcctgggctcaagtgatcctccctgctcatcctcctgagtagctgggactacaggtgcatgccaccacacctggttctttttaaaattttttttttatagagatggggtcgctctcactttttttgcccaggctggtcttgaactcctagcttcaagggatcctcccaccctggcctgccaaagtactgggattacaggcatgagccactgcatccggcctttatgttatagtacccagaatttcataggcctccctacataagctatattttactatatattgattagggtgaaagtcataataacaaaaagccactatgaatttagtggcactttcaatcaaatttgtatttttaaaatacaattgcttatttcctataccttactatgtagaatcttgtgtgtgggagacttctaggaatgggaagaaggaagctaagtttgtcaatatcagtaaccttttgttttcttttcttctctttgaaattctagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattgg

SEQ ID NO: 35644 - DNA, 21431 bp, Homo sapiens; identical to SEQ ID NO: 35643

SEQ ID NO: 35645 - DNA, 5358 bp, Homo sapiens
gggcgccaggacgtgggcgtgcaggacgccagagctgggtcagagctcgagccagcggcgcccggagagattcggagatgcaggcggctcggatggccgcgagcttggggcggcagctgctgaggctcgggggcggaaggtctgtgtgtgacaagagggacggtgggcagcggccctgggcaccgggccggcactgaacccccactccccacagctcgcggctcacggcgctcctggggcagccccggcccggccctgcccggcggccctatgccgggggtgccgctcaggtaagtcaccgcagccttggcaagggggtgtgggagcggcggtccgcttcggcgcccgccatcggcagggatctccctcttggtgccaggtacctgcctactgctcagtcgccgaaagtaggggaaagggcaagccagggtgccctagggcgaaactaggggaaaggtcaccgcttcgcgccgcctccccgcgcggctctcgcctgttctccccttgacacagcggaagtcccttccctgaacttgctaaccgtctcttttcccagctggctctggacaagtcagattcccacccctctgacgctctgaccaggaaaaaaccggccaaggcggtaggtagccccgaggccaggtggaccttagccagacccaaccagagccctgaaatttgcctctctctgcccaggaatctaagtcctttgctgtgggaatgttcaaaggccagctcaccacagatcaggtgttcccatacccgtccggtaagggaagggataatcagagctgggtggggccagggtggtttcccctgccagcctggcctgaccagcctgtcccccaccctctgcagtgctcaacgaagagcagacacagtttcttaaagagctggtggagcctgtgtcccgtttcttcgaggtaaggaatgactcggggcttggtccctggtgaggtgtttggagatgttaagctcaaaaggagcctggatgtgggatcctgtgccttccccaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggtcaggaactgccctaggtcaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacaggggagactgtggccgctttctgtctaaccgagccctcaagcgggtcagatgcagcctccatccgaacctctgctgtgcccagcccctgtggaaaatactataccctcaatggaagcaagctttggatcaggcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgaggtgagggcctcccaagcccctctccctggagccctggggctttcttcccagtcgggtcagactacaacccccagcagcacctggggcagtgggtctccagctttacaccaatgccctaggggatgcggggaggcatagtcagctcagcttctgcgaagagagacagcaatgatgttctgctcaggtgcctgccagcagtaccagaagttaattctacctcatcccttacatccaccccttttaagaaaacaaatacctggaagcacctgatgaactgacccagaacaagtatctgcctgacctgacaagctaggtcagcccttatcttggagatctgggtgatgaggccaagtctgacaaagccctttgcaattttccttcccatgtcccaactatgcaacctcagtccatggcttacatggtgagtgctaacatggaccagggagccacggacttccagatagaggccgccatcagcaaaatctttggctcggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggtacaggacggtcttctgcagagcctcggctgggccaggggtgggtaggcacatctcagcacgggcatataatttgtgtggccctgtgctaggaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccataggacaaaggaaaggagctctctgggcttggcagtgctctaaagaatccctttgggaatgctggcctcctgctaggagaggcaggcaaacagctgaggcggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggtaagtggccaggggtccaggagagcctgcatcagggactgcagccgatggcccctctgagccccgcactgtccccatctcttaaggcagtacgggctctggagcagtttgccactgtggtggaggccaagctgataaaacacaagaaggggattgtcagtaagtgagctctacaccattccgcccctccctttcctctccttgagactaatgcccccacccccacccccaccccacctaccggacagatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggtgagactcggggctgccaagctcaggtgagggctggaggtgcaggcccaacccctccttccctctccccaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtc

SEQ ID NO: 35646 - DNA, 30437 bp, Homo sapiens
acgagacgaagacggaaccggagccggttgcgggcagtggacgcggttctgccgagagccggtgagccggctagcgggcccggggggtgcggctgggggggcggccgcgtgggccaaggccgggcgtgcgcgggcaggccctacgggcagcgccagggccgttccacacggcggtgctgttcgagccgggtgggggaagggcggggccgtcacccggcgcgcgcgggctgggcctgggggcgcgcgctgcgctctgctcagggggcggggtctcgggccggaagtgggctgctgctacgcggggtgggggtttctgggccgccgctgaggtgtggtccctgcgctgcagcgactggaggtcccagggtggttgggccctgggagggtgtgggcgaggtgggccgtcctgggagctctggggacgcacattgtgggaggccgtgttgcctgagggccgagagatcgggtggtggagtcagacctgggttgggttccgtgcggtgtgaccttggacaggtgctttaaccgctgtggatctcagcttcctcatctgtaaaacggggacagtaatactacccacattaaactcttagcgcgatgtatggcagaaagtaagccagctcttggactccctcctttcttcagtgtgtgtttattgaatgcccactaggtgttgggcaccgtgctaaaccctggctgttttcccgggaacaaagatttgctctccaggaatccacattatgatgagcaggaggacagtataacgggatggtatcaacagtgctagttcagtccctacttcacagttgccctcggatgctgcagggcagagcttgacctctgccccattttggggatgaggatcctggggcccattgagggaggttatgctaggccgggcatccgcttctccgatggcatgtctctaacagtagtaatgataatagcagctctttgttagttgggcacttgttttgtgtcaagcactgttaagtgctccatgtggctttgtgtcttttaatactaacactgtctttaagagagattctcttcttccttttttttttttttttgagacagagttttattctgttgcccaggcgtgcagtggcaccatcgctcactgcaacctccgcctcccgggttcaagcgattctcgtgcctcagcctcccgagtagtcgggattacaggcgcgcgccaccaagcccggctaattgttgtattttttagtagagacgaggtttcgccatgttggccaggctgttgtcgaactcctgacctcaagtgatctgtccgcctcggcctccaaagtgttgggattacaggtgtgagccaccgcgcctggcaagagagattactttcattttacaaataaggggtctgagactctgagaggcggagtgtcttatgcagcccagcaagtggctgaacccccacctgggacttcagtgtctaggctcttaacctctttattacactttctccctgaggtccagagctacacatccagatgtgccctttgtggtggtgcgtcaaagtgcctagcacagtttttggcacagagggaagcttaggacgtgatgtgccttttgcttaagtgttttcatgtagatttttgtttaatccttaccaccactttgtgcagagatactgttttacccattttacaggatgagccatttgtgatgcaggaagattaagtgacttgcccacggtcacataggtcctttctggtggcacctccttcccccactttacatagggcttattgtggtgccttgaaagtaatagagtgctttagagccagcgttgaatttgtataggtttgggatcttgctaggagagctgctgaaggaagagagattcctgggtaggtttgagggagctttttcatggtggtggtggaaacctggatcaggaagccttgtaagggtgagatttgtgtggtagtcatgggtcttccatggctgccaatgatggaattgtgaaggaagggtgagctggagctctgttttgattgtcaggaggagccaattaattgattgagtcggtggatgttcattgtacatccacagggtgcctaatccatgtatttagtggctgcagcgtttgtggagcacgtgggaccaggtattaatgtactgctaatgaaagttttaaattatatgatgatgaaaggccattaatgttttttgagctggggtgtggtcaggagacacacatggctttaccagctgcttagattttatagcagcatgatgcacacgatacagtatatataggaatgtcgccataatagattacaattgctcagctgggaccatgtcttttttgtttgaatgtctctggtacctgattttgcgcacagtattttgttcattcaaggattttaaacaagggaggcacttgctgtgatttgtgattcaggaaattctctctggtttgctgtgtaagaacagattgacacagacaaatttgaagactgttgcagtgcatctccgtgcaagatggtgctggcaggtctcaggcgcactgtttttggcattggagataggaggatgagtgagacaaggtccctaccctacatcttgtttgttaaatacctcttaaatttgatgccatgccaaatattttatgtaccttatctaatttaaacccttctatgacccttttcagataggtggctttaacttgtaagggaactgaggtacattgagtttaagtaacttgcctaagatcacacaactaatgagtgactgcctcacattcaaacccatgtcctcctggcttgaaatcctcagctgtttgcatcgagtggattgcttcctggcccaaatctggctcgagaatggttcagaaataacgagataatgacaattcattgtgggacttcctatcataaaggtttgaatgaattgctctggaaacatagggattaatttcccagtggagtcagtaactaaattgtgttggtgtcttgcataacatggttttatcagctgatttggggagtgtaacagtgttgatgatttgctttctgacaagtttatatagacacatttttctctctttgacgctgttctgccaacctgaaaataagtagtgagtgcttgctatgtgcaagatactatgaggtgcctgggagatgtgagggcacgcagacctggcaagttattgacctctacagacctcagtcaccccataaaaaggggactggatgggtggatttgcctcttctggctgtcacattctgtggcttggtgagtcaggaggcttgcagcagcttagtgcaggagactgatgtggaaagaccaactctagtcactaggtggagggaacgaagtaccgtaagagagcaaggggctgggatctcaggattgttccagattgctctgcatctttcccctgcccctccccactggtaatgttgctgtcttatgaaatgaagaaaattgttaagtgtctaggtcactatgaagtctctggtatttcatagtgtgtcctcatggtgactgctcagggatttgatttagatctggattagcctgcctttatcttgagtcttccctccctactgtctgttctctactagtagtcaatgtgatctttttcaaactgtaatgagagcaagattctaccgcacttaaaacctgaaagtgcctgggtgtggtggctcatgcctgtaatcccagcaccttgggaggctgaggcggaggattgtttgaggctgggccgcaaaatgagacctggtctctacaaaaaattaaaaaattagctgggcttggtggtgaccatctgtagtcccagctacttgggaagatgagtcaagaggatggcttgagcctgggaagtcagggctgcagtgagccgtgattgtggcattgcactccagcctgggtgacagagtgacaccctgcctcaaaaaacaaacccaacagtggatttcttaatagaataaaatcctaactccttctgttcccacctcaggctctgctctccttgctcactgggctggagagccctatctctagagcttcatgtggttgcttctttctctgatccttaagctcaactgttcatctcagagaggcttcctctgaccacattccgtaaaccccgttgcataagtggttggtatgaaatgatgtttgttggtgtatttggtcagtgtcagactttgcaccactagaatgtgaactccctgtggacaggcaccttgtctcttgcttttctgtatcctggtccctagaacagtgcctagcacgcggtagagctagtaaacatttgtagaatgagtgacggttgactacactggtgctcatagacaataacgcccacatttactagcatttgaaaattagactcattgctgtgtgtttattgttttgaatttgaaagcctagcagaaaagggagggaagagaatgtggaggctggggctgggcaggcttgcctgccaaccccagggcctctcttgtcctcacctgtaaaatgagggacatgaagtgaaccttgcagagggctgtcagggttaaacaacaagtgtctgtgaagtatctggcacttaggcccacagatgccctaccattgccaggtagctctgcagagaattaactacaaggattcttcacctgtaaggtcatttgatactgcctttttaatatctaggtattgaaaagctgatttactttttcaattatgaaagaatttatagttttttttttttttttggaaataggatctcactgcctcaacctcttggactcaggcgctcctcccacgtcagcctcccaaagtgctggtattacaggcatgtgccagtgtgcctggcctaggtatagtctttaaggaaaatttgggaagtagtgaaaactataaataggaattaataaaaacccatcgggccaggcgtggtggctcacgcctgtaatcccagcactttgggaggcctaggtgggtggatcacctgaggtcaggagttctagaccagcctggctaacatgctgaaatcctgtctctactaaaaatacaaaaattagccaggcatggtggcatgcgcctgtaatcccaggtacttgagaagctgaggcaggaaaatcacttgaacctgggaggcggaggttgcagtgagttgagatcgtgccattgcactccagtctgggcaccagagcaagactgtctcaaaaaaaaaaaaaaaagaaagaaacaaacaaacaaaaaaccattatctgaagaaaattgtaacattttgatatctttatgggtaactttgggctgatgttttctaaacagaaagcattctcgtttatgcatctgcctcccatcataaaagcacttactcatccctttatttagtgcctcttatagtttagaattgtatattaatcacattaaaatggggcctcaattttagtctggctggtgttgggcagttcatttcaggtcatgtttgtatgtggaaatccagattctgtggctggaatcttagtgtctctcgtttggcctcatggggaagaaggtgaggcttaaaaagtcaatgtacctaggctgggcgcagtggctcacacctgtaatcccagaactttgggaggccaaggtgagtggatcacctgaggccagtagttcaagaccagcctggccaacatggtgaaaccccatctctactaaaaatacaaaaattagctgggtgtggtggtacacgcctgtaatcccagctactcgggaggctgaggcaggagaattacttgaacttgggaggttgcagttgagtcgaggtcgtgccactgcactccagcctgggcgacagagtgagactctgtctcaaaataaaataaaataaaataaaataaaattgagtgttcctacaggtttgcttttggtgactctctaggaaacacttgaccttacttgcatgcctaatgtaacacaggcccttctcttttcttcccatgctttagaagatggcagtgaacgtatactcaacgtcagtgaccagtgataacctaagtcgacatgacatgctggcctggatcaatgagtctctgcagttgaatctgacaaagatcgaacagttgtgctcaggtaagagaaatctgctggatcatttttctaggaaagcctgtaggtttttcaggaatgtgaaggcctgtatctgactgcaaagccacacacagaggttcagggtctttgttagggccaccctgtttcttcctctcagccctgcctttgcttctgcttccaaaggaacttttttttttttttttttttttgacagagtctcgctctgttgcccaggctggagtgcagtggcgcgatctcggctcacttcaagctccgcttcccgggttcacaccattctcctgcctcagtctcctgagtagctgggactacaggcgcctgccaccacgcctggctaatttttttgtattttttttagtggagatggggtttcaccgtgttagccaggatggtcttgatctcctgacctcatgatctgcctgcctcggtctcccaacgtgctgagattacaggtgtgagccaccacgcccggcctttttttttttttttttttttttttgagatggggtctggcgctattgcccaggctggagtgcagtggtgcagtcttggctcactgcaaccttcgcctcccgggttcaagcgattctcctactttagcctccaaagtacctgggactacaggcgtgcatcaccacacctggctaatttttttgtatttttagtggagacggggtttcaccatgaggtcgaactcgtgacctcaaatgatctgcctgcctcagcctcccaaagtgctgggattacaggcatgagccaccatgcctggttggaactatacttaaataaagagtgtgctctggcctgcaggtccaccatcttctgctctagagactgcattctgaggcctgaagctcagccccgacttcttggtgtctattattgtgcatccagattgcatgttttatttgaggacagtaattgtattaactactgtctgctgttctagttttatgttcatcagtggcatttcttattcccaagaagtacaagatcaaagtctagcaaatatcatttcagccacaattttatggaactactgtttaacaataatttggcaaagatgtaatgatttaaagtctcggtgtggtggctcacgcctataatcccagcactttgggaggctgaggcaggcagatcacctgaggtcaggagttcaagaccagcttggccgacatggtgaaaccccgtctctactaaaagtacaaaaaaattagccgggggtggtggcaggcgcctgtaatcccagctgctctggaggctgaggcaggagaaacgcttgagcccgggaggtggaggttacagtgagccaagatcgcaccactgcactccagcctgggtgataagagcgagactccgtctcaaaaaaatgaaaaataagtagtgatttaaaagaagaacaaaaacatggtctctttctatgtatgctaatcgtatgacgtgggaaactagaaagaagaaaacaaaaaaatgccttataattccactattcaagccggctactgttcactcactaatcatgagccactgtgcctgccctggatcgatcttaaattactgccattgcttggccgggtgtggtggctcgtgcctgtaatctcagcactttgggaggccgaggcgggtggatcatgaggtcaggagtttgagaccagcctggccaacatagtgaagccccgtctctgctaaaaatacaaaaaattagccaggcttggtggcacgcacctgtagtccagctacccgggaggctgaggcaggagaatcgcttgaacctgggaggtggaggttgcagtgagccgagatcatgccactgcactccagcctgggtgacagagcgaggctctgtctcaaaaaaaaaaaaaatttattgccgttgcttataggattttttcttttttttttttgagttcagcttctgcccttccttattttatagctgggtcctagtctcggtcttagtttcattgacttgtcttgttatttccttggtgaggtgtatttaatcttggttttacggatggtcagatggaggctacgtgtgaagctgtacagtaacacagtggtgcccaagagttgtgtttattcagcattaattactttgctgatcatagacaacaggctgttagccttagatctgtgctgtgtcccccccaccattttctattagtttcctcattattcatttccctatccccatttgtgtgaggcttttaaagcacttgtttgacctgtgttctgtgactaatgtgaggatgaggtcatcctagttttcactggagccagctttttaccagcaattccctctaaaatttacctttttctgtaaatatattccaaagtctatttcacttagttaattggaaaatgtgatctttaatgtttagataagttgtatatgtgctgatcgggctctaggtttatctcattcaggcagagagctgttgtagacaggactgggcataaagaggcttcagtctgctctgagccatgtgacttttgacaagacccttaatgtcttagttcttcatctgtgaactggggcagcgatacctggcccacttgttggccagtgtgagaatcacctataataacagctttcagataactgactgtgtgccagaccctggaaatgagtgcaggtcatttgatgggggcacatcctccttttacagatgaggagactaaccctggggcacagcttatgtattacagaacctggttttgaaccagatctttctgagcacacagcccacatgcatcctgctgcatacttgttatatcttttatagaaacatttggaggggattaaacaaatgtaaattacaaatgtaaattacatatagttaattatagtgatactgtttcactataaagtctgtgaggtttgtcagttgttttttttttctttttgagactggaggctggagtgcagtggcgtgatctcggctcactgcaacctccgcctcccaggttcaagcgattctcctgcctcagactcctgaggagctgggattacaggtgcgtgccacctgtaatttttgtatttttactagagacggggtttcaccgtggtggtcaggctggtcttgaactcctgaccttgtgatccgcccacctcggcctcccaaagtgctaggattacaggtgtgagccaccgcgcctgggtggtatgtcagttttgtctcatgtctgctacttttcccaaataaagtgctttttctccctagaaaagggtaagtgcaggacacttaactgtgatttgtaaacaaacttgttcattcataactagtcttcttgaaagccgtataagatgtctcttggagtatgtagatggttgcattgtgtttcacattggtgtttagaaaatgaggtcttgcttccagtatgagagcagacaggatgagacacagacattgtctctctgaagaaggcccgctgccaggggtttggagtcagagaaagtgaggctcctcaactccttgtgcttactgaggcccaaggagaattccaggagcttttgatgctggtgccagatccttcctaacctcatctctgatgagcagaggatctagcagaccagagttctccactaaacacagctttacaaagtaggaatacatttcttccttgagagggcaaagtgctgaggtcctttgttaatctgcctgctgcctgtgaagtggccaaattttgtcagcagtgggctctcctacccccaacagtgagctgagcctttgcttggctctggtagagggagattaggcaaggataactttcagtgaaagatttggcaggttgtttcaagattcattaatacattctgtagtctccgtagtttggagagctagtcatcaagtattttggaaagatagtcatcatgaggaaaaacctggtcaaagagaatgatttttatgagagcttttttttgtcagaaagggagtactggttgcttttgtgaattgttcctgtgttgcattccatattcaggcccctctgcattttctcaagagcacagcttggtcctctgcacatgtagaggggtctcactgaatgtattcggctctccccttctcctccttgtcttctccctccagcctggcttcctttatgggttccttcgcagcaaaggtgttgatgttcccaggcaaatggtagattcctttctcctcagcttaatgtggggccccgacagcccttgagttcatgtaagacagcttggcgatcttgcttctgctgcactgctaatgacatggtcctcctgctctgggagtgtgttatcacacctgtaaccaggcctctcccagctcagatctggtctgatatttctgtttatgggatacttttgccctacctgtcattacttaaaatctcagctttgttttctcctcaggctagctcccttttccaggtactccatttggggccatgattccatctttcttccagtgtcccaggcctgagaagcatcttttgaggctaattcacagttttatttgtcttctgaaagagcttctagatccagccccttctcagattgctcactgctgctgcagtggcctcctgactgaacactaagttccctctaagttcccagcccccaccttcccttttgttatattgcataagtctgcagcctttctgagggactggttttatcaagtcacatttctgatcaaggaagtatctcttcaaactttttttttttttttgaggcggagtctcgctctgttgcccaggctggagatctccgctcactgcaagctccacctcccaggttctcaccattctctgcctcagcctcccaagtagctgggactacaggcgcccgccaccacacccggctaatttttttgtatttttagtagagacggggtttcaccgtgtttgccaggatggtctcgatctcctgacctcgtgatccgcctgcgtcggcctcccaaagtgctgggattacaggtgtgagccaccgcgcccagcctcttcaaacatttttgcctaagtcttcaagcacctccttgatttttcccttgctttacataaagcaaaccaaaacagaagataggaagctcattttcttctgattatgaatagttaggtcttcattaaaaaaaattaaaggccaggtgtggtagttcatgcctgtaatccagcactttgggaggccgaagtgagaggatcacctgagcccaggaatttgagatcagcctgggcaacatgacaaaaccttgtctctaaaaaagaaaaagaaacatgaagagaatcatactcgcataaaagtctatcaggaggactggatgccaatatttatgtaattgattctttctctttttagaaatagggaaataaataagaatgtttctttcttttttttttattcctgtacaattttggtaaccagtttcatgcataagttgttgactttttttttttttaactcctgtgcaattttggtaaccagtttcattcataagtcattgtctcttttttgttgttttttttttgagacggagtcttgctctgtctcccaggctggagtgcaatgaatggtgcgatctcagctcactgcaaccatcgcctctcgggttaaagcgattctcctgcctcgggttcccaagcagctgggactacaggcatacgccaccacgcctggccaatttttttgtatttttaatagagacgggatttcatcatgttggtcaggctggtctcgatctcctgacttcaggtgatctgcccgccttggccttccaaagtgttgggattacaggtgtgagccaccgcgcttggccaatttttcttttttttaattgtgtaaaatagtactgggtaaaataccactgtggatatagttgctgaatagattgtcttctatttgggtttttaaaaaaagttcgtccgtttcaaaaaaaaaaaaaaaaacaaaagaatgccctcagtgtacttttgttggatgagtaaataaatcagtcacctcagaaatcaaggccttaaccttctgaagatcctttcttaattaagaatgtcaccctggtcactgaagtgcccctgctctcgtttatgttgactttccaaaaataacggtaaccgaacatgctggaaccagcagagaactggttcggcctgacctcaagtaagttgaatatgcattttatggcagtcttgaattctgcagattacttattacttaaccactggtttagcttcccaagcttgttcctttggcaaattagccctggaagggcagtaaagtacacagtgaagcctgctgtgaattaggagagttcagtttgtcggcattagagaaataatcttcctggaaagtttaagcagtaataaaacactttttggaaaaaaaaaatgggcaagtgggggaaggaatgaaatgggatgaaatattgcaataatttattacagtagtctcttttttttttttttttttgagacgaggtctctctctgtcccccaggctggagtgcagtgatgtgatcatggctcactgcagtccttgacctcttgggctcaagtgatcctccttcttcagcctcctgagtaactggaaccacaagggcatgccaacacgccaagctaattttggtattttttgtagagacagggtttcaccatgttgcccaggctgttctcgaactgctggactcaagtgatccacctgcttccctaagtgttgagattacaggcgtgagctacggtgcctggccttatcatagtagtctttatttatttatttttgagccagagtttcgcttttttttttttttttttttttttgagacagtgcagtggcctgagagaatcgcttgaactcaggaagtagaggttgcggtgagccgagatcacgccactgcactccagcttggcaacagagcgagactctgtctcaaaaaaaataaataaataaaaaattaatagaggaacacaaaaatgtcttctattcaactttgttaattaaatgacgggttggctgggtgctctacaaaaagaataaaaaactagttgggcgttggtggcacgtgcctatagtcccgctactccagaggctgaggtgggaggatcacttgagcctgggaggcagaagttgcagtgagctgagattgtgccactgcactccagcctgggcgacagtgagaccctgtttcgaaaagaaaagaaaagaaatgataggttaaatgtatttagagatgtaaaaagcccagggagacagacgtcttagggaaaaaaatgttttttaatctagatcaaggatggatcttggaaattgcctcctgaagaggagggtatatctttgtgaaaaatcagaaaatgtcacttttgttattttcttttctgtattttaggcattcatttttgtttctagtggtcattttattgtcatgatgattaccaataaagaacaggagttttaaaattttgtagaaacactccttttctccttgttataggcttctgggttgcaagtatgttgtagaatatatggggtgaaaaccacagtcttgttacaggttttagaaattgacttcacatgaagttagtgaagcttttggtttttgtaggtctacttcacaattttaaaaattgtatttggtttaagtgggtctgggaagaagttcaccctgcttctttaattgtatttttctgttgccgttgttctttcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaagtaagtaaacgttatcttttattgtggttaatgttccttaatgatcgttactaaggaggtagatgctagcttatgactttggacattttcttttttttcttaatttatctagttaacttttctcagttaacacagaatttactgggagcagtttgcccctaccttcttgcccctattccccttgcttgtttctttcttcatcgtctgtgaagttagtaactgtttagaggagtcagcctgtaaatttgtacagtgatttttatttttaaaaaattcctgtgtaatctctagtagtctggaatctaactctcttaatctggatttacttctgtaaaagcatactgtatgtagaatagttccagtagagaagattctaggccaggcgtggtggctcacacccgtaatcccagcactttggaggctgaggtggagaagattctagaaatacttgctttttatagaaggttacaaggaggctccgtggtgggtgctggaaaactcctttctgcccccaaaggtttttgaaggtaacagaaacatggtccaccaggcatggtttagcacaaacatttaatgtttagcacaaatattacctctgttttagtagataatagattaagtagtttatcccttcccccacccttgtgaagggtttatccttttaagccatttttggggggataactttttttttttatggcaaaggtagtaacacccccaattatcttgctggtgtctggtttttatttattttgaaatcagggtttttttttaattttagttttgtctctacaatatataaaataggcatttatagtataagaatatcacttaactttccaggcatagtttaaatagagttcatatacagtaattttgcattcattattatggaattttattttttgaatatggaaaatgtctaaagtatataaaagtaataatagtgtataaacaataaatagtaaatagtgtaatgatccctcatgtaactcaatggttagcatggccaattttgttttatatctaattctatcctatcctatgtattctgggttattgaagtgagtacagaggtaatatttgtgaatgtttcagtatcaagcaaagtaacttttaaaaattatatttgtcagaggggtggatatattattggatatattctttttataatacattgcaactggaatctttggagattaaaagatagttaaaagccaggcatggtggctcatgcctgtagtcctagctactctggaggttgaggcaggagcatcatttgaactcaggagtttgaggcagcagtgagctatgattgcagcataagactccagcctgggcaacagagcaagaccccatctctaaaaaagattaaaaagttaagttgtggccaacacttcagtgatttgaatacttgaaaacacagtattcttgtataatagaaatacttacagggtccttatgtatatttgttattttttgtgtgtgtgtttttattggtgttttttttttttttttgagatgaggtcttgctgtgttgccagtgctggtctaaattcctggactcaagcagtcctcaagatagctaggattgcaggtgggcagccctgcccccagcaagcatgttttaataggatttggaattacttggaaaacatgtcattttgtaaaaatttatcctgagactgattctgcatcttgatctattttcaggttagaattattcttttttcttttcttttcttttctttctttttttttgagacagagtctcactctgttgcccaggctggagtgcagtggtgcaatctcagctcactgcaacctccacctcccgggttcaagtgattctcgtgcctcagcctcctgagtagctgggattacagacgcccgccaccacacccggctaatttttgtatttttagtagagacagggtttcaccatattggccaggctggtctcgaactcctgacctcaagtgatctacctgccttgacctcccaaagtgttgggattacaggtgtgagccaccacgcccggcccagaattttcttgaacacagttcattgtagatgcctttggttggtttgtgcaatggatttttcttcccttttcttaaatggggtctctctctgtcacccaggctggagtgcagtggcacagtctcgactcactgcaacctctgtctcctgggctcaagcagtccaatctcagcctcccaaggagctgggaccataggcgcatgccaccacacctgcctaatttttttgtatttttggtagagcctaggtgtcaccatgttgcccaggctggtctcaaactcttgcccgccttggcctcccaaagtgctgggtttacaggcatgagccactgtgcctggcctgtgcagtggatttcatgctttgtgataggcattgtggccatgcaagttatatagcggacctactctttatagcataatgcacttttgtatcacgtcttacgatgtgcttggatggatgtgtgtatgtgacttatatggtacttgttccttttttgtttctgattccttttcatacatttgagagagtggggaggggttgggaagtgtaggtactcttgaaggcaaactgcatgaaacttgctttataaatttaggggcttagccctaaggtctctaaaatatttttttctccttttggcagagctttataatgaattgatgcatggactagtttgatgcttgccaaaagcctcttttttggggctaaacagttgtttttctctgcagataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcaggtaaaaaaacaaccccaaaacgtttccaaaaaatagcgttccagatattcattcagcgttcaactagaatttttttcagtagccataggcttagggatcttaagaaatataatcccaggcatgtggccagagtatggattttggcatcaggcagataacggtgtgtgtccttaggtgtctgtagccctgtgtaagcaacttcaactctgccccacagtttcctcctctataaaatgggaattttaatacttgccccagagggtttttgaaacttgaacaagttactgtatgcagttttgccaaagctctagaaatccatcaggctagctcatgtaagagagcattagtttgttccaaaacaagggcatttttacagagccctaggatgggaagttataccagagctgaactccttgaaggaagtgtgtaggtctctcagggactgctcttggctgtctgtgttattctctctgtagaccagcttcctgtgtatactcacagcttccctacctgccctagaactttagctgctaggtgactttggcttgccatggtgctagcagagtcaggggcgggggtaggggagaggctgattttacataccttctcaaaagggtatgggcttggtagctttcccaagatgtgtttacattagtatagaatgtgtatattttggggcagggtagatactctacagatgctaatttcttcttttccagaggatggcaagaatattagttaaggtttcataatacctagagagaggcttgttcatctgatagagagggtaggttgagtgctttctaaatagcttaatggagagacaattcgcatgccatataattatatttttatatttaaagtataaagttaaacggtttttaatatatccaaagaattgtgtaactatcaccacaatcaattttagaacattttcatcactctgaaaagaaaccctgtgctgggcgcagtggctcatgcctgtaaatcccagcgctttgggaggctgaggcaggcagatcacttgaggtcaggagtttgagaccagtctggccaacatggtgaaaacccatctctactgaaatacaaaaattatctgggcatggtggtgcatgcctgtaatcccagctactcaggaggctgaggcaggagaatcgcttgaacccaggaggtggaggttgcagtgagccaagatcgcaccactacactgcagcctgggtgagagagacagacgctgtctcaagaaaaaaaatagaaagaaaccttgtacatagttaatagttgtcacttcccactttccccagctttaccccctccctccagccctaagcaaccacttatctgctttctgtctctggatttgccagttctaaacttttcctatacatggagtcatagagtatgtgatcttttgtgtctggcttcttttgctcagcctgctgttttcaaggttcatccatgccctagcatgtatcagtccttcattcttttttattgtggaataatattccattgcatgcctatacctcatttgattcagcagttcatggtcttttgcgttgtttcccactttatggcagataggaataatgctgctgtgaacgttcatatacggcttctgtgtggacctacaagttttgatttctctcagttacagacccaagagtatatactctgggagcagaattgctaattgctgtgccatgtgttaactctgtatttaaccttttgcagaactacctgttttccaaagtgcctcagctctttacattcccatcagcagggttcccgtttctctagatattgagtactttttattctttacctgtttagaatgggaaactacatagataaccccgtgcatttcatatttcagatgctgctaccagttgagtggagacgtgcattaagcatttagtctttgggataaacgtgctagagagagtcatccagaggaaatgcctattactgtgggtgacaggccttgtgattatagtttggggtgttaggaagatgagatattttcaaacctggcatgtaatatgcaaactttacaaaataattgctaagtaggtgaatcatcagtgatatatataccttgaggtttagcccattcttgattaattttacttgtagataggttggctcctttactccttttttcttgtctttgtctgcttttggctgtaaatactgagagacgtctataaatactagtcagtgtgatgcttttctctcctcactcttctaaactccttctaaaaggtaagcagagatgaagattttaaagcaattcatgggaagagcaggctctcctgctcttatggattccctccctcttccactccaaggagtctgaggtgaggagttaggagggacctaactttccagatggggagcagtgggcacctggcaacagccgagactgtgtgctcatgtctagcgtgaagtttgcctttgctctacgaagctggatttggtttgtagatgtgttaactaaatcttagctgttgtaaccaacatgaaacaacctgtttgtggatttggtcagagctgggttaaggtggatcatctctgtgcaccagaatgactgtacccctttcagatggtagtcctgttcaccgcagtggagaaaagacctcactgaaggacttattcccagcatgaaacatcatgacagaaattggtacttaactctgctgccaggatagaaaccactcagtaggcaaatgtgggagcgttgtcttgcatgcgggggctctctagcattggttcccttcactgaacacctgtgcaaggcagatggtcacagcttctccatgttgtcttgtggattttttgtttgtttgggctggaattactccttttcaaaaacctgtgctctctttttcagctccccagaggcccatctcaacacagagaaccgctgcggctcctaaggctggccctggtgtggtgcgaaagaaccctggtgtgggcaacggagacgacgaggcagctgagttgatgcagcaggtgggcacccctgtgtttagcacgtgagtcacctcgggggataggatccttgcggtggccagggtgccttatccgtgttcttaaatgaacacctgccttgtttgcttgccagagcatgtgacacgtgtgagcctcaggtgctgtgcggggagcatgaacgtggagatgtaagagagagatcaggtgtgcctgggctctcttagtgtggcagaagcctgtgctcggaagccagtgcttagactagaatcctgttgaatgtttctggaatgctgccagggacctgggatttggagaatgaaagataaaggaggtctcctttttgaataatttaataaaaaggattccgcagtctctctgctgagtcctagactggggtcactggagattggaattcagagtggaactggtatgaaaagcctgtggctcttctagttctgttcttagtaattgggtgattcgaaatgtcttcttcaggagtaaatgtccttaaggcacctgtcagaggtctctgtggatcaaaacaagttttagacttttagacattttcccactaatccttgtaattggttggtttgcttgctttcagatgattctttttgttaattctattttttaaattttgttttattaaaaaagtttttttaataaaatagagatagggtctcactatggtgccaaggctggtctctaactcctgagctcaagtgatccccctgcctgagcctcccaaagtgctggagttacaggtgtgagtcaccacgcctggctccattgaaaaaatctgggatgctctgtgattccagtgagtttgggattgcatccttttacttttctaaaagccaagtcctgaaacttgagggaattgatttctaatgcagaacctctcatgacccacactcagacttctaagagatcaggacagtgagaacctgcccaaaaatcacatttcacttttttattttttattttctttttttgagacggagtcttgctgtgtcgcccaggctggagtgcagtggcgtgatctcagctcactgcaacctccgcctcccaggttcaagggattcttccgcctcagcctcccgagtagctgggactacagtcgtgcgccaccacgcctggctgatttttgtatttttagtagagacagggtttcaccatattggccaggctggtctccaactcctgacctcagatgatccacctgccttggcctcccagtgctgggattacaggcatgaaccactgcgcctggcccacatttcactttttcgttctttcatttgtgtgtgccccgtggtcttaggtgccttgggagtgtccaggtgactgggtcaccgtcctcatccttggagtgggtgtggctgacttgagcacccgctggggctgttactttgaagtacagaagcctcggagaacaaggagagacttcctgtaactatttcaagacatggatttcaaacacaggaagcagtttcagaaagaaatacgagagagtaaagagtggttaatgttgaggctgggtagcagcgacttgatctgtgctctccgagagagcgtgccaggttctgcagtgtggctgctctctgctcagctcttttttttttttaattattattattattatactttaagttttagggtacatgtgtacaacgtgcaggttagttacatatgtatacatgtgccatgctggtgcactgcacccactaactcgtcatctagcattaggtatatctcccaatgctatccctcccccctccccccaccgcacaacagtccccagagtgtgatgttccccttcctgtgtccatgtgttctcatccgctcagctcttatcctgggtgatggagcccaggcttggggttccatagattgagggagaagtaggagtgtctctgtcagttaacttctatctggacaagtcagcctctctgaacttactgcctcacgtgtgaagtggggctgacacttgctcacagcagttgagcagattatatgagctgaatgttaagtgcctggaatggtgtttgttgccaataccactgggataaatgtcagtggataaaagactgtgatgattatggttcttgttcatggtcttgatagagtagaataatgttctttaaaagttcacaggaaccagtttttttttttggcttgtgtgaaataatatgcgtaaatggtcataacaaaagtagccaacattttatttatttatttatttatttttatttttatttttttgacacggaatctcactctgtcgcccaggctggagtgcagtggcgcgatctttgctcactgcaagctccgcctcctgggttcacgccattctcctgcttcggcctccccagtagctgggactacaggcacccgccaccacgcctggctaagtttttgtatttttagtagagacgaggtttcaccgtgttagccaggatggtctcgatcttctggccttgtgatccatctgcctcagcctcctaaagtgctagcattacaggcgtgagccacagtgcccagccatagctaacattttaaaagtgcttatgtcatgcacagtgtaagcacttaatttcactttcgcagcaaccctgtgaggttttacacataaggataataaggcttggagaggttaaataacttgagctaggatttgaacccaggtatacctgtctccagaacctagatcagtcagtccctgctgaatggggaattgaggaagaggttatttgatttatctaaggtatacagatgtttcttttccttgcacccacctttggaaactgtaagtactcaccagataatgactctgggcaaattgctgctaagcgttgatgagagtaccaaggcatgggagatctgtcctagacctagacaggtttgatacacttggagaagatggacttggtgcctgcctgtgttcaagtcccagatgagggttacggaaggcaagaaccacaactcttatgggggagagtgtgattggggtctgaggaggcttccttccctgagagggtgaccagaattagctgctttggatggtcggtgttgtagaacttcaacagtcgaggttgggagggattgtggtcttgaagaggcttataactctgttgcatgtccatcggtgctggggaacattgagaggctaagtttgcagaggctgaaggtcactaaccaggtgctttgttgatcctggaaggctgggatcaaatgctcatacccagctggttcaaccctgacatagaagtactgtgtttggcctgcacagagttttatttatttatttatttatttattaaatataaaggatttgtctccaggttgtcaaagtccttcccttacctgttaccacctctcttggctcatttacattatctggcccctcctgaaagtttttgcatttgcagccctttgtaaatatggaaaatggagccacgtgggcttgtcaggctgtgggaaaaacagtgtatctgcacacactaccttgtggtattcgtatccttgggagatctgcaaagattctacattcctaagtcgtcctggagaaatttacttttagttgattttagtccaaagcagtgctgtccaatgaaggtagaaggtgagtcagaagtgtgagctacctgatttacatggtctagtagctacattaaaaagaataaaaagaaataggtaaaattaattttagcaacacatcatctaatatgtaaaaaataatactccagcatataatcaaatataaataatgatcaatgagctgttttacatttgaagactctgctaggtctttgaaatcaggtgtgtatgtgatacttgtagctcatctcagtggcactggccacgtttaagtgtttatatagacacatgtggttgatggctactgtggccagtgcaggcctgaaacactgacttggggcttcttaggttataactattgctttacctcaagataaggttctaagagtgaccttaattactagctacaggttttttttttttttttcttttggagatggagttttgctctgtcacacaggctggagtgcagtggcgtgagctcagctcactgcaacctctgtctctcaggttcaaatgatactcctgccccagcctcccaagtagctaggattataggtgcctgcctccacgcccagctaattcttgtatttttagtagagacagggtttcaccatgttggccaggccggtctcgaactcctgacctcaggtgatctggccgtcttggcctcccaaggtgctgggattacagatgtgagccactgcacctggccaagccacagatttttaataacctcatgaatacagacttgaaaggagtgccacgtgaaagccagtgtcttagtatatatttttttagtgatttagtgtttgttatgtgtgtatagttatgagcaatatcatggacagatgcaacttttggcctttataggtgggacccagaaggctgggtatctggtttggccttgataatttgttggacagagaaggttttaaagggtttgagagggtagcattagtgaaactagtgaaactaggtggataccaagctagcattcctttttttttttttttttttttttttttttttgtggcgtgatctcagctcactgcaacttccgcctcccgggttcaagtgattcccctgcctcaacctcctgagtaggtgggactacaggtgcacaccaccatgcccagctaatttttatatttttatagagacggggattcaccatgttggccaggatggtcttgatctcttgacctcgtgatccgcctgccttggcctcccaaagtgctgggattacaggcgtgagccactgcgcctggccagcattccttttcataagctctttcgacttcctttcttccttggtcattaatgccaccaggcatgtgattagaaggccccttccctgccttttggattgtggagctgtagctctgagtctgcttcccgctggggctggtcggctcttggcctgtgtatcccctgctctttggggctgttggtttcaggaaaggcagcaaactgcagcaaaagcagaggtggggacagtgagggaaaatggatgatttagctttgccggccaccaggcagtagctgtactgtatgtatgtatgtatgtatgtatgtatgtatgtatgtatgtatgaatgaatgaatgaatgattgaatgagacagggtcttgctgtgtctcccagactagagtgtaatggtccattgatagcttactgcagccttgaactcctgggctcagacaatgttcctgcttcagcctcttaagtatctggtactataggcatacaccaccctacctggctaatttttagatttttttgtagagacaggttttgccatgttgcccaggctggtctcaagttcctggcctcaagcgatcctctcaccttgacctcccaaagctttgggattgcagatgtgagccacggcagctggcccctctagtactttattgaaactttcaattattttttatttctgcggctggtaaaggaatagtgaaaggctgtctagaactgtgattctggtttggtctaacaagactttgatgatgaactttgaaattcgttttgataaaattgtcctggtggtgtcacctgatcctcatctctggatgctttttgactgcaggttataaagagggtcctttctcctgggatgagacttgatctcctctgttgtgtttggtgtcttcatcaggctgtggggaagctagataagctgtttatttctgtttttaaatttttattatttattttttaaaaagatggagccttgctatgttgtcacaactggcttttaactcttgggctcaagcaattctcccgactcagcctctagagtagctgagacgcgtgcgccactccacctgacatgcttcagtttttgtggctgtgagttcagaaggctggactagatgatttctctggtcccttctggcttgtagaattcccttctgccgaggtcgttctcagtggctgtacctttgattttgttgctttactttccatgctgctctgtggccctgacctgtaaatacaggtttttgcaacttgcattcattgacagttaaatggaattcacttgtcatagatgtgaatacagtacactggaatgaagatgccccatggttaaagtacacacaggactatgagtgttataacttttattggtcttggctagatagagtcctggcctaaggactgagacagatttcttcatagcctcttaatgggaatcagagaccctcagtggggctcatggagggtcagagcactttccattgggcttccaaagagttccattgagccctttccagggtcctttctattgaccccctcatgcaatcagacctggacttgattgtccagtcccttggtaaggactcagtttatgattgtcagctaccttgctaggctgtaattgtctcaggcttccctagttttttctccttaatcctttttcagtccctgagaagcttctacatgtttcaaggggtagtctgctctttctgggagctgttaccgtcaaggttgctataaacaaatccatgttgtttatctgaggctgaagaaaattgacattaaactgatgtggtttttgtctgtgttggggtttgatcaaagaccacatctccttttgggttagaagtctgcctgatattttattgccatactaatgccaagcatctcaccctttttaatgtcttgtgcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgtatgtgtttgacatgaggatattttctttccattttacatagaagggttggtgaactctgtgctgatgcttgttgtattccagtgttgcattcatcaaaagacttcatctttaacccctcaaagtcagccagagggcatctctgcccagctttagcttctgcctgaggtctgtgagcttttgaagaaggaataggacaaggaggtggctggcttgcccagcatctgtagtatgtggccactgataggtgatgagtgccacaaactgctcttagccagaagcaacccatgtcctcactccaccccacctcctattgcttggatccctcagcttcagttgctgcctccattttatcagggcccggggcatgcccggaaaagcaggcacatgctccctttttcacggcgtgcccacatatcacgtcatgtctgggtatgcctttctcctccctcctaggagtttgcctggttctcactccctcaaagtactctatgatcaagtttctttggatccatgtttattgcacagtcaaatctgttgatattaatcacgacatgttagttgatcagggaagactcatttttttctagatttaggattgttatccggctgtgtccactgtttaatggtgatgtttgtaattctgtgtgcctagcaaggtctgtaggatcaaactacaaacttctggtagtatgtgtagcactatgcaaatacaaggtagtaataatgctgttactgtcactgtccttgagacatatcttgtgaatttcaggggattaagacagatgactgaaaagttgataatctgttgaataaatctttaatttagagcttgctctgtgctatgtaatgaaaaaaagacaacgaagatatagggggtccttggtttagtctgagtattattttagtggagccacatcttaagtaagttcagctatagagatttagttaatagaaataagatggtggttgaaagagaagtctgattttacagcagaatagtatagtaatttcctgctctgagtccatgccagaatgccctgtagtgagaatgaggtgtgtgggagtcatgaatctgctttttccttgtgcactcaatttttctgccactgatgttgggtcagtcttgctgttgtgaatattttgggtaaagcatggctcctaagtataacaaaaggaaggcataaaaggaaagctggctgcatagacagtttattgagagaagatgttagagtactgaactttacaggggacttcaggaatttttgagggaaatttttttttttttttagtgacggggatctcactttattgcccaggctggagtgcctggtggtgcgatcatggctcactgcagctttgacctcctgggtcaagcagtcctgcctcgaccccgctggggagtagctgggactacaggcatgtcccaccaggcttggctagtttttttttttttcgagacattgtctcactgtgttacccaggctggtcttgaacttctgggctcaagccttggccttccaaagtgctaggattacaggcatgagccatcacacctggccttctttcttctttaaaaaacagttttattgaagtataactgacataataaactgcacatatttaaaatgtacctttgatgacatgggtgaaattaccaccataatgaagacaatgtaaatatgcatcactttcaaaagtttgagggtaaatttgactgtgctcagtttttgtctttggtgagatgcaattctactacccaagaaataaaatagcagtcacctggcctgtatagagccaggaagaaccattgtttttaagaggctgtaagtatgaggaaagtgaactcacagtagaaatggatctttcagtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagt

SEQ ID NO: 35647 - DNA, 30437 bp, Homo sapiens; identical to SEQ ID NO: 35646

SEQ ID NO: 35648 - DNA, 4699 bp, Homo sapiens
ccttttccaagcggctgccgaagatggcggaggtgcaggtatgggctccgcgcgggccggggcggcaaggggccgggtgggatccaggccggaatggggtcgcaccctctctgtcttgcatgttttgcggagcttaacatccataatgaagcaaaatggaagtcttttgggataaggggaatctgtaggaaatgccgcggctctctttaggcctagggttggctacaatgtggcatttccttctcgaggcgagggtgatagagcttccagcacaggacaggtattttgcaactagattttgcttaccttgaactcgggtagtgggtgggggccctggggtagagtcttggccgaattggacccttgtgtgtcctcagcgatgaggaacacgcggaagtgtggccgggcggtctcggggcaatgagaaactgagttttggccaaaatggaaggtatttttatcccgctcagtgcgcgggctactttgatttcacgtggaggtgttaatcggggtcccctgcagctccggttcttttaattctcaatgcctttctgcggggggtcgagagctgttggctgcggggcactctggaatgaactcgttttccgtcgttttggggattggcgattgtcctgaggcgtgttactggaagtcgagagctgtgatgaatggttccacaaggatgggacatcttttgggcctgacacctgggggccctttccctggctcctggtgtagctacttaagtataaaggagggattggccctggaaaggtttctttgtgagtagtctgttgttggggcgggtgacatttcagagccaggccgatctaggcaagttgtgttcaccaagcatgtgtctttgtgcctagcacagttcgcaatgttttgcgtagttcagttaaccatattcctgaggcagttactggtatccttgttttacagaggaggaaattaaattggaattggtgattttgggccaaggtcacgacttcaggaagtctgtctggattttagagtctttgtaccaacgcttacaaagcatgtgtaacaaccagtgtgtgcttcatgcttttgcattaaaacaatgaggatttctacttttagtgttttttctgagacggagtctcgctgtgacacccaggctggagtgcaatggtgcgatcttggctcattgcaacctctgcttcccaagttcaagtgattctcctgcctcagcttcccgagtacctgggactgcaggtgcctgccacgacgcttggctaatttttgtgtttttagtagagacagggtttcaccatattggccaggatggtctcgaactcctgacctcaactgatctgcccacctaggcctctcaaagtgctgggattacaggcgtgagcccctgtgcccggccaggatttctactccggaggaagctgaggttcggtgcctgagcagtttaccggggaaagcagagtgctctatagcagagctagcatgggcttttgactactctgcctaatctcatcccacctgaaattcggttttcttccaaattaaatttgtggtagaaacatcctatacattagaagagaattagattgtgttaacatcctacaattgattggccacagtggctcaagcctgtaatccgagcattttggaaggccgaggcacacggttcacttgaagcgaggagtacaagagcagcctaggcaacatggcaaaaccctgactcaacaaaaaaaaaagtacaaaaattagctgcgtgtggtggtgcgcgcctgtagtcccagctactcatgaggctgaggtgggaggatagcttgatcctgggaggtcacaggatcacaggacagcctgtgcaacagcgagaccctgtctcaaaaccaaatcctacagtttattagttacaaggtcttgtaactgggtagtcagtgggcagagccttgctggtcttcgttcaaatccaattgctttgcaaaatacaatctgagcataaaatactcatagaagaactcagatatgaggggagtttgggcctcttaaactgctcactcactgatcctgaggcagccttgctttctcagtccctgttcctcatctgtagaacggggctccgtgcatagttcccagctctgatggctgggtgcaaggcacgctgttggcacggtaggacaaaagaagggaatgcttgcttgtgaggacaatcaaaggctgtccttgtctctgagtccttttgcccttgtctcccacaggtcctggtgcttgatggtcgaggccatctcctgggccgcctggcggccatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagccactcttccccagggttggggactccaggctcaagaagtaattatgtattaggctagtttttcatttaaacaggaacttagctctggcaagtactgcgctgtgtctggagggtgactgcataggcagtggtgggaccctcaggcggctcggccctgctaagcctttccctccctctaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttgggggtgctggtagactgggcaggcctcacactctcccctctccctagtgaagtacctggctttcctccgcaagcggatgaacaccaacccttcccgaggcccctaccacttccgggcccccagccgcatcttctggcggaccgtgcgaggtgagcagagcgtggggactgcaggtggtgacgggcaggcggccggtgatgagaacttctcccactcacattcgagtttcccgaccatgagatgactccacatgcactaccatctgaggccaccccatgggcccacctcagtggggtgggtgggcatccttatgaggccctctgactgggcctgctatctgtcacccaacaggtatgctgccccacaaaaccaagcgaggccaggccgctctggaccgtctcaaggtgtttgacggcatcccaccgccctacgacaaggtgagctatgccaaaccccacaggcagcggccttacctgtggcgtccatgatgttccgcaactacctacattgtttgatcctcatgaaagcagcactggctgagacgccagtccagccgacctccttccctgtctgtccctcccgggctcttaagcccctctctttctctaacagaaaaagcggatggtggttcctgctgccctcaaggtcgtgcgtctgaagcctacaagaaaggtgagtcccagcttacgctgcaccatctacttgggagatttcaggcctgctgagggacctggggacctggagcctggcagatgatgtccttatctcacgatggtctgcggatgtccctgtgggaatggcgacaatgccaatggcttagctgatgccaggaggcttgggtgggtgcttttctaacaggcctgcagagaacagttgcattatgatatgcccagctgtcagtcacctcccagctctcaacagctccggctcttcagggtgtgggggcttagatatccttacaacttcatttgttcaccccccccccccccccccgcagtttgcctatctggggcgcctggctcacgaggttggctggaagtaccaggcagtgacagccaccctggaggagaagaggaaagagaaagccaagatccactaccggaagaagaaacagctcatggtgaggccaggggctggtgctgaggggggcatctcactcctggacaggcctggcaggtgccttgctcacagagtactcttaactggcaaaggaccagccggggttggggtgggatgcagtccatgtaatgagggcaatgcaacccctcctgaccaccaccacctgcacttattcttggcagaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 35649 - DNA, 23476 bp, Homo sapiens
gcgctagcggcggacccggctgggcagttccttccccagaaggagagattcctctgccatggagtcctacgatgtgatcgccaaccagcctgtcgtgatcgacaacgtgagttgcgtctttcctatctataaggggacttgggctctcctcctcgaaaggatcgcttcccggggttcagcctgagccgccggctctttgtcactggcccggcctgtcaggcgcgttcagccaccgccgcctccttcctccccttatcacatagtccgcaggcaaggcggccagccagcaaaagtgggatggagaactctggagtggataaaggaaagagttatagtccaagccagtccttgggcccttggctctaggggccttaaccgctgtgtgagattcccgtcgcccgccctctcccccatttccgatcgctctattggttgctctggctgtccatcttagccaatgataccgcctcttagccttgccggatgaggctaggcctctgcggtgattggctcacgcccctgccattcttccttgccgccatattgttttccctcttgaaggggcggggcagtgctccagggctgtggggattggcttccgggactctgggtggtggggcctagaggcgagtgcccgcccgcgggtggagaacggctaagttttccttcggtctcagccggcgctgcggcttggtggtgtggatctgggtggggcccgagaatctggtgccagaaaccgctgtaggatgtcagctattactgtgattataaattacaaagttggtaaaggtcgagaagaaaggagagtgacaaaggaagcagagaggttgtcctcctctttggaacgcctagttcttacggggaaaaaattaccaaacttaatatttgcctggcgctctagcgcttccagggcgttttcacatacattcgagttggatcctcacaaaaactggacgcatagtttaaaaggaactttgatcttcgtgttaccgatgagaaaactgaagcgcgaagacgtaacgtgagcccaaggtcacatagcagaggtgccctaaatccagtactttatccgtcatcccttttgccagcaccaccatgcagaagcatcaatattgaccaatagaaagaatctaaatactgctcttattttggggggaaaggagaaaattgtaaaacgactgcatttctgccttcgattcaaagctttggtcccacagagattgatccctgtctgtgtcccttgtaggtccctccattgaggcaaaactaccagttccctctgttgtaagctgactctgtcagattccctttgttgattcagctcttgggaccttaggcatattacaatgttctcgtttaagcttcagctctgttaggtagataggaattactatccccagtgtatgcagggatgttaaataacagatttcaaaccatccagtttaggaattgaggagccagtcatcagactaagatccagttccaagttgcttgctttttccaatatatttttgttgttgttttcattaaattttccttctctccatgggtattttgtttttattattcccccttagaaaggggcaggattgagctcaatgagacagctcattttttttttcttttttttttttggagacagggtctcgctctgttgctgagtctgaaatgcagtggcgcgatcacagctcactgcagcctcaacctcctgggctcaagtgatcctcccgcttaagcctcccgagtagctggggctgcaggcacgcgccaccacccctggctaatttttgtattttttgtaggaagggtttcaccatgttgtccaggctggtctcaaactcctgggctgttgcgattctcctaccttggcctcccaaagtgctgggattataggcctgagccaccgtgcctggcagagacgcctctttttttggtgtgggggggtggagggaacaggatctcgctttgtcacccaggctggagtgcaattgtgcgatctcagctcactgcagcctccgcctccaggttcaagagattctccagcctagactcccaagtagctgggattacagatgtgcaccaccacgcctggctaatttttgtttgtttgtttgtttgtttgtttgtttgtttgtttttgagacggagtctcactgtcgcccaggctggagtgcagtggcgcgatctcggctcactgcaagctccgcctcccgggttcacgccattctcctgcctcagcctcccgagtagctgggactacaggcgcccgtcacctcgcccggctaattttttgtatttttagtagagatggggtttcaccgtgttagccaggatggtctcgatctcctgacctcgtgatccgcccacctcggcctcccaaagtgctggtattacaggcgtcagccaccgcgcccggcctaatttttgtatttttagtagagatggggtttcaccatattggccagacttgtcctgaactcctgacctcaaatgatccacccgccttggcctcccaaagtgctgggattacaagcatgagccaccacacccagcccagatacttcatttttgagaggatctttttgtctccctcactagactattaaatccttgtggaaaaagatgatattctcccacaggtttagtggtgttgggaaaaaaaatttaagaaagatgatattcctttagtctcacttcacccacttctctccacacacacacagtatacctagggtctggcacctctgtgtgctcaataaatgttttttcattggattgatgggtgattggatgaatgactgaatatctctatcaaagtaacaaagatattcctaaataaagaaaagatggggagttttctctagttagttactgcagataattgagtaggactttttgttcttgatgttgattttcagagagcactacgatttctgtctttagccaggctctttgtgcttcttctgcctttttcttagttgtaaaaaggaaaaatatatagaaattcaatttcctgttttcatcagcaatgcagaaggaacaacctgtctatcccaccagctcctttgcttcttgaattgctaggcaggagttccatctccggccattttctttaatatcacttacactaatgcgtcttaatttttttctttctctttcctggtagtatgtttcgaaatgcattacagcagtgatgcatttttagtttcaagatttaaagaattgacttgtcttttttttccccctctgggaaaacatgtcctttattatgccagtatttctgccaaaaggtgaagtaggagaaacttaagtcattttcctattagtatttgctgaaaatctgccacatttttacatgtgcggtctcaggtagtccttgttgtttaacatttggggggtcattttgtttttattattttcaagatggtagatgtataggaaacattatttgaaatacctgagacaacttattacatataatgagaataatgtatcactagctatgttaactccatagcttaacatgttgctacactttatttatgggcagaagagtataatcaaaagaatgcaggagaaagaaagcagggaaagagccccattaagttcacagcctttcccaatcataagacaattgtgaccacgtctttcatcttactctggcatcaagtcatttcatcagaatttaatgaggaaaatggaggggcaggtaggtgtgtgctttaatgacaacaataaagtgataggtatttttttaatcacccaagaagctttatgatgatagatattttttaaaaccaaatataagtcatttcttcccaaagacatagagaatagtgtaagataggagcagctcctaggccacattttgaggactacactttgatcagaatactatgtttattctgaaactcaaatttttcctaagatccaggccaaatgtggtggcttactcctgtaattccagcattttggaaagccaaggctggaagatcgtttgagcccaggaattggagaccagcctgggcaacatagtgagacttcatctctactttaaaaaaaaaaaaaaattagccaggcttgcttggtggcatgcacctgtaggaggctgagatgggagaatcacttgagcccaggagtttgaggctgcagtgagatcgtgcacctcactccagcctatttaaaaacaaaaacaaaaaaactctaagtttacagttttgcctgaacctaaaatggatcaacattcctgtcaaacttaaaactgtctttgtgactatatggacctaaatgcaggctcttcagaagttcaacaataagctaagcatttgtttgttttgctttggatgttgtgctgcttcagccccctttaaaaaaaaaaaaagagagagagagatactttaaacacacagaaaaattcggtgtggtatataacaagcacccaggtagcatgtgtctactacccagatttagtaaatattgatgttgccatatttgcttcagtattttttttgctttagtgttcccatccaccttcatgttttaaggaaataaaacattacagatataattgaagactctttgtacccctccacaaccctatcttttttttttttttgagacaaggtctcactctgttgcccaggttggggctcattggcacaatcaaagctcactgcagcctcagcttgccaagcttaagcaatcctcccacctcagcctcccaagtagctgggactacagccgtgtaccacctgctcagcctttttttttttttttgtagaaatggggtctccctgtgttccccaggctgatctagaactcctgggctgaagcagtcctcccacctcagcttcccaaagtgctggtattacaggcatgagccactgtgcctggcaaccctatcctttctctctgttttacaaataatccgcaaaacaaccatcatcataaaattgtcctccttttatactctggaagataagtcaggagaattgtgttgttcaaggccagcctgggcaatacagcaagacccccatctctttaaaaaaaaaaattgtgctcctttccacctatgattttttttaatttttaattattatttgtttttaaattttttttagagatgaggtctcactctatcacccagattagagtgcagtgctgcagtcgtagctcactgcagcctcaaactcctgagctcgagcaaacctcctgcctcagcctcccaagtagctgggagtataggaggagcaagccaccatgcctagatccatccatgattttatgtgcatatgcattttaagtttggcaggggagtgtgctgtttgtgttttgaaagtttacttaagtgctatcatcctactgttatctctttttattatagcaatttcaaacatacaaaggagaaggaatagtgtaaggaacatccatacgttcacctagctgtaacagttatcaaactcttggccaatcttttcaactacattcctgcccatttccctctcccacattcttttttttttttttttttttttcctgagatggagtctgctgtgtggcccaggctggagtgcagtgatgctcactgcaacctccacctccgtggctcaagcgattctcctgcttcagcctcccgagtagttgggactacaggcatgcaccaccatgcccagctaatttttgtatttttagtagagacggggttttgccatgttggccaggctggtctcgaacttctggcctcaaaggatccacccgcctcagcctcccaatgtgctaggattataggcgtgagccaccacgcccagccccacactcatttaaaaacataatcaatatactattatcatgcctaatcaaatcaacaagaaccccttaatcttatcagttatctagtcaatgttcagatttcactaattgtctaaaaaaatttttcttttacaatttgttatcagcttttctgatcctactaatgctgattcacttaagtttttagggacactagaattagctgaggaaatgaagtcaatgtatttatctaacactgtcacttgcagtgtgatattcaggctgttggttgtacagcttcagcaagaatccatccctagcttgacagaaaaggtgaagaagaggtgacttataaagatattttcactgttcaattatgtatattttgcaagccaaggatgtgcttcacactgagctaagtcctctgagggtaaaaaagaaatcagataccatgtggaagaagaaacgtcaccaattagtggctgcaaatgcctagaatagggatttcaaattcaatgcctgcagaggccaagcaggaatggaaatatactcaaaagagaagagagagaatagcctgaaaggcacctcttccaggctgggaaatctgaaaggtgcattgaattgagcatgcctgaccaaaatgttaactgattctcctttctatccaattgtccccatgcaggaataccggcctagtgttgccagatattctgatttttaaaaatttgtgtatttatcgaggtcaggagatcgagaccatcctggctaacatggtgaaaccccgtctttattaaaaatacaaaaaattagccaggcgtggtggcgggcacctgtagtcccagctatgcaggaggctgaggcaggagaatggcatgaacccgggaggcggaacttgcagtgagccgagatctcgccactggactccagcctgggcaacagagcgagactgcgtctcaaacaaaaacaaaataaaataaaaatacaaaaaaattagccaggtgtggtggcaggcgcctgtggtcccagctactcgggaggctgaggcaggagaatggctttggacccgggaggcggagcttgcagtgagccgagatcacgccactgcactccagcctgggcgacagagcaagagtccgtatcaaaaaaaaaaaaaaaaaaaaaaattgtgtatttatttatttatttattttgagacggaggctgtctctgtcgcccaggctaaattgcagtggcgcaatctcggctcactgcaacctcccccttgtgggttcaagagattctcctgcctcagcctcccgagtactgggactataggcacgtgccaccacacccggctaatttttttttttttagatggagtctcgcactgtcgtccaggctggagtgcagtcgcgcaatgtctgctcactacaagctccgcctcctgggttcacgccattctcctgcctcagcctccagagtagctgggactacaggcgcccaccacttcacccggctaattttttgtacttttagtgaagacggggtttcaccgtgttagccaggatggtctcaatctcctgacctcgtgatctgcccgccttggcctcgcaaaatgctgggattacaggtgtgagctactgcgcctggccttattttgaattttttgtatatattttttgaggcagaggctcactctatcgcccagtctggagtgcagtggcaagatcacagctcactgcagccctgacctcttgggctcagcctcccaagtagcaaggactatggacccgcaccaccacacccgagtaatttttaaatattttgtaggcctggtgtggtggcacatgcctgtaatcctagcactttgggaggccaaggcgggtggatcacttgagatcaggagttcgagaccagcctggccaacatggtgaaaccccctctacactaaaaatacaaaaattagccgggcgtggtggcgcacacctgtaacaacaactactcaggagtctgagacaggactatcgcttaaatccaggaggcggaggttacagtgagccgagattgtgccaccgcactctaggtgggtgacagagccagactccatctcaaaaaaattaaaattaaaattaaaattaatattttgtagagacagcgttttgccatgttgcccaggctggtctctcgaactcttggcctcaagcaatcctccctcatctgccttccaaagtgatggggtgacaggcgtgggccaccgcacccagccatactttttgtttgtttggttggttggttggttggttttgagacagggtcttatcttactctgtcatccagcctggagtgcagcagtgcaattacagcttgctgcagccttgacctcccagactcaagtgatcctccaacctcagcctcctgagtagctgggaccacaggcacacaaccaccatgcccagctaatttttgtatttttgtagagacggggtttcgccatgtgcaggctggtctcgacctcccgggctcaggcagtcttcctagctcagcctcccaagtagctaggagtacaggcacacatcaccatgcctggctaactttttggtattttttgtagtgatggggtttctccattttggccaggctggtctcaaactcctggcctcaaagtgatttgcgtgcctcggccttcctaagtgcttggattataggcatgagttaccacacccagccaagactactcaagaagcctctaccaggcattttttcatttggccttgccagagtgaataacaaagacagtggcagcttatttgccaggtacacagttcctagttgtaaatactgttaaagaaatggacataacccttttgtatgctcttgagcagaatttgtgtggcttgagcagaattgaggcagctcagctgctcctcattctccactgattcttcaccctatgactggcatggcaggcctgcttgggggctgcaaggacacgctgggtctggttccaccttgtgcatcactcccagtgctgctttcccctttgctgaaccgcctctgcctggggcttctgtcatttcagctggtcattcaggttccatactttaggttctatctgccagtcatttgcacttgattttaattttactcagccagcatctgttgagtacccagcaaatgccagatactgccaaaatgtattttagccttaaggaacttcaactgaaaagagacgaaagtggaaaccttacattgtaataaaaagcagaatgaagtgcatgccacctcgtggtacaggtaatggaaatttgctgtgagataataggaagatgatcattcattccaactggggatgtttcttcaggaggaaggtgatgatatttgaactgggctttttatactctttgctaggaaggacagagaagaaaaaacaaatctgacttcataatctgcctgtttacccagactctagtccttttgctagtaaactaaaaataaaatacccaggaaaatcatctcttaaaaatatccagggtctgaaggacagatctcatcctctcttgtttttaacctctgccgggagacccaattagtctgttggcatcaccacacccagatgaaggcagtgagcaatcattggaagcctgagcaaacaagttctaggagttccccccttgcctgtccgtgccttgctctcagagcccttgggtttgtaggcaaattgcccctccttcccagtctttcagctcacttgacagctgcaccttttccaggctccttgttgtactgcccagtccaatgagtttgcacattgtcttctgttttcactctcttctgttggcaaagattcctgctcccttagagaactggctgccctgctctcctctcataccactttctctgcccttcaaccacttctttttttttttttttttttttttgaggtggagtctcactctgtctccctggctagagtgcagtggtgcgatcttggctcactgcaacctccacctcctgggttcaagtgattctcctgcctcagcctccctgagtagctgggattacagacgtgtagcacacctggctaatttttgtatttgtagtaaagacagtgttttgccatgttggccaggctggccttgaactccctggcctcatgtgatctgccccgcttcggcctcccacagtgctgggattacaggcgtgagccaccacacctggcttccttcaaccacttgcttcctccaccaacctctgtcttgccaaaggcaagcaccagatggccagtctcactccccctcttcctgcagaagagcaggaataagagagtcaaggagggaagcaggcatgttgctgggaagcctttggtgcagataaccttggctacttagagtctccaggtgtgttcagtgcttgtagaatgaggtcagtaaataccacactccaccccaggagagtggtcaacaggcagcaggaaaaggcttgccccagctacgggtgcagctgcaaaccatgttgggttagaaaggtgagggtatcaggtgtggtggtagaagagttaagaaggaagaagaggccaggcgcggtggttcatgcctgtaatcccagcactttgggaggccgaggcaggtggatcacaaggtcaggagttcgagaccagcctgaccaacacggtgaaccctcatctccactaaaaatacaaaaattagccaggcatggtggtgcgcgcctgtaatcccagctattcaggaggctgaggcaggagaatcgcttgaacccaggaggtggaggttgcagtgagctgagattgtgccaccacactccagcctgggtgacagaccgagattctgtctcaaaaaaaaaaaaaaaaaaaggccgggcacggtgggctcacgcctataatcccagcactttgggaggccaaggcgggcggatcacgaggtcaggagatcgagatcatcctggctaacacggtgaaaccctgtctctactaaaaaaaaaaaaaaaaaattagccaggcatgctggtgggcacctgtagtcccagctactcaggaggctgaggcaggagaatggcatgaacctgggaggcagagcttgcagtgagcccagattgcaccactgcactccagcctgggcgacagagcgagactccatctcaaaaaaaaggaagaggacagggtgtatctacaagcaatactaagccttgacatctgtcctgcacagggttggtctctgtgtccagagtcactgtttacattgattgggccctgggtggtacctgagatgctgggagaactcagattcttttctggacacctcactcgacataccaagtgttggagcagcaggactgtggttctcttctattctcagagtaggctttagtctttgcttctctttaccatcaggagaccaaggagtaaaaggaaagcatagttaaaaagaaaacaacaacaaaaatctcccaaagcatcgtgctctgcccttgcaataagaaccagacagcacgtgttccatgggagtccatttcaagcatgacagtgctcatggcggtgtctgtcacagaggccctggaagctgggagagttcaggcctgagctgggaaagtaggttaaaagcaccccagggtggcgtaacaaggagtcatgtgcttttcctaccttatgttcctgaacttggctgctttgatgcttctaggtactttcttctttccccaggttttctgtctttttcttccctttattactagtatttttaattcccaaagcaaaacatgttcaatgtagaaaagtcagagactacagaaaaatcacacatacggttgtgtatacagtgagaatcctcctcaccatcctatttccacttcccttcttttggtgtgcatttacctttttctaggttcaaataaatgtatatattatatacaaatattagttttgttttttttttcctgtgagacagagtctgtcacccaggctggagtgcagtggcacaatcttggctcactgcaacctctgcctcccagattcaagtgattctcccacctcagcctcccaagtagctggaactacaggtgcctgccaacatgcccagctaattgttgcatttttactagagacaggctttcaccatggtggctaggctggtctcaaactcctgacctcaagtgatccgcctgcctctgcctcccaaagtgttgggattacaagtgtgagccactgcgcccggccgctttcttttcttaaataaaaatggtaccatataatgtatttttccttttgtatttgtgatagttctgactcctcattctctctcctctttcctcagggatccggtgtgattaaagctggttttgctggtgatcagatccccaaatactgctttccaaactagtaagtcattctgtagcttagacgttttggaggctcatcagctttgttacaggcccagccctataagggacaggagccgagtttggagtcaacaaaggaaaacagttgtctacatggtacaatttgagaggcacagataagaggcctctttttaaaaatccaattttatctgatgctaaaaaattttatcattggtaacttattgctttggaggattgcctcttggtggagccctccttttaaaattctcctatcacccaggctggggattaacatttaacccatctaccatctttttttttttttttttttttttgagacggagtctcgctgtgttgcccaggctggagtgcagtggtgtgatcttggcttactgcaagctctgcatcccgggttcacaccattctgcctcagcctcccgagtagctgggactacaggcgcctgccaccgtgcctggctaatttttttgtatttttagtagagatgggatttcaccgtattagccaggatggtcttgatctcctgacctcatggtctgcctgcctcggcctcccaaagtgctgggattacagcccttctaccatcttaatgaggagtttctcagaactttcctcctaagacagagagactgcaggcaggagaagagcacagaggcttacaggaagggcttaaagggggaggaaaggaagaggctatctgtccgatctatagcatcacagttttttttgttttctgagatggagtctcattctgtagcccaggctggagtgcagtggcgcaatctcggctcactgcaactcctgccttgcaggttcaagcgattctcgtgcctcagcctcccaagtagctgggattataggcatgtgccatcacgcccagctaatgtttgtatttttagtagagatggggtttcaccatgttggccaggctggtctcaaactcttgacctcaaatgatccacctgcctcagcctcccaaagtgctgggattataggtgtgagccatcgagcccagcccagcatcagttttacttagaggtcctgggaaggggactaaggacactaaaatgttttgagttaatcactcctttagaaattctcatttcctcatctttcttggtctgttcatacactgcagaaagagaagaactagaggtattaaatactctaaaaatttgttttcataatttataataaatataaaatatgaaataatatataaataatacatgttcattttagaaattgtggaaaatacagaaaagtataaagaagaaaatcaaaatcaactgtgacttcactccttgaagataatctcagtagaatttgagtgtgtatgtacatctatacatccttcctgtgttctgtcatgaaatgaaaaatgatggtcctcctcactgtcttttctagtgtgggccgacccaagcacgttcgtgtcatggcaggagcccttgaaggcgacatcttcattggccccaaagctgaggtaattcccaggcctacagaacaagccttaagccagcagaggaccttcattattcaccacatggaacatgtcccaacatttggacatacccataagtaaaaggggcaactttctctgaaaatctcctttttgattctctcatcctaggcttaggtggtttatttttcccaggaacagcctgtggtcttggagaagaaaatacctgggacctcactttgggacacactgagaccagtctaggaaacagggctgttgtcttctgcatcctgtcactgccttgtcagtgatcaaatttactgtgtttattatttttttcacaaaaaatattcagtggggagatcctggctggggtaccctagggatgagttaattcacacagctttgtcagagccctcatgcagcctcttgtaagcagatagcagaatcgctgttgccatccttggcttcaagtgctgaggcccagaggtgggagccaggagattgtgtcctggaaccaggcaatgaggaagatgcctcctgccacttgccctagaggcacctgaggggccatggaaatgcagaagcccctgctttgccggctcctcgggaatgagggcagtttgcagcaaacagtatttagccttggagaatgagtgcccacccttagccctgggcaaggacagcagggtggaagctcaggaagctgaggcttctttgcaagggattcagcttgcactgcttagtcttgggagaacagggtcctgggtggagcctgactgcagtcgtaagtcctgttctcttttcccaggagcaccgagggctgctttcaatccgctatcccatggagcatggcatcgtcaaggattggaacgacatggaacgcatttggcaatatgtctattctaaggaccagctgcagactttctcagaggaggtgaggatcctgtgtgtagggcactcctgtagggtatgcaaagctgtgtcaaactcctaccctagagatgatgaggaggacgatgatcactgccaagagtgctggagccatttgattttcaggcatattcagatttaatcttaacaccattcctatgagatataggtagtattatctcattttacaaacaagggaacaagttcagaaaagccaagtcgtggccgggcgcggtggctcacacctgtaatcccagcactttgggaggccgaggcgggtggatcacgaggtcaggagatcgagaccatcctggctaacacggtgaaaccctgtctccactaaaaatacaaaaaattctccgggcgtggtggcgggcgcctgtagtcccagctactccggaggctgaggcaggagaatggcgtgaacccgggaggcggagcttgcagtgagccgagattgcgccactgtgctccagcctgggtgacagagtgagactccgtcccaaaaaaaaaaaaaaaaaagaaaagccaagtggtatttccaaggtcaccaagtgaacaaagggtagagatggaattcaaacctatgtcttttagaattcaaagcctgtgctcattaacttctttcacccagactggagtgcaatagctcactgcagcctcgacctcctgggctcaagtaatcctcccatctcagccccaccccccaccatgcccggctaattttgtgtgtgtgtgtgtggtggggttttgctcttgttggccaggctggagtgcaatggcgtgatctaggctcactgcaacctctgcctcccggattcaaatgattctcctgcctcagcttcccaagtagctgggattacagcatgagccatggcacctggcaaattttgtattttttgtagagacaaggttttgccatgttgcccaggctggtctcgaactcctgggttcaggcaatctatccgcctccacctctcaaagtgctgggattacaggcgtgagccaccttgtgcagcctgtgcttattaacttgtaaggaagtaactctccattcaaaaatgtaaagggaggctggtcactgtgggtcatgcctgtaatcccagcactttgggtggatctcttgagctcaggagtttgagaccaagttgggcagcatggcgaaacaccacctctactaaaaatatgaaaaaaaaaaaaatagccgggtacagtggtgcgtgcctgtagtcccagctacttgaaatgatgaggtgggaggactgcttgagcctgggggcatcgaggttgcagtaagccaagatcgcaccactgaactcgcagcctggtgacagagtgagaccttgtctcaaaaaaaaaaaaagaaagaaagaaaatgcagagaggtgcagactaggtgtatcaatttccaggtgcaggtgggatgttttcagttttgggttttttttgtttgcttttttgagatggagtttcgctcttgtggcctaggctagagtgcaatggcgcaatctcggctcaccgcaacctctgcctcccaggttcaagcgattctcctgcctgagccttcctgagtagctgggattacaggcatgcaccaccaccaagcccggctaattttgtatttttagtagagacggggtttctccatgttggtcaggctggtctcgaactcccgacctcagatgatccgcacgcctcagcctcccaaggtgctgggattacaggtgtgagccaccacgcccggctgttttcagacagtttttttaaagcagtggtccccaacctttctggcaccagggactagtttcttggaagacagtttttccatgggggtgggggtttggggtggccagatagtttcaggatgaagctgttccacctctgatcatcaggcattcaattctcataaggagtgcccaacctagatccctcacatgcgcagttcacagtagggttcacactcctatgagaatctagtgccttggatgatctgatgggaggtggagctcagacaataatgctcgcttacctgccattcacctcctgctgtgcagcctggttcctaacaggtcacagactagaactggtctgcggcaggaatttagagtttcacaaaatcttcttgacagttggagatacacagtagacacaggggcctgtataacaatcttggaggacaaggaggggagttggggggcacagctgaggacagaatgaaattttaaagtgggcattaacttgaaaagttgagaaaactacttgggcagggatagttgacaggcacagcttgcctttttttggagtgaggctgactgaagtccccgggctctcaaaccagcaaggcagggtcttctcccctaagactaatgaagatggaaatctggccttggcctcattgtctcccgggctcctttcaccagcatcctgtgctcctgactgaggcgcctttaaacccacgaaaaaaccgggaacgagctgccgaagttttcttcgagaccttcaatgtgcccgctcttttcatctccatgcaagctgtactcagcctgtgagtagcagctggctagcccggcccctgcggggaaagcagtcctttggcacagctgaggctggctctcctctggaatggttcagagtaacttgagccccctctgctagggaaaggttaaagatggtgggaaagagagagaggcttttgctgaaactgagcactgaggcttcgtagttgaaagcaaagaaggacatgtggctgctattgaccatatcccagtgtcaggactcctagtgggtttggtccccaaggccttggctgggcctgccgaggcagccacatgctgcagcagctcttcccggaggcccccgtaatgtgtccacttattattcagcacttactgtggccagctgctctgccaggctgtgagacaaccatgatccgaatgccaccacagtccttgttcccatcccccgtggctcctgtcacactcctaccccacctcacaccagagtgaggtctacggcagagattatccacaagtgacctacacgtgggatttatttgaccccattaacaaactgtgagccagcatttaaaaatcaagaggtgtcccatcaaaacccaaatttttggcttctctgaaaaaatgggaagatctgggaaggtcgggcacacattcccacagggcaaaaatcagctggagctgaagagcggctgccacttgagatggggctggcaagcccaccctccccacagcctgtccatgctctgttggcctctccgcactgaagcagggggtcagttgcctcacttgcctttttttggagggaggctgacaaaggtccccgggctctcaaaccagtaaagcagggtcttctcctgcctttgttttttatggaagtgaaaaatattcttatttttctttactcttacttttcctgcctggcccctgttgacatttgagggtttttgccttttgtctagagagttaaaactggcccctaggctgggtctctgaagcagctgaaggccaggccatctcagacaggaaggcctgctcttctgggtacggggagggaacttggagaagatcagcaacttccgttcaggtatttcatggcttgctccaacacctgggcttccttagtacccagtccattctacagaccctggagagaggcaggcccaagctttagtttagctgacattgaaccctaaataaagaagtgtatttcttcccagcgtgaggaggcagtgctgagtgacggtttgcccctttgcttcagttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaagtaagtgctgccccctgggcctagggatggagtgggggttgggagcatagcacccaggaccttggtgacctgccagtgaagccaggcaaagcacctgcctgggggtccctggtgaggccttgttcttcccagccaggtctcccctacgtcacactgacagattcgccttcctgacgtgctgccatcttgttgggggaaagggagctgcttccatttcttcagttgggtgatggctacataggggctcagtatgttttttataccttatatgcaaattacatagggtttggttttgtttcattttgttttgtttctgagatggagtctcgctctgtcgcccaggctgcagtgcaatggtgtgatctcggctcactgtaacctctgcctcccgggttcaagcaatcgcttgaatcctgcctcagcctcccaagtagctgggattataggtgcctgccaccacaccccactaatttttgtatttttagcagagacatggtttcaccatgttgatcaggctggtctcaaactcctgaccacaagtgatctgcccgcctcagcctcccaaagtgctagaattgcagcatgagctaccgcgcccactcctggtttttttatttttatttttttaacatccttgaagaagtcataatacatttaaaacatttgtctttgtaagtaaactgaaacctcctgccacctgtggctatagggaaaactcgagctgggtaggaccagaaccatatgagtggtagaaggagaaagatgcctgggcctgggctgaacttaggttgtggtctcagacctaggatccaggggccaagtttccaagcttgcccatcaggaaggtggagcggttaagaactcatatgctaaatgccacccagtgaaggccaacagagacctcactgcccctgcttctgggcagcagctatagtgaccattggggccatcacaacgtttagacaggtttgtgcagcagcacattcctcccctgggcctttgactggatgtgcaccagatttcctgccagcctgactgtcttgcttggatctgcagagagcctgttacctatccataaacccccaaaaggatgagacgctagagacagagaaagctcagtactacctgcctgatggcagcaccattgaggtaggtggcctgccttctttcttcggtccccttaggtccacaaaagctctgggcccaaccagaattctccatcagggtctggagtctggcaggccagtccctttacaccaagcttgtccaacccctggcccatgggctgcacgtggcccaggatggctttcagtaaggcccaacacaaagtcgtaaactttcttaaaacattatgagattcttttgcaatttttttttttagctcagcagctgtcattagtgttagtgtatattatgtgtggcccaagacaattcttcttccaatgtggcccagggaagccaaaagactggacaccccagccttacaccctctctctggagcagcagagctcctgagcatgagtggccctgtctcctgcagaggaggcagccagaactttgctccctcccgctagaggggaggaagctcctaagggattgtcccacatcagtatgagattaggaagtgggatggttagtgccatccttcaccacacctgggtgcagtgtagggtgagttaccactcccttgaacccccattgctaggaagacgtttccatgagcaaataaatccatgtactgatgccaaagacctcttggctggaaaatgccagagcgagaaggaaatataggagcctcccctcactagtttccaggaggcctatctttgttcctttaagcccttgacatgtagagtctgtcttgagcctggccttcatagccacccagttactaagtgacgtgcagaggggcgtcttccattcccactcccaaagggaccttggtcccagctccgacctcttcagctggccctcctacctgcagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggtttgtctcttctcttggagcccttcccctggaagtgttcagctcctgctggctccaggcaccctgagaattgacttgaagttctcctctttgcccattcaggttttggtgacaggctcctgagtgaagtgaagaaactagctccaaaagatgtgaagatcagggtaggagcatggtggggcctggcctgggtggaactaggcttccatggacagagtgccacctggcgtagcttccctctagctttgcccaagctcttcaagcagccatggctctacaagcagcgccaggttcccagcctgtacactgaccctgaggtctaggtcagccacagggaggctgagttctcattctccctcttcacaccaaaggcaggcagttctaatacccagatgaggcagggtactaggtagagggccccctgcgtgatctttcagggaaactataatcttaagaggagactgacttactgttgctgtgccccctgcccaggtggctcccctgtcacacagtctgacaccttagtgataggtgaaggaggttggctgtctgaggagagcggggatcctaaaggaaggagtacagttcttgccatggagtctgcttctccctgccccccccaatagtcccagcttccctgggacctgtggggactggaaacctgcttccccagatgagtggcaggctggccacagtgccctccagagaggccagagcttcaggcttgtgtaaaatgtatcccctgccatgggcagaaagaggagcattgtagggaaagggagcgggagggctggaagtctcagattcctctttcccccacctttgcagatatctgcacctcaggagagactgtattccacgtggattgggtgagtagctcttccaggagtaagaacagaacaggaagtgatggcactgataacccctcagcaccctctaaagaaaagcctgatttggtttggccccaggggactggtaggctccacacacagccacttctctctcacacagttcctctgggtttcctccctccaggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctcactctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtc

SEQ ID NO: 35650 - DNA, 48930 bp, Homo sapiens
gggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccaccacccttgccccctcagctgcccactcgtgatttccagcggcctccgcgcgcgcacggtgagcgccacccgggaccgagccgctgcaggggaagagggccgctgcgcccgggtgtcctttatctccggacccgctggagcttccgaggggcttgcccccaagtccccccaccccaccccggtcatttcccatgcccttctctgcccccaagccccgacctctctctttcctcccttctccggaagccggcaaaagccggccctccccggtagggaccgttgcagtggccgttggcggccggcgcggcgatgccccgcctccggcgcgagcctcggagcccccgggctggtaggccgagccggcggctccgcgggggaggggcgggtcggggggcggtgcgaggcccagccgggcgccccgctggcgggtcgcgcgcgcgcccgcgcactcttcctgccctcgaggcgcgccgcgccccctcccccacccgctcgcgtaggctaccgctcgctgcgcgttttgtcccgcgtctcgccccgtccgtctcctgactggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaaggtgccaggagttggcggggaagggaggggtggctgcggccgggctctgcggcccctccgaccctggtcgctggagccttcgcttcttttcgtctcgggagcgttactaggtcccctcctcccaccccctggcccacacgccccgtctccacgttcagcgggagcttcgtgcccagaaaacgggctcttggaagaggcacttgtcacctgactcggacgcggcactgtaccccaggcctctttattactcttccgctgtgggtccggctttttggcctttaggagtgggacatgtgagggtgggggcctgtcgtcaggacttcactgtatggtgcccttctttccgtctctgaggcccgatttctctgacgagggcccaaaatgaagaggtccctgcgcggggggctccgggttcaaccgaccgcctcgtggagttggggcggcctgcgtcctgcagccttggggtctgtccgctcggttaccatgcactcgagacctgtcgagcgtcccctcttcttccgtaggagagaagtgtgtttagaatcttaaggtagaactgcctttccggcaggcccattttgaatgggtcttcgatttgctacccccgcgcccatgcgatgggctcccctgcgtttccctctttgtttcaattgtttaggtgtccccccgagcctcaggctcagctcaatcgcgagatgattttctgcagcgactttttgttcctaggggactgtgaaggggcgggggactgccacgatttagattcgttgggggctgggtcctggggagactggagaggatggctgggactcggggcacatggagagagcgtctaacatggcggcggctgcggggagagggaagcgctttactggagctgcattgtgagcacaaagcgaaagcagagggggagggcagagaccaggcagccgccccgactggcctccttaggcccccctctaaaaaaaaaaaaaatcgagccacacccacgattttttggattcaatatttagtccttgtagatcaaactactgaggtatatcttcatctgcaagtcagccttttgttttatgctttcatcgcaggacagtgtaaactcttgtttagaggggcgtgtgtatgtatgtagagaaaaggtctgggcagagtgaataattaaaatgagtaagatcagaggtggaaggggagaaacaaattagtcgtttgtaaaaacgaggtaattacgtctgtgactatcatgttaacttgaattttaccttataaagtaaaatgaagccttgataacttctacttgtctgcctctaggaaaacatatttataacatcttgaatttccaggaaatcattttgcagtgtttatgtggccagacacctaatagtgttacttgaggtgctgatatagtaactggctaaaacttgggctgtgggaaataagttgaagaaaactggtgatgtttaggtcttattaattttacttatatattttacattttgggagagttttaaaacatttagatttgatacttccctgtttcatcttcggtattgaaggttggaagttttacttgaatttcatggacttgggatttcttttttttcccaatcctttattttgataaatgtatgttttattataggtaattggaatagtaaatgtagttacatcaagaaagtaacaaaagtattttaagtgtaaggtagctacattcaaatgttgaatggaataagcatgcccaaggccagtatcttctgagtctgacacatgatttagtttaccctgttgggtatcttcttaaatttttttttttttgagacggagtttcgatctttttgcccaggctggagtacaatggcgcgatctcagctcactgcaacctccacctcccgggttcaagcgattctcctccctcagcctcccaagtagctgggagtacaggtgcctgccaccacgcccagctaattttttgtatttttagtagagacagggtttcaccctgttggccaggattgtctcgatctcttgacctcctgatccgcccgccttggtcttccaaagtgctgttacaggagtgagcccctgtgcccggcctctttttaaaattttaatgcagtaagcaagcctgctgatctggctgctacttgagtttttgattctttagaatttcttggaaatgtttttttctaggacagtaattgaacataaaatattaatgattgtgaacattaataatgtgttaatactaattatgaacattaatgattagtgatataaagtgtagagacattaatgactgaaagataactcctcagagaagttaatataaaggtaggtgctgattggcagccaatttagttgtgaggtggctgttagaatctagtgttcaagtacttctgaaaaaaaaatataaatctagtttataagcccctcctgaggacttgaaccatgactggtcattaaatgtgtataggtgtatgtgaattactatactctgtcataccctaccctcaagtgattttgttattttatttttattttttgagatgaatctctgttgcccaggctggagtgcccaggctggagtgcggtaggatgatcttggcttcctgcaacctccacctcccgggttcaagtgatcctcccgcttcagcctcctaagtagctgtgattacaagtgtgcgccaccaccccaggcaatttttttttctttgagaagtctcgctcttgtccgccaggctggagtgcgacgatgtgatctcggttcactgcaacctccgcctcctgggttcaagcgattctcctgcctcggccccccgcccagagtagctggggttacaggcacctgccaccacgcccaactaatttttgtatttttagtagagacaggttttaccttgttggtcaggttggtctagaactcctgacctcaggtgatccagccgcctcggcctcccagagtgctgggattacaggtgtgagccaccatgccgggcctcccctaaagtcataaaggagaaaataatgtaattattacataggttattaactaggctaatacatactgaaagattgccgtgttaataatggagattcaacaaactgcacaaagtaacttttttttctgtcttctcagtgttttaagtggtagatagcagcaaaaaggtcaagttacagttaagtcttgagactttgataagccacagactgaactctacctacatgttaagtagttaagttggcagtattgatgttgacttaattgctattaaaactatatcttttgccctttgaaaaacccagggcatttggatttgccctaaatttaagcacatctggtttttagtttaaatcctttttatatttagatgatttacttgtgagaagacttaactgtttttaagtataagtgagcatttctaatgcactaaaataggattgctttacaaatcagttttgaattcctctttagaaacccttgtggagtaaagtgaggtactatttacaattagatttgttttgacttcagtccatttagcaacttacatttgagctttatttcaatcttgacctattcttatcggagccttctggaccaaaatgctttttttatggattttaaaatcaaatatcctggcaaaaatgactatggatatgtagtattgcttaaattaaaacagagaattgaaataattttattgtactttaaaaaacaaagttgtttatttcctaataatttgagccattaaagaaaaagctaagcatctgctcattgagaatgcatgctcttaatgttgatgaaatatgatcgtgttatgtaatgcaactaaaaggcttggtgggtttttaaattcaggcttataaagagtacatgaatgtttagcaaagagaagaaatacagctgtgataatcaagtgtaaaatccatttgcaaatcttacaggtaatattgaattgaatgattaactgcctagttttctttatcagttcattggtgctgaactgggccctaggctatgcaagatatttcaaaaccaagtcttaattttaactgaagagagacctcatttgatattattagatgtaatcagttgtgatatagaataaaggatgttttaatagatgacatttaaaattgttatattctttgtgaatataataggtttagactctagtgactttggtaggtgaaagattaactaatgatcacttgcgtaaaatgcaaaaatagcctgacagctttttaaccactaagtgaccaaaactgatagccagaagtgtagtgtttttaatactttttcctgaaggctttctgcacttcatctttgcagttagtagtattctttaaaaagaatgctgttgttgtgagggtaacatttctttctagaacgttgcagtgtgtctgtgcttagaattttcattgcagctgttgtgcagaacttatgtgttcagtgttttaaaataaaaacattcttaactattttataagtaaaatctttccttgaggctattacctgaagccttctttgacatttaagatctcttgatgtgtttgcttttccatgggttgcaagaactattcttctgcaatgcagagggcaagattattttgcattcaccttgtcatagaaaaaagctgtaatgcttaatttgtttccctttgcttgactgtgtgtgtttgtatgtgtagcactgggaagtatttaaagctgtgaattcccccaagtgataatgggtacctttttctagggtgagagtcgaagcctaagtattacattgagaatgtattgttttaacgtggccaaattagtgtactctaggatactacccatgtggcagatatttgagaatgcattttgtgtgacttacagattaagcatacaatttgccaaaattttatgtaattaatttcctagtttacatttagggctagatgaagactagtactgtttcatcttttagaaaaactaacacttttcctttagtaaaagtgttaatttttgcaatacttttgcaaaaggttaaacttatagcaattttgtcatagctataatcttacactgttataaaatttagaggatttttaatttttatttattatcattatttgagacagttttgctctcgttgcccaggctggagtgtaatggcatgacctcggctcactacaacctccccctcccaggttcaagctattctcctgccttagcctcctgagtagctgggattacaggcgcccgccaccacgcccggctaattttttatatttttagtagagatgggatttcaccatgttggccaggctggtctcaaaacgcctgacctgaagtgatccacccacttcagcctccaaagtgttgggattataggcatgagccaccatgtccggcctaagagtttttttttagagcttaaaccaccttagaatttagtccagttcattttatagaagacaaaattgagatgtttatatggaatgacttaggttggaatgggtgatttccaaaattctcgcagttttttttgaaacagaatcttgctctgtcgcccaggactggagtgcagtggtgcaatctcagctcactgcaacctctgcctcctgggttcaagtgattctcatgcctcagcctcccgagtagctgggattacaggtgcatgccaccacgcccagctaatttttgtatttttagtagagacggggttttgccatgttgaccaggctggtctcaaactcctgacctcaagtgatctgcacgccttggcctcccaaagtgctgggattacaggcgtgagccaccacacccggcctcttaaataatgttttatgggagtaattagaatttgtaatgttccacggcctaagtgtagttttcatgtttaattatgtagaatcaagtaaagccttttgcttcaaatccttagagtttttctgttttaaaaaactgaatgcaaaagaaaaatgctttccatttccttattattagacttttattaatgtctcattgttgaactttgtgtttgcattgtccgggtaatggggttctgagaatatcggtaaggtaaaatcccagtgtgtcaggtatcattgggacatccatattgtaatgaaataaacttttataaagttaaaactctgaagtttttctttatgtttagcttcctatgtacatttgtcagactctactccagcttggtatgttgtagaccggaaaaatctggaaaaagcattaccagtagagagaaataagaagtgtgacaaccttttcatccaaattactgtattccaagcttctgggtattttttggtagttggttcctttttctgggggaaatgaatggtgtgtgtgtatacagtatagaagagtgagaggagtagcagaagagaaattcatccaaagttggaactgtaaattgctttgttttagctcatttatttctttctttcactagctctactacagtgcttttgttagatagactatgagtacaaaaacgtgggtgaaagataatttactgagtagagttcaaaattcaaacttcctgaggaaaggggagggtgtgcttcttgaccatgctcagctaaagtagtttgtttcctttaacttcccctgttacctattgtctgtacacttcttgacattgttttttttttttttttgagacggagtcttgctgtgtcgcccaggctggagtgcaatggtgtggtcttggctcactgcaacctccgcctcctgggttcaagtgattctcttgcctcagcctcctgagtagctgggactacaggtgcatgccaccacacctggctaattttttgtatttttagtagagacggggtttcgccatgttggccatgctggtcttgaactcctgaccttgtgatctgcctgcctcggcgtccaaaacttcttgacatttttatattgccttgtgttgttaaccttacatgtttttctaaattggtaataagctctttgtgggcagagactattaacattactttgctgcgctttctcacacatggtatatgctgaataagtacttggtagtttggccaaatcattacatagaaatatctgtagcttcattaacaaccctgttaaaatggattaatccatggggttagggaggaaatgctttttgcacagaactatttacttgcagtgtttttttattgaaattgatttttttcctgaagggttttttactttttacaggtgtgtagagttgatgagtaggcaagtagaagaatactttttttttttttttttttttaagctgggtagcaggctgggcatggtggctcacgcctgtaatctcagcactttgggaggctgaggcaggtggatcacctgaggtcaggagttcgagaccagcctggccaacctgtgaaaccccgcctctattaaaaatatgaaaaattagctgggcatggtggcatgcagctgtagttccagctacttgggaggccgagacaggagaattgcttgaacctgggaggcagacgttgcagtgagccgagatcgcgccactgttctttagcctgggcaacagagtgatactccatctcaaaaaaaaaaaaaaaaaaaaaaagctgggtagcattagcaagatatgtgaatggtcttaagagaacacagataattcttattattagaaccattgtacattattggaaatttcattgcattctcctcaatactgttctaaaaatattttaattttaattttttagagacagggtctcactatcacccaggctggagttcagcagggcaatcatagctcattccaaccttgaactcttagccttaagcgatcctcttgtctcagcctcccaaagtgttgggattacagggttgacccactgtgcctggcccccctcaatactgttatctaaacatagaaataactgaaatatattttagtcattaaaaaaccctttgggcttacactttgagttacattgaacttctttttacattgtggacaggaaagatagtaagcaaaagtttcctcaatttttaaaaggacgacggtagaaagaacacattgcaatctatagatgatccatggcagctatcttcaaatgctgaaagcttgctcatgtagcaggagtctgtgctgttttagaaaacgaaaaagtattaaaacagtgatggtggggatgtaatttttttacatttaactcccaaggaatgtattaatataaataagttgtacagaattatgctaaggaatagcttggttaaagcaactaatattttgaaagatgccctttaagattatttatggtaatttgcttttcaaatctagaagctttagactttttaagaatatagttcaaagtaggtgatgctggaacttgttaacatttctttttcctactagagtcagctgcttcaattcactcagacttacctgcataattataaccttggacaaggaataaaggtttttacaggattggcttttatcttttttaaaaaattggacaaacggcttgtgaaactaaactcctggatacttaacctgcttgaaaaattatcttacaatggaaccttaggtaacatcctttttttttttttttttttttttgagatggagttttgcttttgttgcccaggctggagtacaatggcgcaatctcagctcactgcaacctctgcctcccaggttcaagtgattctcctgcctaagcctcccaagtagctggtattataggcaaccaccaccgcacccggctaattttctgtatttttagtagagaccaggtttcatcatgttgcccaggctggtctcaaactcctgacctcaggagattcgtccactttggcctcccaaagtgttgagattacaggcatgagccactgcacctggcctaggttagcattcttatgccattcttagcgttcagaaatccagcattcctgacaggtgttcattcagcctctgctttaaccagtcttccagggcctggtagagtgctcgtttctcaatgaaaatttgtttcattggtgtgccactctttaagttcttggtggtagaagtatatccttaccggccgggcacaatggctcatgcctgtaatcctaacacttttgggaggctgaggcgggcagatcacctgatgtcaggagttggagatcagcctggccaacatggtgaaaccccgtctctactaaaaatacaaaaattagccgtgcgtagtggcttatgcctgtaatcccagttacctgggagtctgaggcaggagaatcgctggaacctgggaggcagaggctgcatgagccaagatcgcaccactacactccagcatgggtgacacagcgagagtctgtctcaaaaaaaaaaaaaaaaaagtatatccttaccaccactgtttaatagtctttgttttctggaacagcatagactcccgctacatgagcatgctttcaacatttgaagaaagctgccatggatcagctatggattgtagtgtatgttctttctaccctgcttttaaaaattgaggaaacttttgcttactatcttttttgtcttctggggatttcactagctaacaatactcagttgaatttgtggagggcaaataggagacagtcagctgcctaccattgtgggcaaagtcaaaactcgtaattgtctaagtgaagaacagagaatgtggggattggggacttgaaataatacctggaaaaactggtaaagattggaccgggcgcggtggctcacgcctgtaatcccagcactttgggaggccgaggcgggcggatcacgaggtcaggagatcaagaccatcttggctaacacagtgaaaccccgtctctactaaaaataaaaaaaattagccgggcgtggtggtgggcgcctgtagtcccagctactcgggaggctgaggcaggagaatggcgtgaacctaggaggcagagcttgcagtgagctgagatcacgccactgcactccagcctgggcgacagagcaaaactccgtctcaaaaaaaaaaaaaaaaaaggaaaactgctaaagattatggaaagttgagaggaaaagaaatattttgtttttgcaaaagttggtacagtactctagaagtgatttatttggcctggatacataaagtatagctaggtgctcttaactactttggttattttaggcttcatttttaagtattccctctcagtttagacatctccttatttgagaataggagttacgaagttttcctggaaagccaagttagtttttttcagatgtttcctcctaatcttccttctgactatttaaaattgtctagttgaagaatttttagggttttttggagtttatcatctctctttgctatttatttttaattgcataattaaaaatttcttcttaaattttttatttgtggaatttgttggctataacaataaagaagcaaagcccaggaggacatctatcatggatatccctcttctggcaccctaatggcacctactgaacttaatttaaaaaatccatttcaagaaagtaactttggtggtgatgaaaaacttcttgggaagaatggaagatctagatgtattgcaattcagcacaacataataatctgattggagaaaggaagaaaacagcagcagcagaggcagagctggaatgtagcaacagctggaatccagaatgacattctaagggggagggttgttaaggcacaaatgatttttctgggatttaagaccttacttaggtaagttatttaactgtgtctttcaatttacagttaggtgaaatatgattgatagtaatgcctccctgataggtttagctaccttttaaatttgaatgtctgttacatagtgaatactgtcaactattaaaagcagtaaagaaacaggatatagagcgagactggatagcacttgttgggataattatttcccagtaccacatgactctgacatctactgggtgtggtcacacctctcccatgattcccccttaaagactctgggtaatctgggaaatggcctgatttttatcttgctcatatgtgtgctgtaaatggatttttaatacacttaggatactcagctgaaaaggaactctaaattgaatttcaagttagaaaggatctaagagggcaggtgtgtgttatcaacattgtaacgtagtaggctttctgatgaagatagtttttttttgagatggagtttcgcccttgttgcccaggctggagtgcaatggtgtgatctcagctcaccgctgcctcaccctccctagtagctgtgtttacaggcatgtgccaccatgcctggctaattttgtatttttagtagagacggggtttctccatgttggtcaggctggtcttgaactcctgacctcaggtgatccacctgtctcggcctcccagagtgctgggattacaggtgtgagccaccgcgcctggcctgaagatacatttttatgctaggaaaatggtttcattctctaggaaaaatacttaatatcttattttatttgtttcatgagtagctgaccaatttattgttacctcttctgctgctgttagccatgttccagcccaggaaagaataaagctgtgtctgtctggagccctttattactcctatcttaccattctgttcttagtataatgttggatctgtcaatgtgacaagctattccttgtatattcgcttagttcatgctgtaaattttaacaccagtggacaaattttctagttggactttaatgtaaaccatttgaataggaagtgacaataggaatgaagccacttaagatggcatcatttttctcttgagtagtctgtgctttcaaagattaggcaaattgtatttggagaagtgcagataccatatccttttccttatcatggaaggccacttaaggagtaagctgagattgcaagctatagtaatctttatagctatagtaatagctactttcattttgaaaagtaaaaaattagaccaattgtcgtaagaggctttctgtttatagtgtacattttggtatttaccacttagtttaacttctgaggtgtcagctaagaatgcaagatttaacaaaagtactacttacaaatggcagtggtatgcctttgttttttctctctcacctctccttctcaaaggtggtaacccctaagtgttcagatcataaacgagtgttctctttatgaaatagttactaggttagattcgtaaactggtctagaaatccagccacagttcaagttttctgggttgtttaaagtttcaactttaaagtttattaaacaacttacttccaaattaaagctgctgtataatggtttttttttttttttttttttttgagatggagtctcgctctgttgcccaggctggagtgcaggggcgctatctcggctcactgcaagctccacctcccgggttctcacctttctcctgcctcagcctcctgagtagctgggactacaggtccccgccaccacgcccgactaatttttttttgtatttttagtagagacagggtttcaccttgttagccaggatggtctcgatctcccgacctcgtgatctgcccgcctcagcctcccaaagtgctgggattacaggcgtgagccactgcacccggccccgtataatggtttttaaggtcactaatcataccatatgtttgattcagaataatttatttccaggttctactgggctattacaagttaattacaatgtatttgaacgagatgagtgtttctcaaacttaagcatgcatcagaatcacccagaagactcaataccaactacaaattgctgggttcccccagccaccactgagtttctgattcagtaggtctggggtagtgcctgagaatttgtgtttctaacaaggtgccagttgatgctgatgttgctggtttggggcctacagttttaaaaatcactgacgtaaaccaacatagggtctctgctctgcagagatctgattatatataatagtgaaacaaagtccttcccagctcagattccatggtgataaagttctttgtatacctcaatagctgagagatcaggaaatcctatattttactgataagggaaaaactagtgccttttaattaagtttttattgtcatcctgcagttttcttaataagttttggtatttcctcttatgagtgctgtttcttagaaactttgatcagacttaggatcctgctttcctgaagcttaggcaaggacaggggataggatatttataatagtagtgtagaaaatgttaacagccatggaagaacatgtgtaatgctatgatgaaactttctttttttattgtggttagaaaaatgttatatggatgacctgtagtttcttttgatctcactcttggtcaggctggagtgtgatagcgtgatcacacgttgaggctactcactgcagcctcaccctccccagactcagtgatcctcctacctgcacctcctgggactgcaggtgcgcgccaccaggcccggctactttttgtattttttgcagagacagggttttgccatgttgcctgggctggtcttgaactcctactcttgagctcagatggtttcctcaccttggcctgtcaaagtgctaaagtgctaggattacaggtgtgagccactgtgctcggccaagacctgtagtttctgtacctttttaatttatttttatttatttatttatttattttttttgagacagattctcactctgtcacccaggctggagtgcagtggcacgatcttggctctctgcaacctctgccacctgggttcaagcagttctcctgcctcagcttcccgagtagctgggattacaggtggccgcctccatacccggctcatttttgtatttttagtagagacggggtttcaccgtattggccaggctggtctcgaactcctgaccttgtgatccgcctgcctcagcctcccgaagtgctggaattacaggcgtgagccactgtgcctggccaccttttttatttatttatttttttgagacggagtctcactctgttgtccaggctggagtgcagtggcagtggcatgatcttggctcactgcaacctccacctcctgcctcagcctcccgagtagctgggactacaagcatatgccaccatgcctggctaatttttgtattttttttttttcagtagagttagggtttcaccatgttggccaggctggtctccagctcttgaccttgtgatccacccgcctcagcctcccgaagtgctagcattacaggcgtgagccatcacacccagcattttttttttttttttttaagacagtcttactctgtttcccgggctggaatgcagtgacacaatctcgactcagtgtagtctccacctcctgggttcaagtgattctcgtgcctcagcctcctgagtagctgggattacaggttcatgccaccacgcccagctaatttttgtatttttagtagagacgagattttgtcatgttgaccaagatggtcttgaactcctgacctcaagtgatctgcctgccttggcctcccaaagtgttgggattacaggtgtgagccatggcgtcgggacctgtacctttgatttactacatttttttgactgggcaattcagttcgctgggtataaggaactgtggtctgctctttgaaaattctgtaaaagagtcttgagattgttgagttatgatttacatacttatttccttacagtaaactcatcagttcttcaccttttaaaaatctcagttattggattgaaacatgagaaatatgttaatagtaatactaaatcagaataaataggcatgtgagctttaataaaatgcacagttgttttttttttttaatttttattttattggccaagatactgtgctgtcacccaggctggagagcagtcgtgcacatcacgacttccgacttgtggtctcgtgatcatcctgtctcagcctcccaagtagctaggaccataggcactaagttaaaaaatttccacgcctcggtaatttttaaattttttgtagagacaggttctcactatgttgtccaggctggtcttgaactcctggcctcaagtgatccttctgccttggcctcccaaagtgctgggattgcaggcctgagcaaccatgcctggccataatgtgtagatctttattttggctatgcagagttctttttgcatactttcttttgtcataatgttccatgaagatgtgtaccatgaagctgagtttcacatactggctgtttcccttttcatttcccctttaaccttgttccagttattgccgtgtaacagattaatccaaaatttaagggattaaaaccatgattttcttatgcacaaagattctgcctgtcagggattcagacagggcacacaggagttttgatgtttctgttcgatgacactgggggcctcgtgggaagactaagacttgttcattcatatgtttgttgcttggactaaaatgagtggaaccacagggattgctgatcagaagcaagaggcctttcttcatggcatggcttcctcatcatgtggcagtctcagagttactgtatttgtatgatggctgaaggctccaaatacaaggtgtttggatcaccagcaaacaaggcagagatagattgcttttatgactcagccttggaaatcatacagcatcacttatacagtactcttggttgaagctcactcaagtacaatggcaggggaagtagactagttgttaatggagtagtgccaaggtcacattttagaacagtatgtgagactgcatgcagattttgtagctatctttggaaaatgtaatctgcgatagctctcggtttggatgaattctaaatttgttattgtgtagaaaattggaggttttctactctaggatagcttgtcctactataggatagtataggttcataattaaggattgttattggtgagagtcctaacaatgtactgaagtctgtcaattttagtatcttttctgttgcgtggaattcttattgttttcattaaacaaactatatgttcattgcacagtagttaagtgtataaaacaaagcaaaaggaacacagctctggctataattttaccactcaggtaccattcttacctttttcattgtttatctttttatatttattttcatcgctacacaaacattttttaggagtttgattctacctccattttggttagatatacaaactctaccccatgagggatgtatggtgtatttctagatttagcaacaattttcttgaaaaatgtacaatactatagaaaaatgaagatagtaaataccaggtataagttaataacagtgtttcttttgttcagtaataatgaactgtgtactagcactgaactttaggccctcctatttgcgtattttctgtttgtatatttttaaatagaggaattgtgattataatattattattttggaatatcctaaatcataaattcaaaacttatttagttttttttttttttttttaagatggagtctcgctttgtcccaggctggagtgcagtggcatgatctcagctctctgcaacctctgcctcccgggttcaagcgattctcctgcctcagccttctgagtagctgggattacaagtgcgcgccaccatgcctggctaatttttgtatttttggtagagacggggtttcacagtgttggccaggctggtcttgaactcatgaccttgttatctgccgacgttggcctcccaaaatgctgggattacaggtgtgagccaccgggcctggtctagttttttatttcttaaaaatagcctaccctttaagcaaatagaattttttattttaaaaatttttagcttcccaagcttatgagtcttcccttttcttcccttttaaaaaagagaatgaactatctgttgatcctcagagtattttgtgaggtaattggacacatcttctgcacctggggtcaggtctgtcatatcagtgtaaaaaaaaatttttttccctcaaatcagtagactgaaattttatacctgtttatttggaggcttatagatggtgtgaaatagttcatctaataataaaattgggtactattaaaagcctttaatgtcttagtgattatcttggttttatttacctccagtgttaggaaggaattgtggtagggttttcaatttggggtagaatggctaggcaagttgacatttgtttatggtacaaagaaaatagatcatttgacctaaaaaaaaaaaaaaaaaagaaaaaacaaaacttattaccattgcttttaaactggcttctgtggtttctgaatgccctttattagaatttaactttgtactttgtttcacaattttattattggtaagggggtaaggaactatgtatgttcataatttattgggattaagtgttgtcctgttaatttagatttatcctcattcactgtcctcttgacctttacaataataatagtttgtgactctgttgcattacctgaatatctgtggggtcttacttaatagtagcctgggaaacctgcaaagttttaatcttagcaagaaaatgggatcttaaaccagatgttagttttctgtcctcacccttgaactaacaaagcaaagctgttgacttgtgtattagtgaggtggtagctatcttgttcaagataaatggatgaagtacattaaagacaatatgcccatgagtttattcagaaaaaaaatactttttttccccttggggtggggagcagcatctcacgctgtcgcctaggctggagttttggcattatttcagctaactgcagccttcacctccagggttcaagtgattctcccacctcaacctcccaagtacctgggactacagtctcgtaccaccatacccagctaatttttgtgttttttggtagagatggggtttcatcatgttggccaggctggtcttaatctcctgacctcaaatgatccacccaccttggccttccagaatgctgggattacaggcaggagccaccgtgcctggcccgaaaaaatactcttttttttttggatgcaaaatttcactcttgttgcccaggctggagtgcaatggtgcgatctcggctcaccgcagcctctgcctcttgggttcaagtgattctcccgcctcagcctcctgagtagctgggattacaggcatgcaccaccatgcccagctgattttgtatttttagtagagacgaggtttctccatgttggtcaggctggtctcgagctcctgacctcaggtgatccgcccaccttggcctcccaaagtgctgggattacaggtgtgagccaccgtgttcagcctaaaaatactcttatatcacctagtcacatgaattctttggggagagggagaggcaaaaatttaacttgataaatgtctgatatgctcacttgggtataagcaggatcctaaccaaattgtggcccttacccatgtgggtaggagccatatgcctagtccatctaatactctttcttgattaagctaaagaatgaataatgttgtgccattggtttacagtacagcctttgatatcattcagcaatggttggagtatatctaaaaagttttatgtacttaggctgggcgcggtggctcatgcctgtaatcctaacacttggggaggccgaggcaggtggatcacctgaggtcaggagtttgagatcagcctggccacatggtgaaaccctgtctctacaaaaaatacaaaaaaattagctgggcgtggtggtgagtgcctgtaatcccagctactttaggggctgatgcagtagaatagcttgaacgtgggaggcagaggttgcattgagacaagatcgtgccattgcacgctagcctgggtgacgagcgaaactctgtctcaaaaaaaaaaaatttatgtacttaaactggaatatatcttaaaagtttatttaagtcaaaatttgagacaaacttagaggattgtgagggttttgtcaagcatgcttaagctggtatataccttcaaaacggaatgtaattcttttttttcttttaacatagggtaagcttgatgattaccaggaacgaatgaacaaaggggaaaggcttaatcaagatcagctggtaaagatgttatattttttattttagacctaatgctcactattttaaagacaaaaattaattctgtggttttttgtctttccagtaaagtttgggttctttgtcattttaggatgccgtttctaagtaccaggaagtcacaaataatttggagtttgcaaaagaattacagaggagtttcatggcactaagtcaagatgtaagtaaaagaaagtatacatatttatgaaatacttttgttgtttctttgggttttagtccttccattactattgataagctctctgcaaggtgagacagttgtatccaattatatctaagatgccttcacattctgtaaagtaaaatgtaacacctgaaagatgtcttttaaaaatactaagtttgaaattgggggcggtggcatgtgcttgtagccctggctcctcaataggttgaggccaagagttcatggctgtggtgcatatgattgttcctgtgaatagccaccgcacttcagcctgggcaacgtgataaaaccccatctctaaaaaaaaaaaaaaacattaaatttaaaaatttttttaaaaggaccaagtttgagatttgacaaccatgtatagtagctatgctaaaggtctcattggtttaaaatgttagctctgcaaatacataaaaatcagatagtcattagaaatacataaatgttttttatttatcatgttccttatgtctaatgactcacaatttaaactgtcagaaaataaagaggctcgtttatataattggtaattattctctgctttaggaaccttaaggggtatggcaaactgatgtgctcctatatcagcactcgatccaacttaatagtgggtttttgatgtgacaaaaacctttgggaataaggacaaaagttaaatgcaagcaaagtcagataatttgttgaggccagaaaattaagccatctgaataagtgtcatcttctttggagaagactaataacattgaaatacaggcatgtactccataatgatgtttcagtcaactttggaccacatatatgatgatggtcccataacattgtaatactgtatttttactgtacctattctgtgtttcgatatataaatacctctgtgttacagttgcctacagtagtcagtacagtaacatgctgtacacatttgtagtctaggagctaatatgctataccacatagcctaggtgtgtagtagattgtactatctaggccgtgtaagtacactccatgtttgcacaatgaggaaattccctactgacatatttctcagaatgtatccttgttaagtaatgtgtgactatgtaaagttgcctctaatttgctgaaacaaaaaagtttattatatgagacaatgcagtgtagggattaagagatcagattctagaaacagactgcccagttgaatcctaattttgtgacttgactttgtagtttgaccatggatgagttacttaatttcactgttcttgtattagtcaaggttttccagagaaacagatccaataggatagaaagggggctgatgggcagaggccatcacagtgcctcggttttctaatctgtaaagtggtaataataacctcatacggttgtgcttagaacagtatttgatgcataactaatatatttcaagcacttaatcatttttgtttgtttgtcttgttttgagacagagtcttgctctgtcgcccaggctggagtgcagtgccgctgtctcagctcactgcaacctccgcctcctgagtaactgggactacagacctgcgccaccatgccagtctaattttctaatttttagtagggatggggtttcaccatgtcagccaggcttgtctcaaactcctgacccctcagatgatcggcctgcctcagcctcccaaagtgttgggattacagtgtgagccaacgtgcctagcttcaattacttaatcttagaattacttattacatctgatcagggaaggaaaatctttgctgaaaacaaaaaaagtaatttaattttgtacctagtgtcttagtcaactttgtgttactataatggaatgcctgagaccggataatttatataaagaacagaaatttgtttctcacacttctggatgctgggaagtccaagatcaaggtaccagcatcttgttgcattactgtgtcctcacctggtggtagaaggcttaagggcaagagagagtgatcatactcctgcaagctctttttatagtagtattaattcattctaaatagctcccaaaaggcccaccctcccaacactattgcgttgggagggttaagtttctaacacttgaattttagggggatgcattcagaccatagcaccaaaggagagatttattccacttagcttaatgaaccctgcccaatttctttttcttgcttttttaaaatagaagcaggattgctatacagtttaatgtaacatctattttggaagttactatcactgtgtaatgaaaatacctgtatccttttttgcttctcttgtaacactggtattttcaggacctttctctgagctttaacttcattagcagagctgttatttatctttgatcctttggtatactgtacacaattattaaacatgctttttgtttagcattcaagaacttctttagcctggctccagcctaccttttcacctttttccttcttgaactgttcatttcatacagaatagctttctttcttatcttcttttgctttgttaacttcctttcatattcctgtccctcttcctgtgtttcctgcctccacctacctataaagaccttcctgggcagggtgtggttgctcacgcctgtaaccccagcactttggaaggccgaggtgggtggatcacctgaggtcagaagttcgagaccagcctggccaacatagtgaaaccctgtctctgctaaaaatacaaaaattagccgggcttggcagcacacacctgtaatcccaggaggctgaggcagcagaattacttgaattcgagaagtagaggtgtcagtgagccaagatcgtgccactgcactcctgggcaacagagtgagactccatctcaaaaaacaaacaaaaaacaccttcctggctggtcatggtggctcatacctgtaatcctagtattttaaggaggctgaggtgagaggatcgcttgaggccaggagttcaagacccaagaccagccttggaaacatagaccttgcctcaaaaaactttttttaaattatttttttaaaaaagacttttttttttttcttgagacagtctcactgtttcacccaggctggagtgcagtagcatgatctcagctcactgtagctatcacttgccatttattgctaagatatttattctgcacactctgttaccattatagatttgtcttgttcttgcagccttcatcattcttcccaggtctccttccccatttttccctttagtataggtttcatatgtccctattttggttttctgtgtcttggttcatcctagtgaggcttgagaagggggaaaaggtggaaaggaaagcactaccatggcttttgagaagactagccttcctctattcccaacctcatgttagatacacgggagagggagaggaataattgagtttggctgatgctttcctttcagcctttccaggaaagaaaaaaaggaatgtgggaaaaatacattcatacttagctttatctatttttctccaccagcatcatcttattcataaaaacaaattaggcactcttttcagtaagatggaataactttctgagactggcagcggattatttgggacaaaggggcccttgtgggtttttggcatttccttgtgagtcattagtagatactcaaagttagaactttgggtcatttgcccatagaggagctagattgaggtaagatttttattgttgctgtggttgggtttcttttttaattggcctaggcctttacatttctgtataatttctaaattcattaaatttttactttttatatgcataatgaaaaacttcagatatatatacctaactaaagaaaacaatacaatgaaactctttgtacctgtacccagcttgtatatttatcatctcatggtcaatcgtatttcatataaatccacattcatttccttgctccctttgccctctagattattttcaaacaagccccaaacacattgtttcatcagtaatagttcagtagtaaaataccttctagggaaagagctgttctgaatttttaacaattgcttaaaatagattatgtttaaaactatttgtaagtcaggaatcatccttttgtgtattgaggtcatatctcactcattgagtaaaacatgttttatttaagctggacctgaaatggattgaactaagttttatataactaattttggtgttttacttttatattgttttgcagattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggtattagtggtatttgataatagaaacttctgagtatttaagttgacaactgaaaggttattaattagctatttactattaaaaggttgaatgaacagtatgaacatgcctccattcacctgtgggacctgctggaagggaaggaaaaacctgtatgtggaaccacctgtgagtatcactgtgataactttgattttataactaggaatctttaaaaactaattttcttatgtttatagttcacttggaagaaaaaaattagtttttttttttttttggagacagagtctactctgttgcccaggttggagtgtagtagtgtgatctcagctcacagcaacctccgcctcccaggtttaagtgatttctatcacctcatcctcccaagtagctgggattacaggcatgcgccaccacgcctggctattttttgtatttttagtagagacagggtttcgccatgtaggccaggctggtctcgaactccttaccacaaatgattcacctgcctgggcctcccagagtgctgggattacaggtgtgagccactgcgcccagctagttttcctatttaaaattaatattaattgaataaaatttagaaatgtatacatagcattcatctgctatttactgtttggtttatttcttttttgtttctttgtatgtttaatctgtaatgtggaaatcagaacaccagcaacaaacaactaaaactgggaatatgatagtcctaacttcacatggtcttgtatgtaacttaactgtgtttgaggtggacagattaacattagattgactttccacagcttttggtaatagatagggactgtttgttttatggctgaagttttgtgaaacaattattgcatttcatacattctgctcatggttattgccttagtttttctttagtttgtcttagacatctgctaatttgaggatgttaatttttttctgtatttaaaatatgctgatacttggtctagttttctttgtgagctccttattctcaaacatgcaactgtgaactgatttttttaaaaagggacatttacgtttcactccttcagtataggaatttacgtttttagccttctgtgaaatcagggaatagattcttatctttgccatttataaggttgcattaggaaggtagatttttgaacataaaatgaaagtatctgtatttatgcatttttagctattggttgaaaagaaatcagattggattataagctttaatcaccaaaatggtatgagctttaattggcaaaatttagaagagtatatttgctttaaggaaatgggtgccagtccttgtctgtcctttcttcatttaagaaataattttcttggtttgttaacatttactctggtctgtatttctttgtacaatatgtgtttacccttttgcttttagttctgcaagttctatatgtataagcttgttaacttaaaaaagtagttttaggtcaagcttcatcagattttcatgagcattgttgaagagtaacaaaggtgttattaaacctttaagcttatagcttgttttggggttattttctacctaatcttgttcccacatcttaggaatgtaacatctttacaatggaaaggtactaatctttataatgggaaggtactaatatacccaaattagtgtttttatgtacatttgatttgtatctataactttttgaaaacagttttgagccaggagccgctgaagtgaaataaggaaaacatatgaagtgttcattatctaaagagttgttggtagtttattaagattaatttcccaatgcttttgatacaatatggtcctcaaagttttatttttcttcacagtgacctatcggggagtggccctactatgtatctattaataatacacaagctaagaaaattgaaagtaataactcttcatacatctccccctctgccctgcacttttaaaaaataccctggtacaccaaattctgatagtttttgtttgtttttgaatatctttcgattgtctacttttttctcttctacttttatacctttctcttgtctgacgcagttgcttaactgagtccacccctctccctctttaaaatctttagtggcttcatctcagttttattttatataagtttgtccttaacttcaaggacattcatggtctggcctttaccagtttctccagccacatctttccctatgcttgttttttattccctgtattttagccacagtggcttcctttccttttcttgtatttgacatcttttgtataggactttgtaatgctctttcttctcccttgaaacacttcttcccctctactcttctggatttcaactcttgtagcacttacctagggaaaccttttgtggcctcactctgattgggtccagtccattgtagttctgtgtagtacttttcacagatgtaagttttttgtagttgtatttgataccacttctgttagaccataagcttattgaggggatatattgtgtctttacataactttttgttttcccagtgcctagcatattgtctaatgtgtagtaggtgctgaataaatacttttgaatgaataaatgttaaatgtcatctttttccacctaactagtttacttaaaatacataaagttcaggccgggcatggtggctcatgcctgttaatcccagccctttgggaagccaaggtgggcatatcgcctgaggtcagaccttcactaggcaacatggtaaaaccttgcctctactgaaaatacaaaaattggctggacgtggtggtacacgcctgtaatctcagctacttgggtggctgaggaacaagaattgcttgaatctgggaggcagaggttgcagtgagctgagataacgccactgcactccagcctgggtttcagagcaagactgtatctcaaaaacaaacaaacaaaaaccccgtaaagtttaatataactacattcttcttgttccctatcattctgtaatacatttctgttcttggtgaaatgtaatctttttatgtgtatatgtgttttagtaacagttattttttaatcacaatattttatagaatgttggatcttcttcaagccaggcatcctcagataagtcttacattataattcatgttctttttcttagataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctggtgagtattaggtggatatcaactttagtttagggtcctggttttatttgattttgctacaaatttaaactatacacttacttagttttcatatatgtacactagattttatttttaaagagactttaagcatgacaaagtttttttttttttttttttttttttttttttttttggagacagagtctcgctctgttgcccaggctggagtgcagtggcgtgatctcggctcactgcaagctccgcctcctgggttcacgccattctcctgcctcagcctcctgagcagctgtgactacaggcgcccgccaccacgcccggctatttttttgaatttttagtaaagacggggtttcactgtgttggccaggatggtctcgatcccttgacctcgtgatccacccgcctcggcctcccaaagtgctgagattacaggcgtgagccactgcgcccggccttgacaaaatgttaagacagattatcaagagtaattcctaccagtattcattatatttgtcttagtagtcatttgtcttactagtcttgatcactattataaactgatagatagttcttttgcagtagtattgatgggcaggagtatgggtgagggccagctgttacaaggattttcaaataggtttctgtctgacatgcccagatttgctatttactatgccagtgcattggaggaatagtatgagttgcttttgttttgttttaatcatggggagattatagctccataatcttgaactataaattcctccaaggcaaggggtcttttccagttaattttatcatgtagcacaacactaattatatagctagacacttaactgtgaatacttttatgataactcttatgttgatgagtaaaattctgaatacaaggaaacattggagcataagttttgttagaatcagagtgcctgaatttaaatcttcgcttcaacacttactagctctgtaactttgggcaagttaatgaaactcttgtacctcaggttccccgtttagaaaatatgtcaagtgtgtatacagtgcctgacacgtggtaagcacttagtaactggtagctagtaggttgaaactagaagtgaagattgtacattggtggagttaatagttggagattaatataaggcaatctttttccccctcttaccactttactaagtaaagtaagatttttaatctgtatgctgcttcatactactacttatgagacgggagagggcttttaatatagtagctctttatttgcattatacattatctgaaatagctactgttgaacctaaagtaattctggaataaatggtaaagaaaactttctaaaatataaaacactgttaattaactttataaataagtttgtaagtaaattcagattatgtgatggcaaactatttacttatttggaatttaagttgaattcttttttttttttttgagacagtctctgtttgtcactcaggctggagtgcagtggtgtgatcctgactcactgcaacctctgcctcccgggttcaagcgattatcctgtctcaggctcctgagtagtggggactacaggcgcatcaccacaccaggctaatttttgtattttcagtagagatggggtttcaccatgttggtcaggctggtctcgaactcctgacctcaggttatccacccgccttggcctcccaaagtgctgggattacaggcatgagccactgtgcccagcctttttttttttttgagtcagagtctagttctgtcgcccacgctggagtgtagtcgcatgatcttggctcactgcagtttccacctccaagggtcaagcaattctcctgctttagcctctcgagtagctgggattacaggtgcatggcaccacacctgactcagttttttttgtatctttagtagagacagggtttcaccatatcggctaggctggtctcaaactcctgacctcaagtgatctgcccacattggcctcccaaagtcctgagattataggcgtgagccaccatgcccggccttaagttgaattcttttttgtgggggacagggggcactgagtctcactctgtcacccaggctggagtgcagtggcgcgatctcagcttgctgcaacctctgcctcccgggttcaagcgattctcatgcctcagccttcccagtagctggtattacaggcacacaccaccatgtctggctaatttttgtatttttagtagagacggggtttcaccatgttggccaggctggtctcaagctcctgacctcaggtgatcccccaacctcggcctcccagagtgctgggattacaggcgtgagccagcgcgcctggcctagttgaattcttaactttaaaaaagatttattacactttatggcatcatttctaaaaatagactttatttttattttttatttttattttttgagatggagttttgctcttgtttcccaggttggagcacaatggcctgatctcggctcactgcaacctccatctcccaggttcaagcgattctcctgcctcagcctcctgagtagctgggattgcaggcgtccgccaccatgcccggctaattttttgcatttttagtagagttggggtttcaccaggttggctaggttggtctcgaactcctgacctgaggtgatccacctgtcttggccttccaaagtgctgggattacagacatgagccactgtgcctggccgactttattttttagagcagttttaggctcacagcaaaactgaacagaaggtgtagagatttcccatttactttctaccctcacagatgcacagcctccctcattgtcagcatccccccaaccagagtggtacatttgttaacaatggataaacccaaactgacacattattatcacccaaagtccatagtttacatatgggtttactcttattgttaataattctctgggtttggacaaatgcataatgacgtgtatctaccaatatcacacagagtagagtagtatcactgacctaaaaatccttttgttttgcaccattttttaacctcttagaacctgagccagcagaagagtacactgagcaaagtgaagttgaatcaacagaggtatgattttaatttaatgctgcctttactttgctgcctttcaaacaaatgtctcaaacatttactttgctttgcagtatgtaaatagacagttcatggcagaaacacagttcaccagtggtgaaaaggagcaggtagatgagtggacagttgaaacggttgaggtaagagttctctgtattgcaaagttgttgtctttgtcttcagttagtaatttttatctctactgagaacaaattaagattgttttttgcattattagtacatttattataataacagactcattacaccagactgttacttccaaaaaatgaatgtttatccctgtggatgtttaataggatccctgctttgctgaaccaatctaaaaaaattattttatacaaagttatctgtggattaatctgttaccatgatttgtctcttactgaaattaggttgctctgtaaaaatctgggctcccacactgatagctgtgttttggggtatcatcttgcactcctcctttaccctaatgctgtttggtcaccaggctgtagacttcctctagcgttttctaatgctgtctctcaactgataatgatgatttttttcgggtcctcatgtctagttcagtgactctcttcatattactcctctctgactgcctccagaccatcctattcattgtcacaacttaattattggaaaagttagctttaagttacttgtacttgaggctctcagtgatgccttgttacctgtaagatacagtctaaaaaccttaccaactggtcctggccttccttttgatcttcttttagatgtctttctttacacccccaaggtgcaggaaaatagctgtaagctgagggtaatatgcttttccttttaatatgttattcttatatcaagaccattctcttggccgggcacggtggttcatgcctgtaaccccagcactttgtggggctgaggcaggtggatcacatgaggccaagagttagagaccagcctggccagcatggtgaaacccagtctctacttcaaaaacaaacaaaaacctgggcatggtggtgcatgcctgtaatcccagctacttgggaggctgaggtacgagaatcacttgaactggggagacagaagttgtagtgagctgagatcgtgccactgcattccaacctggttgacagagactctgtctcaagaagaaaaaaacccattttccaaagagattgcaaagttttttttttttgagagtctcactcttgcccagtagagatggggtttcaccattttggccaggctcgtcttgaattcctgacctcaagtgatctgcccgtttcagcctcccaaagtgctgggattacagtcatgagccactgcgcctggcccatagatgttataattgtgccagcaacttcatccctctgttggagcaccaaaatgtcccattggtaaggtaaagagagtaggcacttaccccagaaaggtacttgggatgaaaatactgctcaggaagtcccaacaaaatagtgtatatttgctgaattaaagaatgcagttcagaaatgttataggaggattagaagagaaatcaatcaaaaagattagtagaggtgatttacagttgttccttgttataccaggggcattggttttaggacactcccacacaccgaagtctgctcatactcaagttgtgccatgtatctgcgggacccacatatatacaggtgtttcacatctcaagagtactggaggataagtgaacctgtgcagttcaagcccatgttgttcaaatgtcagctgtatatatgaggtgtacaaacccattgagccttgactaagtcgatgggatgtatgtttttaggggagccaggtaatagggatgtatagcatggatgtagaagtagaaatgaactattaacatatttgttttattgaacatagaatgcaaggtaaatattgacatagtaggaagaagttgggaagcagtatacagtgctttgtagttaagtattttttggattttatttgagaagagcatactacttgccactgtgccagtgtggtttgttctttgtatctagtaggtgggcctttctaaaggctatccacatgagattccacgaatttttggagcatcctgaagttggtattacacagattgttggtttcgctttggtagtgatttttatctgtgttgtttataaagggaatagctgattttgcctagtttcaaccagtatgacttgtccagttttaaatccagacagaataatataaatttgatgtaataaaagataggatttccttgcagagcagggaattactaagaacaataagcagaggaaattattagagctgggaaaaggctaatagagtgagctttggcttctgtagcagtttagatgagttggtaaagcttgatcctatggtgttggctgagaaaatggaatgggaaaaacccaaatcttgatgataataatagctaacatttcttgagtgctatgtaccaggttgtgagatagatatatatttgacatagatatataaatccagttactatagaaggcataacagttttaagaaaaatacattattttaggatgtaaacacaggtaatctttctttgaaagcagcttataaaataaatctgaggctgggcatggtggctcatgcctgtattcccagcacttgggatgccaaggcgggtgggtcacaaggtcaggagttcaagaccagcctggccaatatggtgtgaaaccctgtctccgctaaaaatacaaaaattagccgggtgtgttgatgggtgcctgtaatcccagctacctgagaggctgaggcaggagaattgcttgaacccgggagatggatgttgcagtgagtcgagatcccgccactgctgtccagcctgggttacagagctagattccgtctcgaaagaaaaaaaaataaataaataagtaaatcaacatgaaatgctacatagtggtcttatggaactgaaacactgtagaagtgatgacatttttcagaatgttaaatttggcataaatgtaattcatttgggtaactgcattaaagcccgttctgtttatagtatagatggtttatgtagtgtgggggacccatcatggtggtagtgagtggagcttttttgctctcctattccttctaatccttttttttctaccttaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggtatgttcattttagtcagactctgtaacagaaagtttaagtgtttatattatttgactttattctatcctaacttaacctgtaggattcaatgctggattttgaaaatcagacacttgatcctgccattgtatctgcacagcctatgaatccaacacaaaacatggacatgccccagctggtttgccctccaggttagtagtggtacatttttatgtgagagagaaatataaggccagtactttcaggttttaaaaagattgtgaaaataaattttgtttattttaatgactgtttaattttgactcttaggtcttttaatttgatagaaagaatgttattgttcctatgatttgaattaaaaatgtagtttataactgtttatttttaaacttttcattggcatgtagatatagaaaaatatacgcaagtttaatgagtttttataaactgaaaacacctgcagctagattaagaaatgaaacattaccagtaccccagaaacctacgttgtttcctttcaatcactagttaccctcacccctagcgatagcaaccacttccgtacttgtaactgtaatagaccagttttgtctgtttttgtaactttaacaagtgaaattttgcttggcttttaaaatttcaaaattaatctaggagtaaaaataatagaggtgcctttttttgaatgcttttagctttctaggagaatttctggattttattaccttaaaaaaatacacagcaatgaagtgggtaagggaatatgtaagaggcaaagggaagagagaaaccacaagacagtttcagactctttctggacttacaccattatttgaagtagtagcactaaatacagttggtgccttccattgggttaagtggaccttctctccaggactattagtgattgtgagtcatcttggtttttcccagaacacatcagttttagttgcacaaaagtggaactaaataaaataacctatttaatgttgcatgatgttaaatatcataaaataaattgctgagtaaaagtatgtttaatgacagttaatttggtgtaaggtagttaggatttttctgaagtaaagggagctcatatctctcacattttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacacccggctaattttttgtatttttagtagagacggggtttcactgttttagccgggatggtctcgatctcctgacctcgtgatccgcccgcctcggcctcccaaagtgctgggattacaggcgtgagccaccgcgcccggctctcacatttctatcaagagttttagaaaacagatcaaaggtgacacctacaagagagcaatcatggtttttagtgttcattttctgagctctaccaaaggaagagagtaagtcgttttctcagctggggagttgtgtgaaagtcagtatacatagcactgataaaacctgtaaggctatttagttatttacataatgctgagtccattagactctccagtgaaaatgggtactttctaaatgactaaccaaagatcgtcgttttgattatctgtttaatcattgttgggaagggaggtgagagagtgatgggaattgttaagaagatgcatgctgagttgaatataggctgttaaaaagtatatattatttatttgtttatttagagacgcagtctcgctctatcgccaggctggagtgcagtggcgcattcttggctcggcacgctgcaacccctgcctcccgggttcaagggattctcctgcctcagcctccccagtagctgaaagtacaggcacacaccacactacacccagctaatttttgtattttaagtagagatggggtttcaccatgttggccaggatggtgtcaatctcttgacctcgtgatccacccgcctcggcctcccaaagtgctgggattacaagcatgagccactgtgcctggccgaaaagtacatattttaaattttctttttctctagaaacacttgaaattgaaagttggttatgttaacatatattgagccgggtatggtagctcatgcctgtaatctcagtgctttgggaggctgaggagggaggatcacttgagcccaggagtttgagaccagcctgagcaacatagacctcgcctctacaaaaaaattaaaaattagtcaaataaaaaagttagcttggcagggtggcatgcatctatagtcccagctactcaagaagccaaggtgggaggatttcttgagcccagagtttgagactacagttagctatgatggcgccactgcactccagcctgggcaacacagtgagaccctgtttcagaagaaacaaaaggtcaaaatggaatactatctgtctgaggtctagagtatgaataatgccactttattgtacagctttaaaagtcttttttcatggcactgattatttgttagtgcattctattaacattttactttacttttggaaaaaacaagatgaaaccaattgtgaaagtaaactattaaataataaccactgccggtaaaccaaaatgctcacttgaaagctaaaattttatctgcatttcccaatttactttcatgattgctaaaaagtttatttatggtttggctatagaaatttacctttaattgctgggcatggtggttcattcctataatcccagcactttgggaggctgaggtgggcagattgcttgagcctaggagtttgagaccagcctgggcaacatggcgaaaccctgtctctactaaaaatacaaatattatccgagtgtggtggcacacacctgtagtcacagctacttgggaggctgaggtgggaggatcacttgagcctgggaggcagaggttgcagtgagctaagatcacatcactgtactccagcctgggtgacagagtgagacactccccccccccccccccccgcaaaaaaaaaaaaaaaaaaaaaaagcctttaatagcgaaataaaaggtatttagacgcgtctctctaaaaatttaattttgtttgacaaaaatgttttggtcacctttgcagttcattctgaatctagacttgctcagcctaatcaagttcctgtacaaccagaagcgacacaggtaagagtgataaaactattttcttcagggccaggttaggtggctcgtacctataatcctagtactttaggaggctgagatgggaggatcacttgaggtcaggagttcaagaccagtctgggcagtgtagcgagacaccatctctattttaaaaaaataattaaaaaatattttttcacttttgttttaattggttccttggtttctttcttagcttatgaaagaaaataagaatttcatcagtgtccaagtcttctgttggaattcagcaaatttattgttgtggatagctgtcagcctttatttttatgtttaggttcatttttcctcttgatgactttttaagtttttcttaagtcttgcattttaaataatgtattataatataataagccttttttatttagaactgagaatttcagaagacatagtttagacataattctaaaatttagtgcagatttctccatcttagaagtacttgtggagggcttttataacgagacttgggtttatttaacgtcgagcttcaaaaatatatatatttttgcaatttttaggttttatattatacaaatttaaagagagatggtaatattaatttctcccttctttagcagttgtatctatttcttagccttatgcgtcttagaggtaacttgtttttttaacagtcaattttgtaagcaggaagaagcttttatttctttacttatgtctaggttcctttggtatcatccacaagtgaggggtacacagcatctcaacccttgtaccagccttctcatgctacagagcaacgaccacagaaggaaccaattgatcagattcaggcaagttctgttaccgggtcacatacatttgatgaggcacttactcatgaattgaacagatgtacattaccattaatataatgattcttctttttggacctactttgctttcatgaaatatttgagtttgttaatacatataagtttgagattaatttaccactttagtacatctgttcactttttgtttggctaagtttagtttaccgctaaagtgcatctattcactttgtgtttaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtaagcaaattaactaacattaattgcctagtatgtaatatgaatcatggtagattttcttttcttttttaaaggtcttcatttaactgtgcttgagtctgcatctttcattaactgtagggtatatttaattgaacataaactgattattccagagattaactgatactaacggatattctagagataaattttagccttatgagtgatgtgcctgtatcatcttaatttgtagttttacccttttgatttgattaacaaaagcttaaacattcagagaaatagactaatataacatccatataatcattacctagatttaatagttgccctgtttgcttaatcttttattttactgaagtattttgaagtttcagatgttatgctttaccttgattcttgagcaagcacctttagagaatttctagaaaataataataatactataatctgtggggtgcagctaaatcggtgctgagaggaaagttcataagattaaatattaaaataacttttgattaatatgttaataaaaatgaaaaaacattcaaccctgttaaagttcatagaacaaacttctgtaagtggtactgcatccaggagtttgtcttatttatttattttttgagacaaagtcttgctccgtcgcccaggctggagtgtagtggcgtgatctcagctcactgcaatatccgcctcctgggttcaagcgattctcatgcctcagcctttggagtagctgacactccaggcataagccaccatgcccagctaatttttgtatttttagtagagacggggtttcaccatgttggccaggctggtcttgaacttttggcttcagatgatctgcctgcctcagcctcccaaagtgctgggattacaggtgtgagccactgtgccaggccagagtttgtcttttaaaaagatttctcatatatgtaaaagcatttccaaggctgctgattgcatgtctttttattttttttaattccctacttccatttcacagcatattatactcccctttaagtactatatggtatatatgtctttttccacattgaatcacttggagggatttttgtatgtgtgtgtgatgtttttgtgtttgagacctctgtgatgtctttatttatgtctgaggtaaaaccaccattgagtttggccatgttataaaccagagaataaaaggatgaactaatcatttactttatttactaacaggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacaggtacgaaatccagtgtcacctcattggctccttgctttccagcacagttattgacagtgttaggacagtttagacttcagagtggtggtgtccaagagtttctgttttagtagcagaccatatgaatttttcatttcagatcatgagttaaattgagtctgtacttgtatatgtgaattatgtgcaatttttggaggctttatagccattttccttttgtcactgaacttacataatatccctgttgcattgtataatttatatggaattaaatttgttacttgaattaccataaagtgtacttttttttttttttttgagatggggtctcactctgtcacccaggctggagcgcagtgccgtgatctcggcttactgcaacctctgcctcctggacacaagcaatcctccctacctcagcctcccaagtagcttgggaatacacgcatgtgccaccacgtccagctaattttttgtatttttggtaaagttggggtttcaccatgttgcccaggcttgtcttgaacttctgagctcacgtgatctgcccacctcagcctcccaaagtgctggaattaaaggcgtgagccattgcacctggtgataaactatacttttaattgttaattgattgaaggcttttagcatgatatctggcattgagtcagttagacaaagttaagaaaaaactcatggtggctgcatttcgtggactgggttgaaacataatctattttgtcaagtaaggtcataatttggctagttaccatacctgtcacgatagtaatgtaggtagggacgcttttatgtatttgagacaggttctcactttgttgcccgggctggagtgcagtgatgccagcataactcactgcagcctcaaactcctgggctcaatgatcctcctccctcagcctcctgagtagttggtagttgggactacaggtgcttaccgccatggctggctaattttttttttttttttgtagagatagggtctccaggagctcactatgatgccaggctgatctccaactccttgccttgagcgaacttattgtctctgtctcccagagtggtgggattatgggcatgaactaccttgtctagctcgatagagatactttagatttttttttatatatatatttttttaagaaatggggtctctgtctgttgcccaggttggagtgcagtggtgtaatcagatactggagcctttaactctggggctcaaatcctgtactggagcctttaactccccacaagtagcttggactgcaggcttttctcaaactcagggcctccagcagtcctcccacctctaccttataggcatgagccaccatgatgtcttctttagttctttaattcctcagaatttaattggaatcccacaacaaaccagcagtcagaggagttaatactttcattttgtcagcccgattttgaaaagttgtaaaattttctaattattcaatttcttggtaaacttggatcagcattagatttttcagtagtaaattcttacacatcctgtagtattcagtatcactaatatgaagctcgaatcttccatactctgatagaagttatcagttatactatgctcagcttccaaatgataaaaactagtggtgtgatcaccatggctcactgtaacctctgcttctgggttcaagggatcctcctacctcagtctcccaagtagcacaggccaccatgcctggctaattttttttttttttgtatttttagtagagagagggtttcaccatattgtccaggctggtctcgaacaccagtcacatacgcagcaagttctctttaatctcagggccttcatacttactttccttcttgccgaaaactttctcccactgataagtacatggattgctttttctatttttttaaaaaaagttcatttgtttatttttaattgagaagtagaaactatatatatgtgtatttatggtatacagcatgatgtgttgaaatgtgtgtccgttgtgggcgggcttcatggctggcacctataatcccagctacatttgaggctgaggtggcaggattgcttgaggccaggcgttcatgatgaaataatatgtatacattgtgggccgttgtccagtgcagtgatgcagtctcggctcactgcaacctccgcctcttaggttcaatcgcttgggttcaagcgattctcctgcctcggcctcctgcctcaggcctcaggtgatccacccgcctcggccttccaaagtgctgggattacaggcgtgagccaccattcccggcctgatatttgttgaagaaatcatttcagtatgtcccatcattttagaaattttattttgaattagtgtctaatcaggaacaacatgacagaatctttggctttttaaaatggcctacaagtttatactttaccaaaatttaagtaggaatttgggtattttaaaataaaatgaaggctgggtgtggtggctcacgcctgtaatcccagctctttgggaggcccacttgagaccaggagtttgagaccagcctgggcaacacagagccccacctctataaaataaatacagaaattagcagggtgaggtggtgaatgcctgtagttgtagctactcaggaggctaaggccggaggatcacttgagcccaggagttcaaggttgcagtgagccaagattatttgactgaactccaacctcagcagtactgggtgagagagctagaccttgtcttaaaagtgaaaattaaataaaataaagatcacacttaagttattatgctgtgagtttcttcctttctttcctttcctttttcctttcattttttgagacagagtcttgctcttgtctcccaggctggagtgcagtggtacgatctcggctcactacaacttcttccttccaggcttaagccatcctctcacctcagcctcccaagtagctgggaccacaggcatgcaccaccatgcctggctaattttttgtattttgttgttgttgttgttgttgagatggggtctcactgtgttgcccagctggtctcaaactcctgagctcaagtaatctgctcagcttggcctcccaaagtgctgggattaccagtgtgagccactacacccagcctggctatgaatttcttacagtgagatttgatcaagattaaaagctgttattgataaaatgattctaaaattcagttcttttggctactttgtacatggatacacatgaaccattttacaaggaaaatgttatgtgtatttgtcattcacttacaattttaaattttgggaatataataaaaggcaatctatgtaaaaagatgacaccgatgtagttggtttactaagtaattcaagaggagcagtggctctctctttttctctaggtattccctagtgctttcatcgtaaaataggattctaacaactattaatgtatttggagtttcttaagggtgtaaaataggtcaagtaaagattttcaagagtcatacagctgcttttctctctgccccaaaaggggagatttgggttggccagcagcttctgacccttgttgttagtgtgtgggccttcctttgttctgttgccttcctcacctcccaaaggtacttttagcaccctatttttttctcctctttgaattataaacattgttctgtagtattgaatttttgaaaatttctagattctagaactctgtccattgtggatggagcttgtatatatgttagtgtgtaccttagtctagaaccttcaagtgggttgagtgccaatgtgagtaccatgtgattgttttctaaattggctatacttgccattttaaatactttgaaatggaatttggcattaagggctacaagtcgaaggcctctgctgattaaactatgtagttgatgacatattctaccatctagctgcttaaatatgagagagtggttttgtatgttttactaagtaaaaaaaaggatatttaaaagaataagaaaacttctaccactaaggagctttataatgaaaagaagtaattaaatggtacaaaatggtaatgtactaagagtaaatcttttgagttattttgggtctcttgtgctaaaaagtagatgcctttcagaagacgttaatatagcctttcaaataatttgtttggaaggatcaatcatgcaccctgctttcaaaggtttggaattgtggttggagaattttacccccaatagctgagtctaagggtaggagaaaggtaagagactttattcatgtgtagtttttcttatcattgtatgcaaatttaaggattaaactttaaggagactgtataagacacttcttaaactagaaagtgcgtgggagaacaaacggtaatgagctgtttatgtatatatctttttcttttttaaattatagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggtaaaaaaataaaaaaggaggttctaatgaccttttactagttcaaattattttttgatttgtaaaatatatcacacagtttttgggaaggatgtatctgcattagcctcctatgtgcaatttaaacaatgtatattttggtacaatttgtgtatttggtataatttgttatttaaataacagatcatggaatttttgttcatttggttatgtcaaattaatgtctaccactatctcctggaggataagtattttccacattaccaaaacttacggggattgtttattatatttgtacagatgtgtgtttacatgcatagatgggttaaaagtttatcttctgaggggcagttagtacttacagaaatttataaacagattggatcaagataggaaattggagattaatttgattaactagcctggcttataatttctagttcttcccgtcttcattaataaaaaagtaaaaattccttgtgaagataagaaaattatttcttttcttgtcctaaattttaggaggatatgatggttaccgcccttcattctctaacactccaaacagtggttatacacagtctcagttcagtgctccccgggattactctggctatcaacgggtaggtaaagtagttctaaagtgtaaacctgaactaaatataccaatgaaagtgacttagtgttgttgcttaatgaacctaagtaactaatttggcgttaactttgtggtgtccaagacactctgttgaaacaaaagcttttagcactcaacatcagtactcctttagtaaagcctgttaaagacagtgatttccaagagcagagaaatatatttcactgaatgttctttgagaatagtagaagtacaacaattacagaacaaggtgtagctgtgataaactgatactgaagtgtctaaaagattaaggaagaattctgtattgagtgttagactgaaagaatagatgggtaagcattttttaaaaagtaccttttcaatactaactagcttgtcttttaggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatgaatgaatgagtactggtggaatactccattagctttactcttcttttagctaagagaacatgagcaaatttgcgcatgacaacttccaggacaggggaaacttgaacactgaagaattgacctcttaagcctaataatgtggtgacaggctgcccacatgcttcttgacttcagatgaaaatctgcttgaaggcaaaacaaataatatttgaaagaaaaatcaaatgccatttttgtcttctaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattca

SEQ ID NO: 35651 - DNA, 48930 bp, Homo sapiens; identical to SEQ ID NO: 35650

SEQ ID NO: 35652 - DNA, 43484 bp, Homo sapiens
ggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccggggtaagggccgcgcgaggaggccttggcggccacagacgccggcggggacgagcagctggcgcacgggccctcggcccccagggctgcacctccgggccctcggggcgaaggggcgcggggcggtgcctcccacctccgcgggcgtgggagcgagccggccgttccctggtctcccttgagcctgccacccatttagcctgccaccccctcacccttccgggtgggggcggcgggcgagaccggcactggacatggagcctactgaccgcccggcagggacctgctccgcgctaatgcgggggcaattgggctaaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaagggaagtgctgtcatggagtgtggacctcagccctttcgctgtgtttgttgggctttttattagttttttcgagggaaggggtccagatcggcagcgcatcgttcactttttgttttacatactagtatttggcccaggagtaggcccacggagaccagcatgttccattgagtggttttgggtgacctaggatcccgcaagactcaagtgttaattccactagccttaggggaagttaattagtgttgattatcccacccccagcccccttttttcccttcgtttcagtatacaggtaatgttagcctttaagattcaaaaattgtaaaatctgactaaagcactgatttagaaactatttgaaaattgtttctgtaatcccagcactttgggaggcccaggcgggcagatcaccagaggttaggagttcgagaccagcccagccaacgtggtgaaaccccggtctctactaaaaatacaaaaattagccggccgtggtggtgcttgcctgtaatcccagctacttgggaggctgaggcaggagaatcccttgaagccaggaagcggaggttgcagtgagccgagattgcgccactgcactccagcctgggcgacaagagtgaaactccgtctcaattataaaaaaaaaaaattgtttcattcagacctccctcttgccagattaaaaaaaaatgtattttgggtagcaaagtcagcaaattagaagatggaaatattatttattctggatgacttctatagtgatttctaaccattttgatgttgcaacattttgtgagttttctcccctccctcccataaatatgatgtatgaattaaagttcattttacttgaacaaaacactttggaatctgaattgttgagggggaaaagagctggtatttactgccataatactgcccttgattagatttgttacacaattttacaagcaataattatggtagcttcatctgaactgtgttaaaaatggactagagtaaaaagagtgttaacgtacattgaggccaggcgcggtggctcatgcctgtaatcccagcactttgggaggtctaggcgggcggatcacctgaagtcaggagtttgagaccaggctggccaacatagtgaaaccccgtctctactaaaaatacaaaaattagccgggcatggtggtgggcgtctgtaatcccagctactcggtaggctgaggcaggagaatcgcttgaacccggtaggcggaggttgcagtgagccgagatcgcaccactccagcctgggcgacagagcaagactccgtctcaaaaaaaaaaaaaaaaaaaaagaaaaacaaaacatattaatgtgacggtttttaagaatgtaatatttttaaaaaggcagatccactgctatggaaacgtctaagattttaagttgaaaaaggttttagaatgattcagtttaagtgtgtgttccttattaaagatgtatgtccacaaacttgtatccgcatatgaaagttttggagggatacataagaaatgttcataatggttacctatgagacagaggataagggagtgagggaagatggagaggacttcatgacctttctgaattattggaaaaatgttctttatttgaacaaagcaagtattattaaactatatttaaactaaattaaccataaacgcatgttacatgtgcggctaaaattcagttaaatgtgctttttaaaaaagtattagcctgatttccactatagtttcaaattggcctctaaataaataaaaaactttaaaaattgaatttaaaattttttgttttgtgattgtgtcagatactctttttagaaagtcaagccagttatattttaatgaattcttttaggggttcaaggtaatgagccctgtatttgtagtatatatgagtttttaaatattaaattagaatgggaatgttaaccgaagctgatttttttttttttttttttttttttggacacaggatctagctctgttgcccaggctggagagcgatggcgtgatctcggctctctgcaacctctgcctcctgggctcaagcggttctcctgcttcagcctcccgagtagctgggactacaggcttgtgccaccacacccagttaatttttttatttttgtagagactgggtctccctatgttacccaggctggtcttgaactcctggggttaaaagatctgcccactgcggcctcctaaagtgctaggattacaggcttgagccactgcaccctgctgtcagaagctaatgttatgttactattccattagttagctaacattagaaggctgattttaggctgggcgttgtggctcatgcctgtaatcccagcactttgggaggccgaggtaggaggttcacttgaggtcaggagtttgagaccagcatggccatcatggtgaaaccccgtgtctactaaaaatacaaaaattagccgggtgtggtttctgatgcctgaaatcccagctacttgggaggctgaggcaggagaattacttgtacctgggaggcagaggttgcagtgagccaagatcacgccactgcactccagcctgggcgacagagtgagactgtcacaaaaaaaaaaaaaagctgattgtagtatgttattgattagtcttgtgtctaatccatgtttttaagattcttttccttaagacaagtgatcaattcctgtcataaatgaaaaaagtgagtgtaattaattcaaataaaatttatctgttcttatgcttctagttattttaaaattttatgcagattttctatggacatgattggtttcaaatgaagaaacagtgctgttaaaatacatgaatcatataacaggaatgctgtaatagttctgagtatgtagaggactaggaaccgcttagattgtgtattctgtttcttaccatttgtagacatgaataatcatcttgattttatttagatacctgaagttataatgattcctttataattaaatattaaagaagatattcagatgtaattttgcaaatttatggaaatagttgttatcctaaggtgttttcatttgctccttacatgccttaggttttaaaattgtaggctggctgggtgtggttcctcatgcctgtatttccagcattttgggaggccgaggtgagaggatttcttgaggccaagagtttgagactagcctgggttagtataacaagaccccatatctagtaaaaataaaaataaaattacaggctttttaaaaagttacgattcttttaacctctctggcagacccaaattaaatattctaggacaggagtgtccagtcttttggcttccctgggccacattggaagaggaattgtcttgggccacacatgaaatacactaacaatagctgatgaactaaaaaaatcaccaaaaaaatttcataatgttttaagaaagtttgtgaatttgtgttgggcctcatgcagcccgtgggccatgggttggacaagtttgcctggaaacaagtttgtacttacgatcacatgaccaatgttggtcccgcttgattttctatctcccagcttgaccagtgtctcagtagggttgcccagaggaggaaaactcatttgatccaataatttatgtggattttaaccattcaaacctccttctgaaatcaagccacttaaagtggcccagataggtgaaaatctggaggtctgtgaaactctaggtttaggtcctcttcacgagctaggcccaggcccctggtgttacgtgtcttgttaccagactagggtgatttcatcagcattgagttagatcaccaacaaaatgaaggtttctccagtgcgtgctatgttgctggcacagtgcttaataaggtccagtcgtacagagaagcttatagtgctagaataattgcatttgcatttatgtaattgacatttgtagttgattgtggcctgctttatcgggcttatgctactttatatgttgaatttaggagtgtttgaaacagaaacaaaccaaaaccaaatttggtttcatcttgcaaaatgctttggtataagtagaataaatattttggtggcctaagatcagaacagtcactgtgcagttaacttactaaagaacatcagtaccatgagataaaattagtaaggggaaaataaatattaaataagcccaaatggggctttataaatcccaggttattatttttttgaagagaaaaaaaaaatgtacttttagagcagatgtagatagaatttttcatttttgcttgaaagaacattatactgttcatattcttaccatttgatgactcagtgggaagtaagggaactagtttaaaccacactgctgtgaagaggaaactatatatggtaaaatctatttcttaaacacagccttactgcacacaatgaaagaacgaagtcaccaagtcttaaaatgattgacatgggggaggaatttcaaggattaagatgataccaatgataccaaatgatagtttagaaaggaatgttttctttgtattttatcacatcatggtttagttttttttttttttttagacagagtcttgctccgttgcccaggccagagtgcagtggcatgattttggcttactgcagcctccatctcccgggttcaagcaattctcctgcctcagcctccccagtagctgggatcacaggtgtgcaccaccacgccaggctaatttttgtatttttagtagagatgtggtttctccatgttcgtcaggctggtctccaactcctgacgtcaggtgatctgcctgcctcagcctcccaaagtgctgggattataggcgtgagcactgcgcccagtctagattttttttaatactgattattattattatttgcagaagtaatcagattgtcagttttatattattgaaaaattggggccaggcacagtggttgatgcctataatcccagcactttgggaggtaaaggtgggaggattgcttgaggctgggagttcaagaccatcctgagcaacagcgagacccctgtctccacaaaaaataatataatttaaaaattataatttttattttttctttactgcttcttgcagagcaggactaccccataggcagtgtgcccagagtagccagtataattttttttttaattattttattttattattgtttttgagacagagtctcactctgtctcccaggctggagtgtattcatgttatctcggctcactgcaacctccgcctcccaggttcaagtgattcttctgccccagcctctcaagtagctgggattacaggcatgcaccaccacgcccagccaattttgtacttttagtagagatggggtttcaccatattggccaggctggtttcgaactcctgacctcaaatgatcctcctgccttggcctcctaaagtgctgggattacaggtgtgagcccccacactcagcctttttttttcctgacagggtctcactctgttgcctaggtgggagtgcagtggtacaatcatggctcaaggctcaacgtagcctcaacctccctgggctcaggtgatcctcccacctcagcctcccgagtttctggggctacaggtgtgtgtcaccacgcctggctaatttttgtattttttgtagaaatggggttttgctctgtagcttcaggctggtctcgaactcctgggcccaagcaatccacccactttggcttcctacagtgccaagattacaggtgtgagccaccattcccagccaattattttagttcttgttattataactgttaatgttttcacttttgaagtaatgtgaaatagtgcaatttttgctatcttgatggatgaatatataccctgtatgaaaactggtgctgagttctatggcaacatctgcttccaataaactactgctcaagcagaatagttttattaataagtgattgataatctttaatttgaatgaaaagtctttttttttgttaggcagtaatagtaggtttacagttgtttttatagtttcagggatttcagtttttgtcttctaacttgggaaatgtttgttgcttaaaatatactcataagaatgttaagatacgaactacccatctgaacgattataattggaagactttgagtgatgtgattatttgccactttgccatgttgtatgtccagtgtgtgtagctctgaaggagaggggagacgtgtcaaccttagcagcctcttccctgcactaggatcagacctatgctccatcccaggctcctcctgccacctccagcttctcttacgatttctcacttagtaaacttatttatttgcattcagcatgccaaaaatgaaccttacaaactggtaggttctcttttcattcattcattcattctataatttttttgagataatttatacgcatataagtgagcattttcatccggataaatggatacttttgactatatctgtttattacttggaggtaggcataataatttaatatcaaaatagtatttaattcccatatttgagatatttgtgtaaattatgactgacattaggctggcgatcatgacagatgttatacagaaatgtgggaacaatagggataatgatgagaacagattctcttccatatcatttaagtttgtatcaagtaaactggattttgacttaaaagagagtttgtgatttgggagagaagagtgtgtgagaggtgtgtgtgtgtgtgtgtgtgcacgtggtgtgtgtgttatgttttagtttgaaaatactaaaaaatactagatgttattcttttcctctgaggtagtttttcctccatgtcttaggtcacattatttaagaagacactgagaaaaaatgaactactactcctgaattctgttcattttaagggtgggaagtgtattccagttcatcactatcaaccactgccaaggggaaatagctgtgagcaagtgggttatctattgcatatgctatcatatcatgctaacttctgccttaaaaagtaatccaggctgggtgccgtggctcacgcctgtaatcccagcactttgagaggctgaggcgagtggatcacgaggtcaggagattgagaccatcttgaccaacttggtgaaaccccttctctactaaaaatacaaaaattagccaggtgcagtggcgagcgcctgtaatcccatctactcaggaggctgaggcaggagaattgcttgaacccaggaggcagaggttgcaatgagccgagatcacgccactgcactccagcctggatgaccgagtgagactcagtctcaataaaataaaataaaataatccaaaagaattgtattatacttttagaaatggatagctgtacctgaaaaatgcccttaccttggtggctcaatataaactaagactaggtttgtgggcttgtaagaagacatctgaataatatgttttatgtagtttctattaataaaatgtaaacatgaggtgaaaggataggaattgaggtggcattgggagtgtgaactttcctcatttcagacgaatttttcataaaagctttaatctgattgtcatgactgtaacatatttgaaaaaactctgtttttaaaagactaagtggggccgggtgcggtggcttatgcctgtaagccccaggctggtggattacatgaggtcaggagttagagaccagcctggccaacatggtgaaaccccgtctctactaaaaatacaaaaattagctgggcgtggtggcaggcgcctgtagtcccagctacttgggaggctgaggcagaattgctggaacctaggaggcagaggttgcagtgagctgcgatgacgtcactgcactccagcctgggtgacagagcgagactccatctcaaaaaaaaaaaaaaagacaagtgaaattctggatggcagaatgtcctaggctatttataattaaatgtggttcatcagcgtcatctccaacagggctgctgtagagatctttgaaaataccaaatttttatgttttggagagctacataagatcttgctaagttttaccgcattaaacaaaagagtttcttgtagatagtagctttcttttgttgttggttttttgtttttttgggttttgttttgttttgttttgttttttttgagacaggtctcattctgttgcccaggctggagtgcagtggcgtgatctcagctcactgcaacctccgcctcccaggttcaagtgattctcatacctcagcctcccaagtaactgggattacaggcatgcaccaccatacctggctaatttttgttggttttagtagagatgggtttccatcatgttggtcaggctgatctcaaacttctggcctcatgtgattcaagtggtgtgcatagtagccttctatcaagaggtacattgctcttttctgtctacctttgttttattactgtcatgtatcacattcaggtactatttttcatccttaattctaagaatgtgtggtgcctggagccatagaaaaacagactttttctgaatattaaatatattttaaaacaatcatggtatcatactgttaagtcaacagcaaaacttttaatatttattgatcatttactgtgtacctattatgtgccagacgctgttctaggcagttggaattcatcagtaaacacagtgtagctaacattaaataaatgcttgttaaagagggtgcagactatgattacatttcctttcttatatagcttcctcctcccaccctgaaatttttaattgccctttccttgcaatgtctgctcttactagactatgtattatttattttttgtatgttttttgagacagggtctcacatgatcacggcagccttaacctcccaggctcaagtgatcctcccacctcagtctctggaatagctgggactatagcacatgccacaatgcctggccaatttttaaattttttgtaattttttccgggggggaatcttgccgtgttgcccatactggtctcgagcttctgggctcaagtgatctacctgcctaagcctcccaaagtgctggaattacaggtgtgagccactgggcccagcgtaaacagactatacaagaatttgtaactgccgggcacagtggctcatgtctgtaatcccagcaactcaggaggctgagacaggaggatcattggaggccaggagttccagaccagcccgtgcaacatagtgagaccccatctctacaaaaaattttaaaacttacgctaggcgtggtggctcactcctgtaatcccagcactttgggaggccgaggcaggtggaccacttgaggtcaggagtttgaggacaacatggtgaaaccccgtctctactaaaaataaaaagaattacctgggcgtggtgaggtacacctgtagtcccagctactcagaaggctgaggcacgagaatcacttgaacccgtgggcgggggcggtggaggccaagcttgcaatgatctgagatggagccactgcactccagcctgggcgacagagtgagactctgtctcaaaaaataataatgaaaataaaaacttattcgggcctggtggcacatacctgtagtcccagctacttgggaggctgaggtgggagcatcacttgagcccagcagttagaggccacagtgagctgcagttgtgccactgcactccagcctaggcaacatacaagaccccaactctaaattttaaatattttttaaattaaaaaagtattaaaagctcttgattctctcaagttttactgtagttaaatcctgtagaatatcagcttcttatgtataaaatggaagtcttatcacaatgatatgttctcggagcagtacacagagaatgaaattatgttacccggtattactaaatatatttatctaaatgtaaaaatgtaaatagggccaggcgcggtggctcacgcctgtaatcccagcactttgggaggctgaggcgggcagatcacgaggtcaggagatcgagaccatcctggctaacacagtgaaaccccgtctctactaaaaatacaaaaaattagctgggtatggtggtgggcgcctgtagtctcagctactcgggatgctgaggcaggagaatggcgtgaacccgggaggtggagcttgcggtgagccgggatggcgccactgcactccaccctgggcgacagagcgagactgtctaaaaaaaaaaaaaaaaaaagtaaatagctagccaggcgcggtgactcaacgcctgcaatcccagcactttgggaggccgaggtgggcagagcagctgaggtcaggagttcgaaaccagcatggccaacatggtgaaaccctgtctctactaaaaatgcaaaaattagctgggcatggtggtgggtgcctgtaatcccagctacttgggaggctaaggcaggagaattgcttggacctgggaggcagaggttgcagtgagctgagatcacgccactgcactccagcctgggcgacaagagtgaaactccgtctcaaagaaataaatagccaaaaatgcctaataaatgtttcttttcataatacggtgatattagtttaaatgacacttggttttcccattttggaaaatgacattctctaagcgatttgcccaaaatgaatgaaagtctgctttagaattgaagctttagttctgttcattttctcacatttctctttctaaaaatacttagcattttgccgggcatggtggctcacgcctgtaatcccagcactttgggacgctgaggcaggcggatcacctgaggtcgggagtttgagaccagcctgaccaacatggagaaaccccgtctctactaaaaatacaaaattagctgggcttagtggcgcatgcctgtaatcccagctacttgggaggctgaggcaggagaatcacttgaacccaggaggcggaggttgcagtgagccgagattgtgccattgcacttctgcctgggcaaaaagagtgaaactccgtctcaaaacaaaaacaaaaaaaaccttagcatttgttcagcgaatttgtccatcccacagatacttctggagtgagcactgtgtgccaggagctctgttaggtattggattccagcacgaactgctcagcttagctccctgctcttatgaggcttttggtctagtgagggaacttaggcactaatttagcagtaaataaacatgaaccctggaagtaggcaatgccgtgaaagaagttaaaaggagatgttgcgatagattgagtggctacttcgggtggactgaaagcaccaaaagtttaaaatgttatataaatgcaaagtgatatttttcagatgctgtcttaaaatatagtaaatatcctgatgctaacccacttttattttactgtttcattccagtttgtgaagtgtggatatgcaggctctaactttccagaacacatcttcccagctttggttggaagacctattatcagatcaaccaccaaagtgggaaacattgaaatcaaggtaatattttatttattgataaatgataatcaagacatgtgaggtgttcttataaaagtagtttaacagttcttttaagtagttttaaaatatgttgccatgaaaagcaaaggggagggtagaagttctcatatttttaatttatatcaacacctgaacaggggcacaaaaattgaagttaatttcatctgattttgtttatgtatggcttgatgccattactctttggagtaaaatacttaagtttattacattaatgtgaaacgctgtgttagtgacttaagtcctattacataatataatttttaaaagaaatcggcctggtatttttatgtctttcaattccatatatttgtcattgtatgtgagtgtctctttggcaccttagactttttcttttcatgtttttatggcctgatccctctacttttttatatagccatttaggaaaacacagggtgtaaatctcattgattcctcttttcattaatataacttatttccataatgtgcagaaggaagccattcaagcctttatttggccttggattatgtatcttaccataaagaggaaggaaagttttcattgcctactcgctgtatttaagatgaaagactacatgaaaagacgatcgatttttctcccatattaaagggatcagaaatcaagtaggagttacaatatttgacaagaaagagaacagtgagaggacagtagtcaccagttggctttaagttcttcaggtgactgaaggatcaagttatacagaatgccatagaatttagggtcttttttagtgaattatttgtgaacacgctagcattgtttgtcctatctggatagtctttagcaagccttcagtgtaaggttatgagtcatttgaaatatgcattagggcgtatctctttgggacatttgttttatgtaggaaggtggtaatgggtggtagagatttgctatgtagccttctgcttttgggatagagagttgagttacacaatgaataaaaatacaagctgaaacttgggttctgtgttagtttttttttttcagagttaaagtagcgaatttttctggcctctcctgttaacaaaaaaaataaaatgggacactcagtgtaagtttttcctttttaaggagcttttggaatatttgtgggattccttacttgcttattgtgaactcctttcattctgaatgaattctatcttaaatgaactttgactggaaattagctaataatagtgataaggataaactgtttaatgaagttgaaggctatactttttattcagtgtcaggtttttaaagaatggcttttttatatactggacaataaaatttttgaggtatgaagaaatatcatgtatagccataaatttattttgcaacataggcacaaataactacacatctcttcatgcccactttcttcgtgtttaaggccaagtgatagaaatcaaatttgtcagtatgctaataaaacatttttgccaaggaattccctagcagcatttgcttgtatggtttgtcattctgtattctattggctcaattctgttcactctgtgcaatcttgtaagcctatcaagttaaattattcttcgagtagaaaacagcaaaagatacctgtgtcaaataaatttaacttgaacactagagcttggaaaaacaaccctgagctatctaacactctgcctactcagctagacctttgctgttatcatttatttttcttaattaaagttcttaagttcagtaatgaattaaagaagcttactttttggaattcctgtgcttagtattttgacttatactttttgtgtcttgttagctaaaatgtggtagactgaaaaatggaaatttaaatcgtttaatgagttaatttgcattcaggaataactgtccatgttaatttggccctaattattaactccattaaatatagtagtactgcatctgacctcaacctaattgtctctattgcttgtatgtttaaacatttcagtgaggattttatttaggccttttctgactcttacttctaccttctctctcttcacctttcttgacccgttgaagtagaataacaaaaagatggtaagtgaggttacacacatgctctgtttgttttccacttttgcttgatgggacagtagttgttgttttgtgtccctttagtattggggagggggggttatttccatatttttattttaagtactttgatttttaacctttttcattgcttcaatttgatagcaactaattaagtcctatactttcctgattgcgtacaatggaccaaacaagaactaattactaacatagttttgaattgttttccttgtttttcttgtagatgaatgttataattaaaatggaatgtgttgtgcataatattagaaaccagatggctttatataggatatgtgtgatccaaaaaattcaagtgaagttgttacatttgaataaattcactttattgaccagtattaaattgaacattgactgtcatagcctgtatatatatttgcatctagtgtggtatcatatgtgtacttaataaactgagtaaaattttaatatgtaaataaaccatagatagaaaaagagaattctttccatatcatccttactgatgagcagatttcacaacgttatctgaggataaataagaaaaaggtaaagcttttctataaacaacagatttcccccccaaacattgtacagtgtgtttttctttataactataagcttgctggtcttatctcagacatttaactcttcattgtatttttctgtgatagtctaagtgcttctgtagtagatacttttcaagtttgtttttaatattgtttgtaagaatctctgacaaaaatcaggcacttctaatatatattttaactagtaatagtaactttgtgaagttttcttttgaataaacaaaaacatttaaaagaggaaatttatcctaaataaaagatcataacatttgtgtttatattctaatgagattaagaaaagggtgtgcttgctgggcacggtggcttgtgcctgtactcccagcactttgggaggcccaggcgggtggatcacgaggtcacgagttcaagaccagcctgacgaacatggtgaagccccatctctactaaaaatagaaaaatcagccaggtgtggtggtgtgtgcctgtaattccagctactcaggaagctgaggcaggagaatcgcttgaacccgggaggcagaggttgcagtgagccgagatcacgccactgcattccagcctgggcaagagtgagactccatctcaaaaaaaagaaaagaaaaggaaagagtgcgcttgtagagaacagtgtaggcttattttaacagaagtttttgaccgagtgaggtgtttcatgcctataattccagcactttggcaggacgaggtgggaggatagcttgagcccaggagttcaagaccatcctgggcaacatggcaagaccctgtctctatagaaagttttttaaaaagtaaccaggcatagtgatatgtgcctcccaagcaacttgggaggttaaggcaggagtattgcttgagcccagaagtttgaggctgcagtgggtgatgacagggccactgcactccagcttgggtgacagagcaaaaccctgcctctattagttaattgaacaaacaaacaaatgttttcagtggaattttcttctagggatttaattgtgcttttgaacttgagtttactctgtattctaatttgaggtgacattgttcaaaatgattcttggcaaatgtaatccctactacccacttttcatgaagtataaatacctttgaaacagcatctcagttactgtgatttttttcattgtttcagataggtgatgttcagtggcggggcaggtggttaaaacctaaggtctgatctgatcacttataacttggttctgagtgatgaaggcaagttatataacacttagtaggatttttttattaaaattttcgatatgaaaattttttaattggatagcttgtatagtcaaactttgtacttcttaaataagttaatactccattttaaatgtcctgtttgttctgaggaaggtaaggatactcaattccaaacatttctttcagttaatcctttatagtatgtgtggtcctagaagtagatacatgaggcatttatttagagttggcattgggtcatgtaaatgtaagcccctatttgtacattaaataaaaagtaaatttctgttgaaatcagatcagacttatttcaaattggttgaaataatactgattatattatctaattatctaatctgttatcttgtacaacacacaaaaaagacgtaaagttagtaacaaaaatggtatatataattacaggtatagatttcccccctaacattttattaagcagtattaagaaaatgtagcaatattgaaatgattttacaatgaaacttgtatatccatcacctggattctgacattaatatatatcatactgatttattacatatctgttcatctgttcattcatcagtgcatcttgttttttgatggatttcaaagtaagttgcagataccagtatacttctccctgaatacttcaacatgtgcatgttattaactagaattcacaaatacagatttttagttttgcatattcctcatagaagaatctaaacggttgggtgtggtgattcatgcctataatcctagcactttgggaggctgaggtgggcggatcccttgagcccaggagttcaagaccagcctgggcaacatggtgaaaccctgtctctactaaaaatacaagaattagctgggcatgtagcctgtagtcccagctacttgggaggctaaggtgggaggatcacctgagcctggggaggttgaggctgtggtaagcaataatggcaccactgcactccagcttgggtgacagagtgagaccccatctcaaaaaaaaaaaaaaaaaagagtgtaaacatttaatatttcagatatttgagtaataagttagtaagttatggtaaatgaacttcataagaaattgcaacaaatttttactgagcatttctagcatctgtttttaactttgttatactttttgatgcttttagtggattttccagagatctgtttggttttttgttagagtcctcaccttggtttcatctctgatattttctttttcttttttttttaatttaaaactcatatatttttaagcctttgttttaaaacatctcatgttggccaggtgtggtggctcatgcctgtaatcccaacactttgggaggccgagatgggtgaattacttgaggtcaggagtttgagaccagcttggccaacatggtgaaaccccatctctactaaaaatacaaaaattagccaggcgtggtggcaggtgcctgtaatcccagctactcaggaggctgaggcaggagaatcgcttgaacctgggaggcagaggttgtagtgagctgagatcatgccactgcgctctagcctgggcagtagagcgagactcagtctcaaaaaaataatctcgtgttaattttgctgctgcttttttttgtctctccataattaaaacttaacgtattgtagcaaatatctacttctgatactagtttttttaattgaatttatcaacatatgtagaaattagtattatttaacctcttgactagctgttctctaaaaataagtctaaatgctaggacatccttacttattatatatagaaaatgtgactttcaaatgtgggtcatcttaagtatgctctcattggagacaagacttgtgagtattatgcttcatgtgtgatggtgtagttttccagtatactttaagattgaaaatgttgctcaggagacaattttaaaggatgggttatttgcctatatcttaattttttataactctacaaattctcattcaccttggtgaggcatatgtagaaacagtttaaattcttattcaggcatatgtagatagaagtttgtgctatttattagttggtgtatgtatgcattattatagagtaataaagaatcattttattttttgcttctttcattatgctttatagtacttacatttatcattttgatatttagtgcaaagaaatgtgctgcatgcattgagcatttttctacaagtttttttccccctgatgtgctatttcacatatcacaggccttattttttgaacaattgagcaaaagaaacagatgaaacctcatacaaaaccctccaaaatatgaaaatgtggggtttatttgtgctaatgctcttcttttggaaacatttgtgttaaaggtaaggtcaatttattgatttaaaccacattgtatgtaaaaatgtattatccatgattaaactttctaagacattgttcttgatagaaaagattttctaacttgtggaataaaaagatttattttgcaagtgtcagaaatattaaaattaattattcccaagttttcttaaatattatgcaaaactttgatctacagctttgacataattttctaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtgagtttttatgcaggatatgcatatgtgtatttctgtgatattatgttaaatcaaaaattttcttactgttgctatggataaagagaataaaaataattgttttccttcagatcttattaagtatctactatatgctagtcattattctaagtaggaaagtaggatagatcagtaaacaaaaaatcctactgccatggagtgtatatattctaacagggaaaaacagaccaaaaaaattaagtttttaatttagtgagttaattaagttaattaagtttttatggaggagccagcagaaggagactgaaaaggctaatacaataagcagttacagagttaattaaatggtttgttagaaggtgagtgatccagttgacccatgagcaatgcaggggttaggggcaccaaccctccctactcacgtgcaaacttaactaccacccaaaatacttaacttctaatagcctactgttgaccagaagccttactgataacataatatgtattatatactatattcttaacaataaagtaagctagaggaaatactgttaagaaaatcatggccgggcgcggtggctcacgcctgtaatctcagcactttgggaggcggaggcgggcagatcacaaggtcaggagatcgagaccatcctggctaacacagtgaaactccgtctctactaaaaatacaaaaaattagccgggcgtggtggcgggtgcctgtagtcccagctactcaggaggctgaggcaggagaatgacgtgaacccttgaggcagagcttgcagtgagtggagatcgtgccactgcactccagcctgggcgacagagcgagactccgtctcaaaaaaaaataaaaaatcataagagaaaatacatttactataccttaagtggatgtagatcatcataaagatcttcatcgtcattgtcttcacaccgacgaagaagaggaggggttggtcttgctgtctcgggtggcagagacagaagaggtgcaaggggaggcaggaaagatttattgacaaaaatcgtgtataagtggacctgtgtggttcaaacttgttgttattcatggatcagctgtagatgctaaaggcaaaataaatcaggttaacggggagtgggaggttgtaattgtacataggttgtgagaaggtgatgtttaaacagacagggtaagtgagttagccagggtatataggagaatggtattccagataaagggagtagccagtgtaaaggtcttaagttaggaacaagcttggtatattaaagaataagcaaggaagccagtgtggttgaggagagagcaacagaagatgaggtcgagtaagtaatattggtgccttgtaggctctaattaggaattgggcggctggaagtggtggttcaggcctgtaatcccagcacttctgggaggccgaggtgggcggatcacgaggtcaagagttcgagaccagcctgaccaacatagtgaaacgccatctctactaaaaatacaaaaattaactgggcatagtggtgcgtgcctgtaatcccagctacttgggaggctggggcaggagaatcgcttgaacccaggaggcagatgctgcagtgagccgagattacaccactgcattccagcctgggcgacagggtgagactcagtctcaaaaagaaaaaaagggaattgggcttttactgtgggtgaaatatggggctgttacaggaaaaggagatgctcagatttagatttctcttgtgttgtgagtatcccacaaggaggcaaagatagaagagttggagactttttcagtcatttaagcaaaagataatgatggttaggattgaagtagtagtagtagagatagtgagaaattaccagattataggtctgttttgaaggtagggctataaatgatacggttcaacaaagaagagggtagacagtggtgaaaaggccaaggaccagagagataggaggagccagcagaaggagattgaaaacgttattgaggccgggctaggtggctcccagcactttgggaggccaaggcgggtggatcacttgagactaggaatttgagaccagcctggccaacatggcaaaactccgtctctactaaaaacacaaaattagctgggcatagtggtgcacgcctgtaatcccagctacgcaggaggctgaggcaggagaattgcttgaacccaggaggtggaggttgcagtgagctgagatcaccccactgcactccaacctgagcgacagagcgagactctgtctcaaaaagaaaaaagaaaaagaaaaaaaaagttaatgaaataatgaaataagcagttacagaggaaagagagagcaagagagctatgatcctcatagtttaaataagtaatttttcaaggttcttttatttttgtatatatgaagtagaaatttaataacttctgtagctttccagttactgtttaatgtacatattttgtttacgaatatgtttaaatgttgatggaaatttttgaaagggtttagaagaaaatgttgttagtatttttaaagcctgtattaaaactcagtttttgtattaagtgttttgaaaatctaagatcatggttttaaagaatccatatgatttcttatggcttatattttaatattcttatttgtttatgactacaaatatgtctatgactgatagtgtcctaccttaatctcattaacatgctttcacattggtatgtgcatatatatgatcattcttccattttcatccctgtggaggtggaataaaggatgatggaataaaatactattcagactatctaattgcttaattgatgagtatgtgtttcagagttgtagaatttaaattctgtgtaattttcattgtggtcagttgtaaaatttctaaatatttagatattcagagtgataggcaaccctaccagtcaaggggtgctcagtcaagatcaccaaaaaaaaaatcatgcaggatgttcccagctgacctgggctacagagaatgaacatgtgtgtgaccagtgagggcaaaaaggaaagaactcctccttccagggtagttcatttggaggttgtaattacagtcttgattcaagtagggactgggctcagcagctaagccatttctgtatcttccagcaatcaggaattaaccattgatttttgtctttgccgtggcattttactgggttttttattttttctttctttctttcttttaatttttaagctgctcagggtagacagagctacactcttggcccagattgagggagggggtacgaggctctgtaaagcaatttctatattttgtcttcgaattaaaagatatttcccggccgggtgcggtggctcacgcctgtaatcccagcactttgggaggccgaggcaggcggatcatgaggtcaggagatggagaccatcctggctaacacggtgaaaccctgtctctactaaaaatactaaaaattagccgggtgtggtggtgtacgcctgtagtcccagctactcgggaggctgaggcaggagaatggcgtgaaccagggaggtggaggttgcagtgagctgagatggcaccactgcactccagcctgggcgacagagcaagactccgtctcaaaaaaagaaaaaaaaaagatatttccctggctggatgtggtggctgacacctgtaatcccagcactttgggaggccgaggtgggtggatcatgaggtcaggagttcgagactagcctggccaacatagtgaaaccctgtctgtactaaaaatacaaaaattagccaggcatggtggtgcatgcctgtagtcccagctactcaggaggctgaggcaggagaatcagttgaaccctggaggtggaggttgcagtgagccaagattgcgccactgcactccagcttgggcaacagagtgagacttcatctcaaaaaaaaaaaaaaaaaaaaagaatttcccttaagggatatcaattaagaaagtcttgttcaatacagagagctttctttcacactaattagtcattaactaatacactaagaaatctttgctttgtcacgcttatgaaatgcttggggacttagaaatctgtcttcagatttggagctctgtggcagcaggacttcaataagaaataagaggagctgatgaaaatggaagactatttcaggtccatttgattctattttgggcaattaattcactctgtgaccatgaggaaaacatttatttattatgtaattttctaaataccagtttttttctttctgtctgcatttacaggtaatgtttgaaacttaccagttttccggtgtatatgtagccatccaggcagttctgactttgtacgctcaaggtaggttaagcttaactgttagaaaaaacacttcatcaaacatttattatgtatgttttatgtcagagaatttggtttctcaataagttataagccccagaaaactacattatttatataccacactttgaaatattttcagtttttaaaatttgtgaaataagattttatatacatttttatttgctaaatatgtatttaaggtaaaaaaaaaaggcttaaagacttattttttaaaaaataggatattctctcttttaagctatttaaattttttttgagacagattttcgcttttgttgcccaggccggagtgcaatagtgcaatcttggcttaccacaacctccacctcctgggttcaagtgattttcctgcctcagcctcccaagtatttgggattacaggcatgtgccaccacacctggctaattttgtatttttagtagagatggggtttctccatattggtcaggctggtctcaaactcctgacctcaggtagtccgcccgcctcagcctcctgaagtgctgggattacaggcatgagtcaccgtgcctggcatagctattttaattttttatgcatggaatttgtccccagaattggcttgagttaaaaaaaatacgcagagattcaaaaaggtagcataaaatcatgcctgtcaaatatatagtagattaaaaaggagaaggtaaacatttgggagtgcatttctaacttttgaggtgggtttaatggaggggactacttatatattctcttgatattgccattagcaactgcctccctctttattggaaataaaatattggccacgttgggagagctcttttttttttttatggtcttataaattcaacaggaacttactgagaatgtctgggcctgtcagatatgtgccaaggagtcttttaggcacttcaggggataatccagtgggaaaagagtgtggcactggaaatgggtcaagtgtgtttggagaaaggccagtatgtgtgtgacctgatggaagtggtagaaaataaggtgaggtgggtagggagggctctttgggaaataaaatgtaaattcttgcattagtcagtgttcctgggagtatttttgaattgatgatggtgtgaattcctccttttttttttcttttttgcaatggaaatcctcttctttttaaaagagtacaacattcaagggctgtatatgagttttatgaggcttattgcatcaaggaattatatccacttaaaaaggaggtagttttaggccgggtgtggtggctcacgcctgtaatcccagcactttgggaggccgaggtgggtggatcacgaggtcaggagatcgagaccatcctgactaacactgtgaaaccccgtctctactaaaaaaaaaatacaaaaaattagctgggcatggtggcatgtgcctgtaatcccagctacttgggaggctgaggcgggagaatcgcttgaacccaggaggcagaggttgcagtgagctgagattgtgccattgcactccagcctgggcgacagagtgagactctgtctcaaaaaaaatatgtaaataaaaataaataaaaaaagtttttttgaccaggtatggtggctcatggctgtaatcccagcactttgagaagccaaggtggtcaaattgctgtatctccagagtttgagaccagcctaggcaacatagtgagatccctatctctataaaaagtaaaattagctgggtgtggttgcacatgcctataatcccagccacttgagaggctgaggtgagatgatcacttgagcccaggaggttgaggaaacaggggaaacaaagcagcttctttgctgttcttttattatgaggtttaactgacattgccttttattataagttccagtgaataatcaaagtgatgctttggctagccatgtttaatttttcttagatttctagctgtctagtatcaataggcatttttccagaacacacagtatatgttatttgtagtatattcaaaactatctaagttgaaaaaaataaagaattgtacagagctttaagaacgtgttctgctgggtgtggtggctcacgcctgtaaccccagcagtttgagaggccaaggcagacagatcacttgaggccaggagttcgagaccagcttgggcaacatggcgaaactctgtctctacaaaaaaattacaaaaattagccaggcatggtggtgcatgcctgtagtcccagctgctcaggaggctaaggtgggaggtatgacttgaacccaggaaatgaagattgcagtgagcctagattgagccactgtactcctccagcctgggtgacagagccagaccctgtctcaaaaaaaaaaaggaaaaaaaagtcctgtttttcagtcctcagtctcagggtctgtttcttctcatctccttggacagcacataatagtagactaaaagtcttaaaagagaacactcgctttaatacttatgcattagaaacaaactgcaaaataactaaataataaattctggcttctagttggttacgtttctgttttggcttccctactgtatttggaactcgctggctttggttttcctgatttgactttttatttaaatccccctggcttttatgcaggtttattgactggtgtagtggtagactctggagatggtgtgactcacatttgcccagtatatgaaggcttttctctccctcatcttaccaggagactggatattgctgggagggatataactagatatcttatcaaggtaagtgaaaggaaaatatcatggaaattaaattttgtaatttgtttaccaccttaacacagaattgaatctatcgttttaggattccagcaaatctgtaccactagagaaattatccaattacctcccttatttatataaaaattcatataagatttatacacatgaagaaaaaagaagatacattaaaaacaaggaaaaaagtgtacacacatgatctctgtatactaatgagagtacattatatcattacataattatatttgttattcctgaggagtgagtagacagatatttcaaggatagaagagacccctaatttgaaactttcttggacagctcaggcagccttttctgccataaaacctttctttgagcaggtatgttttaagccatgatcttggttgggttgtctgctcttgtcctttcctacaaaatacagtgatagcaaattaatgatatttgaggaaaacagcccaaatacgccagactttaatatttagtagttttcatggaatagatgcagtttttaatatttactattttagtttatttctgaatataactagttataattttctttaaaacattactggagaaagtacataaggtgtctacttgctaacatatatcatttttaatattaaaataaaatttagaaaattgtttataccacaattctataatcagtctatcctctccaggacagtggttctcaccaggggacagtgctgtcctctgggggatattagcaatttctggacacatttttggttgtctgagctgggcaggaatgctactgaacattctataatgaatagggctggctgcacaacaaacaatgtatagtctgtcagtggtgctgctattaagaaaccctgtctctgcattaaattgggttgcactgtctttaccttgacattgggttccttcagtctcatttaaagtaatcctcctcatgaggggagattaaattaatgagaattataatactctcattttaggccaaaattcaaagcgtaactaacagaatttctggggttgtctttagaacacagactcaaatattagaggattttttttttatttgtaaagtctagtaattttttttctctcagtgggtttttaaaaaaatagtagtattttctagcatttaagaaatgtaacaatggagattatacctttgagtatcccaataattcccttatcattcgttaaacaaatgctattgtccttctaatatgtgccagacacagtactagaagctaaagataaaacttttaaagacttgggggcatttcataaatatggcattaattgtgtgagcaaactgcaggctacaggagtccagtactaaaataatatttattcattaatatacttttgattgtttatcaaaactatcaaaacattagtactcatgcagtgcttttcaaaaactgacttttctagtcattttactgacttacttatgaattgttaattcttttaccctctctgaaactgaaatataaatccttttatggcggataaaatcctgcttctgaaatagtaggagctgaggatccactgcccattctgtttgttattgatgtgacatatttaatgagcattactagcttttgcagagtagaactcattcagatgtattatgaacttattgctattgttttgtaccagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacagtaagtgtttccagtgtataatatatatgtgttttaaagtggacagccatgattattggtgtcagcttaaggaggttttcttagaatcagtatttttgtcttgggttgttgtaatatgtatatgtgtgacttttaatgtctctttctacattaagtttctatttaattattttagggcaccatataatgcaaattaaggcaagaatcataaattactctctatactaggatataattagatgcgagatgttattttgagattctagtatttggcatagcatttctcaatgtatgttttacagaactttatttccctgagatgctaataagcatttcacaaaaattaaaaaggattacattgtcagatgagtttgagaaagagttgatttcacttcactgtagaactcagagcctttggtatgctaatatgggcacaattaatatagtatgcgtgtttttcagacttatgctctaggacttttcagaatttcatgggattagtgatctaagaaacatactttggaaatggtcattctagagcattgctttactaattcagtaggtggcagcctttcctgacttaatattctttaatgaggtgttaaatgttaacttgaaattgtaactaatgagatttagtacctggttatagtttataacaccagaggagttgatcctacttgaatttttaatgaattaccatcttaagcctattaaatttgtctgagtataaagtacttccaggtctcatctttgatctagttattactaaaatgaaacagtaataggcaatgaaggcaagtattttaaaaccatatgatgcatactagctctacatattcacaaatatatgcaaaatagtcatttttaaagtaattataaaaaatttgttgttggccgggcgcggtggctcacgcctgtaatcccagcactttgggaggccgaggcaggcggatcacctgaagtcaggagttggagaacagcctggccaacatggtgaaacccgtctttactgaaaatacaaaaaattagctgggcaaggtggtgggcacctgtagtcccagctattcaggaggctgaggcaggagaattgcttcaacccaggaggcagaggttgcagtgagctgagatcgtgccactgcactccagcctgggtgacagagcaagactccatgtcggtaaaaaaaaaaaaaaaaaaaaagttaagatagtgatccaaatattcagtaaacccccatttaaaatttttttaaatttattttttattatactttaagttctgggatacatgtgcagaaaatgcaggtttgttacataggtacacatgtgccatggtggtttgctgcacccatcaacctgtcatctgcattagatatttctcctaatgctatacctccctccccttgccgccccccacccaacaggccccatgtgtgttgttcccctccctgtgcccatatgttctcattgtcagctcccacttatgaatgagaacatttggtgtttggttttctgttcctgtgttaatttgctgagaatgatggtttccagcttcacccatgcccctgtaaaggacatgaactcattcatttttttatggctgcatagtattccatggtgtatatgtgccacattttctttatccagtctaacgttgatgggcatttgggttggttccaagtctttgctattgtgaatagtgctgcagtaaacatatgtgtgcatgtgtctttatagtagcatgatttataatcctttgggtatatacccagtaatgggatcgctgggtcaaatggtatttctagttctagatccttgaggaatcaccacattgtcttccacaatggttgaactaatttacactcccaccaacagtgtaaaagcgttcctatttctccatatcctctccagcatctgttgtttcctgactttttaaggatcgccattctaactggcatgagattttgtggttttgatttgtatttctctaatgaccagcgatgatgagctttttttcttatgtttattggccacataaatgtcttcttttgaaaagtgtctgttcgtatcctttgcccactttttcatggggttatttgtctttttctggtaaatttgtttaagttccttgtagattctggttattaaggctttgtcagatggatagattgcaaaaattttttcccattctgtaggttgcctgttcactctgatgatagtttcttttgctatgcaagaagctctttagtttaattagaacccatttgtcaattttggcttttgttgcaattgcttttggtgttttagtcatgaagtctttgcccatgcctatgtcctgaatggtattggctaggttttcttctaggagtaaacccattttgtaacttaatcatctccagatttgctctggagattccttcctgaagtcttcttgacagtttctctagttgtctgattttccatctacctgactattttggaagaaagtggctggcacagggcaaaagataagcaaactaggaatgtaaaacatgttttatttcttccttctctcttttctcaaagaatttgaggtaggctacaaaaatatatacaaataggctgggtgtagtggctcacaccggtaatcccagcactttgggaggctgagatacgaggatcacttgaggccaggagttcatggccagcctgggcaatataatgagaccctgtctctacaaaaaaaatacaaaaatttgccaggcgtagtggcacgtgcctgtagtcctagctagttgagaggttgaggtgggaagattgcttgagcccaggagttcaaggctcaagttttgaggcagagagctaggattgcaccactgcactccagcctgggtgaaggagcgagaccctgtctcaaaaacaaaacaaaatccatatatatatttgatatatatatgcacacacacacatatacacaagtataaagtaataagctgatgaataagtgaggagggacatgggtggacaaatacagaacaggataagatttggtgcaaagaaatgggatgcctgcagttttaacagttcattaaggtgattagaaaacttgaccccatgctggccagcagccagagaatggagagaagccacactatcaggcttcaagtgcttaaggcaggaggttttgctaataagatctgctgtgtgaagtttttccagatattttgggtgatttcatgtgaacccacctgaaggtggaggtggtttttttaagggtataagttttggtaaccttttttttttctttctgttttgagacagggtttcctcactctgttgctcaggctgcagtgcagtggcatgatctcggctcacttcagtctcaatctcccagggttaggtgatcctcccacctcagcctcctaggtagctgggaccaaagctggaatctaaacaatcattgtaattggccaggcgcggtggctcttccccataatcccagcaatttgggaggccaagatgggaggatcatttgagcccaggagttcaagaccagtctgagtaacaaagcaagacccccgtctctacaaaaaataaaattagccagccatagtagtgtgcatctgtagtgccagctacttgggaggctgaggtgggagaatcccttgaatctgggagattgaggctgcagtgagccatgatcacaccactgccctctagcctggacaacagatgaagaccctatctcaaaaaaaatatatatgtattgtagggccaggcatggtggctcatgcctgtaatcccagcacttttgggaggccaagccaggcagatcacttgaggccaggagctcgagaccagcccagccaacatgcagaaactctgtctctactaaaaatacaaaaattagccaggcgtggtggcacatgcctgtaatctcagctacttggggggctgaggtatgagaatcatttgaacccagtaggcagaggttgcactgagccacgatcaagccactacactccagcctgggcaacagagcgagactctgtctcaaaaaaaaattaaattataaatgtactgttagacttgttaatgtaaaattaattctggtatctcatggaaatgtgtcaaatgctagcatacatgggcgtgcttattacttaggacaatccagtgaattgtgaggtgttatgagaggaagtttctacttaacacttctcatttaattaaatatgaacatgatgtgtgactgacaagatttttttgtacaaagtcataatatgatacctgatttgtttaaatcttatttgcttaaattgaaattatatttatcagttacttaaaatgtattaggacctagtaggatacaacagaattgcctaataaaaatagtctagaccagtgttctgtaaacttttttgatcataagacattttttggattaaatgatttgatagaagtggtacacatgttataaagtattttggcaaaataatagtttcacagagtaattatttgatgaaataaaattatttaaaatgtttaatgtggctaggcgcagtggttcatgcttgtaatcccaacactttgggaggttgaggcgagcagatcacctgaggccaggagttcaagaccgcctggtcaacatgatgaaaccccgtctttactaaaaatacaaaaatatgctggcgtggtggcacatgcctgtaatccgagctactcaggaggctgaggcaggagaattgcttgaacctaggagacagaggttgcagtgagccgagatcgtgccattgcactccagcctgggcgacaagagaaactctgtctcaatcaatcagtcaatcagtgttttaacatgtctgttctacatagcagaaatatccataaaatcacaaatatgttaaaattataaaactgtagtaacacataccagcaataatcaaaatacaatggttggtcagtgatgcttgtttctgctttgctgcaaacatcatgcactcatgcatcagtgatttctccaagaaattcctgatatttgggggcgtggcataccttttttttttttttttttgagatggagtctcgctctattgcccctgctggagtgcagtggcgtgatcttggctcactgcaagctctgcctcccgggttcacgccattctcctgcctcagcctccccgagtagctgggactataggcgcccgccaccacacccggctaattttttgtatttttagtagagacagggtttcattgtgttagtcaggatggtctcaatctcctgaccttgtgatccgcccagctcagcctcccaaagtgctgggattacagacgtgagccaccacgcccagcctggcataacatttttaaaagcaaaacagaatgtgataagagcagttacctaaatctatttaatttacctttttttccccaaatatattttaggaaaaattgttgttggtaatgattttggttacagaacagatgtatttataagtactagtgttccggagaacactgggaaattttaatcttttgctgattagtacctgattattcttggtttctagctcccagatggacgtatcatcaaagttgggggagagagatttgaagcaccagaagctttatttcagcctcacttgatcaatgttgaaggagttggtgttgctgaattgctttttaacacaattcaggcagctgacattgataccaggtacattagaagtggtgatttcaaagttatttatcagaaaaatcataaaaatagttttaaagttatttatcagaaatagatggaattaaatagaatgactaagtttataaacttacttgaaataatttcagacttacggaaaggttgcaagaaaaatgcagaaaacttatctgtatcctttatctggatttaccattttactaattctaatgttcttcatgtttgctttttcattctgttttttctgaaccgtttgagggtagattaaatgcatcagttctttactagttggtgtttcctaaggataaagatactctcttacatagtcatgctgatttcagatcctttggagatacacccagtagtggaattgctggatcatatggtagttctatttttaactttccgaggaacctccatactgttttctgtaatagctgtactaattcacactcccaccagcagtgtacaagggtttccttttctccacatcctcgccagtattcgttacctttcctctttttgataatagccattccaacagatgtgaagtgatatctcattgtggtttaatttgcatttatttccctgatgattagggatgcttagcattttttccatttgtatgtcttttgagaaatgtctattcaggtcctttgcccatttattaattgggttatttgctttcttgctattgagtcatttgagatttgagttccttacatattttggatattaaccacttatcagatgtctgatttgcaaatatattctcacattctataggttatatcttcactttgttgattaattcctttgctgtgcagaaacttcttttgttgttgtttgttttttgagacggaatgtcactctctcacccaggctgaagtgtagtggtgcaatcttggctcactgcaacctctgcctcccgttttcaagcgattctcctgcctcagcctcccaagtagctgagattacaggcatgtaccaccatgcccagaatttttttttttttttttgtattttttagtagagatggggttttgccgtattgaccaggctggtctcgaactcctggcctcaagtgatccaccccacctcagcctaccaaagtgctgagagaaacttcttagtttgatgtaaatgcatgtatatttttgttagatattgccaaatttccctctctggcaattgtatcgtttatccttttccaccgatctgatgagtgagaaattatttcagtgtaattttactttttatttctgtcattaagagtgaagtcaaaccaggggtggtggcttctggctgtaatcgcagcactttggaggctgaggtgggaggtttgcttaagcctaggagtttaagaccagcctgggcaacatatggagatcctgtctttacataaatttttttcaaaaagattagccaggtatggtggtggtgtactcctgtagtcctagctactcagaaggctgaagtgggaggattgcttgagcttgagaggtagaggctgcagtgagccatgattgtgtcactgcactccagcctgggtgacagagtgagaccctgtctctccccaccgccacaaaagaaagttcctaaaaaaaaaacatatatatatatataaaacatatttttatatgtttaagggacttgtttgtttgtttgagatagagtctcgctctgtcgccaggctggagtgcagtggtgcagtctcggctcactgcaacctgggtggagtgattctcctgcctcagcctcccaagtagctggaattgcagacgtgagccaccacgcccagccttaagggacattttaaatttttttttttggcaaattgttaatggctttttgtagattttggagttttgggtttttttttttttcagttttgaaaagttttcttttagctttctgatatctttcacagatactctctctgtttgccatttgtctattgctcttagtgttttggccatgcaaaagtttgtttttatttagtcatataaaaagatttatagtcttattacatctagagcttgagtcatagttagaaatcccttctctacactcaggttatagaggaattcacccagaagcattttgtacagcaagcatttatttgtgtaaccctgagttaaatagccacctaattaattttgatgggatggctttggagccaggatagtaatagaaattaataaaaatagcaattgactcataacaagctataaacctggtagaagatgatcagaaatcgaatctagccttcataattatggtaaattctcatgatagggattagggagatgattttgttctttgatgttcattcacagcaaaattgtatttaaaagtacatgccagctgggcgcggtggctcacgcctgtaatcccagcactttgggaggctgaggccggtgaatcacgaggccggcgaatcacgaggtcaggagttcaagaccagtctggccaaaatggtgaaaccccgtctctactaaaaatacaaaaaattagctgggtgtggtgacgggtgcctgtaatcccagctactcgggaggctgaggcaggagaatggcgtgaacctgggaggcggaggttgcagtgagccgagatcgcaccactgctctccagcctgggtgacagagtgagactctgtattaaaaaataaaaaaagaaaagtacatgcctgttgctgattagagcttcgacgtacctaaagtgcggagtcagattcagtaccttctccacagagtttgcattgcaaagtggaacaactcaaattttgttttgtgtgttctgcatgttgaaaatgtacatgtaaatgcttgtgagtacttatcacatgaatctgtatttcaactgcttagtttatgcgacattcactgggcttgctatggcaattaaatacaaaagcaatgctttgttagagttgcagtagctttagccattgagaacctggaagccaggttgaaaaaggccaaaatgggtgcaaatcagctcccaaactttactgtgagaattattcctcagaccctcgctcagattctgttacttttactacatatgcagtctttttagattggattttctgatctcatagatatcagaatagagggtactgctgtcagtagatagcagggtactgtatcagaaaagagggtactgctataagaagcatacacatcagtctagccaaaaataacagcagacagcctctaagcaaaggaacaaaaaagaaaactacaaaagataaatgaaaaattaaaaagcaggaattctggattaaagtagaatagggctaattatagtaaacaaccacatcttagtggctttagggaagcatgtgataaaatagtttgtaatgtaaatcttggtcattattagaagtctcagttatattcacaaaaaagtgtattatatacttttagaagtattttattttcatcaaaattatgaaaagattttatatgtaaagaggggtcgttacttcacagtagtaataacagcaaatattcagccctgtgatttacatgtggaattttatttaattctcccagcaaccccgaggctgacataagtaacagtaaccctgagataccattttcctaacctaaaactccaaatgaataaccattgtgcctttctagatctgaattctacaaacacattgtgctttctggagggtctactatgtatcctggcctgccatcacggttggaacgagaacttaaacagctttacttagaacgagttttgaagggtgatgtggaaaaactttctgtaagtattagtaaatcaactattactaacattcttttaaaaggctatacagtagtttgtgaatcttgacaaccaccagagggagcaagacgtcttccaaaacaaattcctactgcagtcaagtgcatcctggaaatgatagcaagaaggaaatagttcaagataagctctggtcacctctatagagttggtggatggaggcagtgaggtcagggccaaaagttctggttcatctgtaacaaccagcacggactctgaggcacctgtatatgcatgagaagaacctgctgtactatagggaaataaatgccccacttgagttttgttctttttttaaacttattttttggatatgcaatcagccttcagcacttctcttgggctatctcatatttctgactttatttgttgcatatgttgtcttctcagtcagattgaaaaacatcatgtctcaaaattttttgcattccggtgactgtcataactcttgaaacagactttaattggttgttgttggtatgtacagtagaaagaaatttttaaactagaaatagttgatgtttctttggcataggtttttgtgttttttccaccagactctggactatgtgaagtatacagtatgtgctgtatacttaaccaagagttatctaatcctgagttaatctctgagctttgtctcactgactttgatcaactgttttagataatgagattatgtattacagagtactgtatgttacatctttcatatatgactcattgttgaaattaaattgagtatgggctcacatacattaaacagattaacagactggaaaggagccatactgtctaagtacttcacttatttttctgattttattgagttttacatataatttataattaatctcaggtgatcatttattcagcaaacatttcttgaactcctgggtgccagacataggtctaggtgccggggacaaacaaaacaatgaaaacagaatccctgcttttagtctaaataatgtattagtggtaataagtgatatgaagaaaagtaaggtgaagagctggaaaatgttagtggttggggaggtagtgtgctccttcataaactgtgatcaggaaaggccttttggatgaagtgacttttgatcagagacctaagttgagcgtgagaggagtgagccttgtgactgtctgggggaagaatcttccaggcaggaaaaatgcaaaagccccaggttggtgggagtgtgccagtgtggctggagcagagtgagcaagggaggggggcaggtgggatatgaggtcagaagggtagcaggagggcaggtcttgttcagccatggtaaagggtttggcttgactcctggtgaaatggaaagtcttgggtgtgggggcggtttaagcagagaaatgataggatctgatgtatatttttaaaggatcattaagtctggtgtggtgaatagactcttgggggaagagggaacaaaggtgggcatagagagaccagttaggaggcactgagaggaggggagggatggtagagttttagaatagaggaggaggttgaaatggttgttttggagaatggaagcgagaatagagaaatgtaataggattgccatgcagcaggaagggctcagttgaggttagtgatacattatagcaagatgttttgtttctttcctatcttgttcagctgcttgacagcaggtgcaatttgtctgtaggaatctgtagatgagttcagcaaggagggagtggtagatggaatgatctgatagaatgagtttcagtggggctatggagttttagggatgagcgagatagaagcagcaatgaagagcaataactcatattaccaaacctccagggttaaggtagtgtgtgagagagaaacagtaaagcagttgaggtatttacagaagcagtgtcttcaggggctagctaagtttcccttagagtagaggtggtcatctatagcccttatgccaaaactggtttgtttgttttttttaagttttattggaacacagccaagcccatttgtttacataatgttacctgttgtcacatattgtctgtgggcaccttctagctacatgtggggttgggtacttgtcacgcctacaaagcctcaagtatctggcccttcacaaaaaaagtttgctgacccctatgtaagagcaagaaagtaaaaggaacaattaaaacagtctcagaattggtaaataaactgatgtttttctttatcttggattgttagaacccttacagttcatttatgtgacataaatatacaaatgatttagaatgacatagttacattgggtcttttttgcagatcgtgatactgtaaatgaaaaacttgctatgtcattttaaggtttctctttcaggtgttgaccaaccataaagataaggatgtgtccttcctagacacttaatagtagctacagagtataaaacttttcccaattgcctttaattttggttactgtgttcattttctcataacatcctgatgatttgttttgaccatatttggccttgtttattttaagaacatttcatttgattttgagacaatagaaagtaagctttgcttaaaagaaaagaacttcagttttactctattgccctggactagaatcataacagtatgagaccttgaagaagtcatgcaagtcctcttttttttttttttttttttttttttttgagattgagtctctgggctcactgcaagctccacctcccaggtttacgtcattctcctgcctcagcctcccgagtagctgggactacaggcacccactaccatgcccggctaatttttttgtatttttagtagagacggggtttcactgtgttagccaggatggtctcgatctcctgacctcgtgatccgcccgccttggcctcccaaagtgctgggattacacttgagccaccacacccagccatgcaagtcctcttatccagactttgcttgacagcaaagtgactttcccaagtggtcatctgccattggatgggaaatttgctctaattatgtcttggatgtttggtctctcagtagggtgttaagtcatgtaatttactgatcaaattaggacactcaagaatggaaagggtggtattaataatgatgggacaccacgtgtaaatcaggactgttccaagcatgctgggatggatgtgtggtctcctaaacatgagctttgggcaaattactaaatgtttctgtacctcaggtaccaaatattacgttctacttatattacaggactgttgcaagtttgagggagagcatatatttaaaaagccattttcataaagcagaaagcactgtgcacatgtaccatttcattatcctttctttctcctttagaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtc

SEQ ID NO: 35653 - DNA, 12518 bp, Homo sapiens
cgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggtaagcgcggcgaccccgcctgcacgcgcgtctatcgcgggcgtcccgcccccagcccggctccgcccccaccccgactccgccccgcgtcccgcccctgacaggctccgcccctccccgccctctagagccccgcccctaagtgggcccgcccaaggtgcgccccctctgcccccgcgaagcgcgctgtgccgcgagctccgccccctccgggcctggccacgcctccgctccacgcccgtctcctccccagctgggaaggcgcgcgcccagcgcctccttgagcgcccggtgtcgggccccgcgctgctgctcctgcagagcgcggcgccctcggatcccgccccagcagtgtccccgaagcgtctttgcgtgctcctctcctgagtcattgctggttggggtcgccctctcccccggcatcgccctgggtgcgggatcctgtgtcgagtgcacggagtcggctcgggaacaagcgtctggggttacccccaaggggcgcgctctgaggggcctggcccctgtgagcagcactgccgtccttccagggcgcccatcgcgaccccggtattcacccacttctccgcatcgtgtcccggccatcgcgtcccccagtgtgcgcccacccctctccttcgtgtctccccaatcgtgccctcagtgtgcacctactcccacccatcgcgccccgtgtgcacccaccgcctccatcgcgtcccccggtgtgcgcccacccctccccatcgcgccccccggtgtacgcccacgcctccccatcacgccccccatggtgtgtacccactcctccccatcatgccacctggtgtgcgcccacccgtccccatcatcgcgtccctggtgtgcgcccacccctccctattgcgtcgccctctccatcacacccccagtgtgtgctcacccctccccgtcgcgtcccccagtgtgcgcccacccctatccatcgcgtccccctttccatcacacccccagtgtgcgtccacccctccccatcaccccctccacgatgtgcgcccacccctccccatcacgccccctatagtgtgtgcccacccctccctatcacgccccacggtgtgcgcccacttctctgcattgcgcctcccccaccatgcgcgcccacccctccttatccagccttgggtgggctttagtctcccccattgccatgctggggtgtgcctccctccagtctcagtcctggggtatgcaccctgcattcaggtgcactggccattccttctcgggagggtctgtagtcgcattctccagtgttcataaaaagagaacctttccgaagcccttggtgtgcactgtcggcctctatgttacatcccagtggaagatgactagagctgaaggctctgtaaagaggctgtctctgatactggcctggtcctggaggtgaccaccctccctttacagatgagggtggaggctcagtgccagacactggcgggaagtgggatggaaccgtcaggaaccatggtcgcggcctctatggaagtctgcactctgcttgctgtggtcagactccagggaaacctgccctatccagatggcatttggggtgacctttgctttttacattttgactccagtgaagtcaaagttctcccactctggggttgtttgaatatttaaatacttgttaaaactaggtcaaatataaatgtcctttatgtttttgtaggtggcttcctcttaatgaagagtaaatgtaataaaatacatatgatattaattttctcagcagtatttacacttagctctgccatgtggtcaatctcaggctccagttccgttgaaaacacttgtttaattccagaatgactgagtggctgccacctcacaggccccgcttctggtgggtcccctctgagcccatgtgggagcagctctgccctctggggctctgacgaaggggaagaggtggactctggggcccggtggtgctggaaagaagagcttttaggtcaggcaggagaatggttctgacttccctggatagctgaggtggaggattgactgtagcaaactgaggcccatgtttttagggcttcactttttaactcacgagttcacttgcttattaggaattcaccaggggtctgggacagatcgtcattctgtttggagcagaggcactgtggccggccctgccctgccccagcctctcccggggctgcagccattccccccggggctgcagccattaccctgtgggggacgtctgggccctgcatctgtgcctttgaacacactcataccttccttccctaaagaagccagtgcatcctcatgcttggggaagtgaagggggctcatgcaggggtccccacttccatcctgcctggagctgtttgcatgctcttccttcctaggccagttgtctctgtgctggaggccacattcgggatggggagatgggggtgtgccagctcaccactcaggctgccgccaagccactggcatcccgggagtgggcaggggtgtctggcccaagactggagtcggggggtgagtgccgccccaggacacgcaccttcaggctcgcagctggagcccctcactgccaaggccccttgcaggccactctagctcccttgacagagcaccatgcctccccagggtctccccagggtgcataccccagggaagcaagcatgggtgcagtccctgggttcaccctcaggcgagccttctacatcccactccctgtatttaggcatcgctgggacagttgtccctctcccagccagggaaggaaaggagaagtggagagaacaggcgtgtgatgtacagtgcttcctgagggcagcagctcagcatggggtgaaagggtaccaggacgccccagacttgactttcagagtgagccggagggccctgcctcattgcttcactcacaaacgactttatcccagcagtgcaggccggcagaggggtgccccacttttcggctcagactgagctgccccgaagttggctcccagtctcttgacatcagctttttgcctcaactcaaaatgcattttcaggcaacaagacaccccgattgtgccattgttgagtagcttcaagtatggcatgaattaaaaaataaaatagtaccacctactgccgctcagataggacagtttgaaaccagaaagtactcggaggtggcttccctcacatttgctgatgtcagggcagcgagaaggagcctggccgcctgctgtggggagtggccgtcctcagttggattcccgaaatcaccacttgaatgtcccatagggttcctctgagtcacaaatgttttcttctgtttttggtttcttttactagtgctgtatagctgcatgacttttggatatgtgtttttactggtttcataagaattttttaaaaaagagatggggtcttgctctgttgcccagactggtctcaaactcctgggcttacgccatcctcccacgtcaactcccaaagtactgggataacaggtgtgagccactgtgcccagcccacaagaataactttaaaataaagatggattttctcttatttttccctagactttgtttttttctttgaattaacaatgtcagaggaccctaggcttgcattgttttacacatggatgcttaacaagtggaagttaaaaataaattctgtgtaaaaataaaaccatcacgagtgactctgaattgctggagaattttaagaattaggttggttttgatgactttaaaaagccaacaattacctaaagacttgcccattcaagtcgcggttattttgagacacagttttgaggccagtctctggtgtcttctgcaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgaggtgccctcttcgtggatgggcaggcgggggcttgtgctgtaaaattagtccaggctgggcttgtcccccatggccttttataaggtggagggacctagaggctcggagaagtgtggtgggtttttcttcctgacagggcggctgcccggggtgctgtgttctccatggggtactaacatctgtgaagtctgtgatgctgaaggctcttgggggccctgctcaggtctggccattctggggctgcaggtggcgtgtgccccacgccgctgtcaccctgtcctcgcgtatgagctggcctgaccctggagagacactgccctcatgtgcggtgtggttttccattttgttaggaaaggcaagaaagcgcgtgattctttccccttcttccccagtttcaggataatgagctgccccactggcagtgcccagctgggtggatgccttctggctgctgtttgtgacgtggtgtgtgtgtgtctgttgttcttggtaacgctgtggcggactcaccctgggccagggggtccctctctaggccacttttatgggctttgcccaccagctgctgcctggtgtgttgggggcccggccctgcagccaggcgcccttccccagggagccctgcttgcctgagtgggacctagaggctgcttttcttcagccgctttgaaaatacagcaactcgttgcccttttattttactcttttgcctgtggattttcagttagatttcctcctctttccctcccactttggataccctgctcataggggcagtcactggcgactgccttgcattctttattggcaagcagcccctgacttcctttctttgtgtttgctgagggcagatcttattttcacctgcgaaaggtgagactgagcttccagacacgcaggtcccggtcttcccagcagagtgagtggcctggcgccgtgtaggccccgtgatccagcctctgcctgatgctgggccctggcccttgctggagtttgtactgcctgggctcgtggccactgtgtgtgtgacttcccgggtgcccatgttctcctctgcgctgcgggatggcaggcgtgtggggccgtgtacatgtggggggggctctgcccttccccctgctctcccggagctcccctcctgccccacctgcactgctgcttgtgaggctggctgctcagccgtggtccagggcctcctgttcaaatccttctagaaacttgggttctctcttgggtgtttcctggattagtcctcctcccttttgtgttttgtggtggagcacatcctccagggtcttgtcagaacgggcacagaagggcagcgtctttgagacactgcatggctgaacgtgacttttgcttttataaaccttcacacttcagtatgtggctgcacgtaatattctcggttgaaacttttttttcttttttatttcagaggtcagccatgagaatagctcccaatgttaaaagtgaaaagttcaccaggcatggtggcttatgcctgtaatcccagcactttgggaggctgatgtgggaggatcacttgaggtcaggaattcaagacttgaggtcaggagttcagtgccaagcctgggcaacacagggagaccctgtctctacgaaacattaaaaaaattagccaggtgtggtggtgcaagcctatagtcccagctactcaggaggctgaggtgggaggattgtttgagcccaggaggtggaggctgcagggagctgaggtcatatcactgctccagcctgggtgacagagcaagaccctgtctcaaaaaaaaaaaaaaaaaaaaaaaggtgagaagttcagtggattctgattctctgtgctttgtttgtaacttggtttttccctggaagtatctgggaccatattctggcattcagtgtttccttatgtgcctcagaggtgggtgattttctcactcatgctgctgggcactttatgggtctggacgtttatttttattcaggaaatatgccttatgttagttctctgataatttgtatccttctccagactctgttccctctttttggagttcctgttcctcctgctgctcattgtcctagatattttaaatttgataatttttctcccattttgctttgggctttattgttgcatttgggcttctttccgggaggtcatttcaactttatctttccacttcctgtggacattctcatctctgtcatgatttttaatttccaaaagttcttttttctttctgttctttgagtgttctttttttctcagtagcaacttattttttttgagacagggtctcactctgtcccccaagctggagcgcagtggtgtgatcatggttcactgcagccttgagccctggggctcaagtgatcctcccacctcagcctcccgagtaggtgggactccaggtacacgccaccacgcctggctcatttttttattttgtggagatggggtctccttatgtggtccaggctggtctggaattcctgggcttaagtgatccttctgcctcggtctcccaaagtgctgggattacaggtgtgagccaccgcacccatcctcagtagcaattgattgttttctgaaggtagtagtattttttacttcccatagaatttgaatcgtgagtgtaggtgtgtgtggtgtgtatgtccgtgtctttgtgcatgtgtgtgtatgtgtgggtgtgtgcctgtgtgtgtatgtgtgggtgtgtgcctgtgtgtatatgtgggtgtgtgcatgtgtgtgtatgtgggtgtgtgcatgtgtgcattcgtgtgtgtgtatgtgtgggtgtgtgcgtgtgtgtatgtgggtgtgtgcgtgtgtgcatatgtgggtgtgtgcatgtgtgggtgtgtgcatgggtgtgtgcatgggtgtgcatgtgtgggtgtgtgcatgtgtgtgggtgtgggcatgtgtgggtgtgggcatgtgtgtgcctgtgttgggagtgttctcctgcctccttcctgtccgttctcctctgcgctcctcccctcctctctaggctgctgcacagtgagcctttccctgactgctctcacgcaggctgacttctgtgcaagcatggagcaccgagaagctgctgaaaagctgtgtacatggatggctgtgctgccagggctgtgcatccacatggggtgatctgtctggattgcaggttctggaggcgcccagatgctacagtttgagagttgagtcctccaggctccggccagcctcctggaggcgcatctggaggggagaggggacttggcgcacagtgttgagggcacgcgctttcgtgggcctgtttccgccctgcgcctggagctccgcacccaccttctcagaaagcacatctcatgtgtgctgccgtgggaggcacagggttgtgggggtcctgcctgaggggtctgcatgtgaacttccaggcagctgttcagaatcagctgcctgccacagctctgcctcacaggttggggcgtgcccagtccctccgccctaggatcctggtccagtgtccatcagaccaccagtgtccacgcctcagtagcctctggctcagcccagcattgacatatctgcccatccccactcccgttttctttgtccttcctgtttgtgcctttttcatttacttcatttcagtggggtttcaggagggagcagagatgcacgttttaaccccgtctgtcctgtttcagttaaatcaaaactgctcgttgaggaaatgtttctgcccctgaccacatttctccattccctcaggacgcagaaaggctgcgtgctctccttcctgctgccctcctcaaggccaaagtcatggtggtaactgctccccggcctcatgcagccttcttatctgtccctcattggcacacaacctgttccttgctgagaactttgtaaaggggggaagtagtggtgccagcattgtagaagttctactcggcttctggaaagatgggagggatgacccaggacaggtcagggcaccaggacagagaagattcagtgtttgaattgaccattccacacggccactgcactgagaaactttgattgaaaagctagccactggaaggttagtattcacctggcggctcatttcccctcccctggcacatcaccaatgctagtccagcttttctcctgctcctcagagacctcctggctgacagctgtctgagctagcgtcactgtgacgtgttacgcttcctcacctgggtttcgtatgtaaagaaagggtggattttagaggtacatgagtttggatgttagtctaggacgtctcttgtgttctggtgtttgaatgtaagtcggctttccttctgccatggaccacttacctatctgctttgaaactgaactgccactggtttggctttaagaagttcccagtatgcaatggtgtaacaaaacctgggttgaaaatgagccgttttagctcatcagagagaagatggtagaagagtgggttctgaaagcagtggtgtcaggcaccgcgtgaaagagattgtaggcccactggtgagtttttaatactgagctggatcataaatctgcatatcagaatgctgatacttggattaaaatatttggtttttgaattaagccgtatctggaaatgtttaatggccactgcttttcctctccagggcttgtcagtgagactaatggccactgcttttcctttccagggcttgccagtgagactaatggccactgcttttcctttccagggcttgtcaatgaggcagatcagattcaggttcgacgggcagccaatcaatgaaactgacactccagcacaggtacggagctggcttcgcgtggttccagggcgacttccgatttgtgcggggtaactgccatttgggatacgcttatttgagaattgtaggtgggagctcatacagaatgccttaatgatattgattattagattatttatttttcacattttaaatttaaattttcaaatgagaaaactgctttgcagacatcattcttgctgtttggagatggagccaagtgctgggcccgtcctcactgtaagggaagcgggggtgcaaggaccactcagcggccccttcccactcattgtctggacgcttgctgttgtagcccgtgtgcagcttaggggccagctggattcttgtgccctttaagcatcttgcacaagtgacgtgggtgggcagaatgtgccataacccctgattatcagtctgcacagctcgtttctctcaggcacatgcagacatgaatgagatttcatctatcacgttgcagggcatcatactgtcatggaaagagctttggacctggaaacagacttttttttttgagacggagtctcgctttgttgcccaggctagaatgcagtggcgcagtctcagctcactgtgcaagctctgcctcctgagttcacgccattctcctgcctcagcctcccaagtagctgggactataggtgcccaccaccactcccggctaatttttttgtatttttagtagagacggggtttcaccatgttagccaggatggtctcgatctcctgaccttgtgatctgcccacctcagccccccaaagtgctgggattaaaggcatgagccaacgcgcccggccgaaacagagtttttttttaaacttggttcaagttgcagctcttgtcatttgtcagctgatggccccgtgaccaagcatcacttcatcttgtggagtctcagttttgtctgtccataaatggaaccaatacctgctttttctccctttcaatgttgtgagaatccactggaatgttttatgtggaaatatttttgcaaaacatttaagattttaaatatttactattcagtatttaataaatattgaaaacatctttgcaacaagtatccatttgtacctacttgaggaaacctacacaccgctgaggcagtggcagctctgggagtgttcaccagggagaagctgctgagagcagctgagcagggagggcctcgtggagtctctggggcttgactgggggtcagggggctggctgtggacaggtggaccgagaggcagagggagccctgcctgggggctctccctccagcccatagtgtcggtggcagggtgagggtggccgacagccctgatgggactcctttccatctgggagcatgactacttccagccttgctgagtctgtgtaggaactggcagaagcttcctcttgcttagaggatggaagaagatcagggtgggtgttttgcgcccactgtgtcaggaggagagaagtgagcgggggtgtttcactaccttgcctgggctttaaatggggaggggcggggagaagctggcaatggaccctcacttgacgggcccttctgtgagctgggggctttggctttcatggcatggtcccccgcacttggtataaagcgcaaggctcctgtgggtcctaggactcagtgctgctaatcagatgttcttaattagaatctgattttgtgtaattttcagtaagaattttagacatttcagtttatcttctagactcagtttttctctcagttaacattttagctttgaatctgcttttgtgagttttgttaggggaagcttgttgaaccgtaagggctgtagtgagcatacagcaatgcctcttccatgcgtgctgagctgcagtgaggggacggacaagagccaaggtgtgaccaggtgatgtcgctagtgtcagggaacactcatgccagtgaggatcttcccactctctgatgaaaactaacaggctcccctctctctcgctgtgcctgttgtgacaaccatgacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 35654 - DNA, 12518 bp, Homo sapiens; identical to SEQ ID NO: 35653

SEQ ID NO: 35655 - DNA, 105766 bp, Homo sapiens
aggcgtctgaggggcggacggaggcggcggcggcggcggcgggagcgggagcgggcggcgagtggggagcggggccgggagtggagcagccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgaggtgagcgcggcagcccccagccccggacccgggtcctgttcgtccacccgcccgccctgggggcgcccgccccgcccccaccccacccgccggtcggggccgcgtcttcctgccccgcccgggtgcggcgggcggcgtccgaagggggggccgggggctggggtccgaggttcggggtgcagggtcggggtcgagggcggggtctagggagaggagccggggtcccaggcccaaggctgggggccgagtttcggcaccggggtgcggggttgtgtgcgccgcgggcgcttcccgtggcggcggccggggccccgggggcgcgggtcgggcggggccgggccctgcgtggggagccggacgtggctctcgggcccgcggcgcgagaacaaaggccgggcgggcctgcaggcggggcggtgtcggcggccggagcccccgcgcgggccgcctatcggggtgactttgagggccgggcggccgcggggcgcgagcgtggggaaggggaacaatgaaatggggaagccgggccgcgcgccgcggtcggagtagggatttaaagcggaagccgggcgcggcgtcgggaaatgggaaaataacggtttcggcccttttcgctgtgtcgagccgctgaggcagtcgcgctgtggcctcgcccttctcctgccgaggcccgggtctgtccggcgctggcgccccgcgcgtgtcgactcgagggttgcgcggaccccggcccggccccgcgaatgaatgggcccggtggccgcgccaagatggcgctcccaccgctgcctttgtggggcggccgccgccgcgccgagtttcggggcccggtttgcgatattccgaaggcccgaaggtgggggagaggacaggaaatagcacaaaggctgggtgtcttcctcttgcctggatcggcttttcggctggaagcggggtgggggtggggagtggggagatctgttgaaaattccacagggctgtcggctgaggcttttgacttttaagaacctgctatattttttcttgtgaatcgatagttgattcaaatgatattttaacatttcttgtgtccgttaaattacatggttagcatgcagaagcagtatcagcttttgtttgcttaattcatcttcatggaagccttttttttttttttttttaagagatgggatctctttgtaaaagagatcctgttaaccaggctggtctcgaactctggggctcaagcgatcctcccgcctcagcctcccaaagtgctgggattagcggccttagccaccgtgcccagcctgtcttcatggaagctttttcttaagattgtgaaatgggctcctgaaggaaaacgccgatgttaaaatttgtgttttgaaaagggagttggtgtacatttacagttagggtgtacagtactggacttatgggtaaatagtgtagaaatggtaacctatggttttcttttggggagcattggttcattgtattttcatgttgctatctatctgataacattagtctcaaatagtattaggtgattaagcagttgctggtgagattattaattaagaaaatatgaagattatttttcatgattagcaaatggacgtattagttttgtggaaagtttcagtgaactgcatactgaataaggtctttggagcaagcattgttattgataaggtttttgcataagttattttctaatctgaagtgatagtcttttgggagagggaggagctctttattgaaagtaaggttttaattttcatgctattgacatgcatagtctattctggattctttgggaaggtatgtatatcaagaaagtggataggcggttccttctttgctaacgctgggttcgaggctggggatggaggtggtgccactgacatggagacaggtctgagagcctccccagggtaggactgaatggtgggttttgtcttggtttatgctaaggcagaactttctttactttttgagatggagtttcgctcttgttgcccaggctggagtgcagtggcgcgatctcggctcattgcaacctccgcgcccccgggttcaagtgattctcttgcctcagcctcccgagtagctgggattacagctaccaccaccacacccggctaattttttgtatttttagtagagatagggtttcaccatgttggccaagctggtctccaactccagacctcaggtgattcacccgccttgatctgccaaagtgctgggattacgagcgtgagccaccgcgcccagccggtaaggcagaactttctaacgattagagctgcgcagaaatgaactgcaactgcagggtccagaggctgatgctgtcaaccctgggggaaggctggactgcaggtgttgggcggtggtcccaggttacgagcatttggtttcatcaacactgaaagtgctccccccgcccgcctttttttttttttttgagattgagagtttggaaaaccagttaagttctgaggtgcctgtgccccctcccagttaagtgcgcactgcccaggcccagtgtgaggatgacattttatcttctgcgggaacctttcaagatgagtcttatagaggaaactgttccaacatgaaatttcagctcagaattgactttctcaaaagagcacatccactggccaaaagctatttctctcgcgtaatctgaatttatgacagaaccatagttatctcatcagacaagtactgacagtgctcttcagtgatacctttaaaatattgttttttctttgatatcttcagttaattctgtttttttggtgggtgggaaagttgaagtaaattttctcagatttaattttaatcttagaagattcaagagactgcagaatagtgtgtggtttttttattgtttgtttttaagagtaaaacccactgggtgtggtggctcacgcctgtaatcccagcactttgggaggtggaggcgggcggatcacatgaggctgggagtttgagaccagtctggccaacatagcgaaacctcgtatctactaaaaatattaaaattagccggcgtggtggtgggcgcctgtaatcccagctactcgggaggtttaggcacgggaatcgcttgaacccgggaggcaggggttgcggtgagccgagattgtgccactgggcgacagagtgagactgtgtctcaaaagagtaaaaacctctgtaaatccttttgatgcccaatgactttgatttcaaagctagtatcatctaggtagatttatgttgatcacttgagaaacagaatttgaaaagttaatttatttctcaaaggagatgttgtactatcctgcaaaagtaccagagctttgttctcttccctttgctttgctaaaaatttctgggtcttttggtttattttatgtgtgtgttggtccactggaaaagttgtagctttgtagctaaaaacagctttgataaaaggatgaaaaaggtcttcagggcatctctagacttcatctaccatcagttgactttttgtagctaatactttaatgaataacattggtattattttagaagtgcagtgttggcatttattatagttttgtcgttgtttttctctgcccgaaagatttggctcatgttggtctctaaattggattacattcttactgtctgtgactttggctttagcattagtggattggtaatagatattctcaatttttaaatctggcttgaccatatggcaggccatgttattttgaaacccctatttagtgtaagtctcacaagacatggaacaaaaatttttataaaattttaaactggtttgaccgggcgtggtggctcacacctgtaatcccagcactttgggaggccgagtcaggcggatcatgaggtcaggagatcgagaccaccctggctaacacggtgaaaccccttctctactaaaattacttctctacaaaaaattagctgggcgtggtgctgggcacctgtaatcccagctactcaggaggctgaggcaggagaatggcaggaacccgggagggggagcttgcagtgagccaagatcggccactgcactccagcctgggcgacacagcgagactccgtctcaaaaaataaaaataaaaaaaattttaaactggtttacattctgatttcaggtttgcatttgttaagagtggttggagagattatgaagtaggcaattcagttaagtgtttggtttaggaacacagaatgaggagataaaataaatttaaaatggaaactatcagaaatttatgaaactgcagtgttcaacattactgaaagaaaaagcagggccaacgtatatgggagtgagtgtgtatgaagagagagaaatgcaacatcacatcagctgctctgggagagggacagagcaccacctatttcaaagctatgcattttgttctagaactttgattgaagaaatagagacaatctatagacatttgagtttgctagtggattagtggaatgctgaaagctttttttgtgagacagagtcccactcagccacccagtctggagtgcagtggcgcaatctcggctcactgcaaccaccatctcacgggttcaagtgattctccagtctcagcctcccgagtagctgggattacaggcacccgccgtcatgcccggataattttttaaaattttattttagtagagatggggtttcaccatgttggccaggctggtcttgaactcctgacctccggtgatctgcctgtctgagcctcccaaagttctaggattacaggcgtgagccaccgtgccctgccggaatgctgaaagcttttttaaaccttttagcctcttgttcttgtgtcagtgcctaccattgggtgccatggtaatcagtggaaattactcctggctttcagtggtagaaaagctttctgttttatagagcaatgttgcttgcttgcttttttttttttttaagattaagtgggccgggcacggtggctcacgcctgtaatcccagcactttgggaggccgacgtgggcggatcacgaggtcaggagattgagaccatcctggctaacacggtgaaaccccattgctactaaaaataccaaaaaaattagctgggtgtggtggcgggcgcctgtagtcccagctacttgggaggctgaggcaggagaatggcgtgaacccgggaggcggagcttgcagtgagccgagatcgtgctactgcactccagcctgggtgactgagcgagactccgtttcacaaaaaaaaaaaaaaaaaaaaagattaagtggaagtatttccttatttatgtcttcttaaattagaattctgagaaagacccattttttaaaagcttactgatttaaaagaccagattaagattatctaaggtaattccttttttctttcttttttttttgagatggagtttccttcctgttgcccaggctggagtgcaatggcgctgtcctggctcactgcaacttctgcctcccgggttcaagtgattctcctgcctcagcctcccaagtagctgagattacaggtgcccgccaccatgcctggctaatttttgtagttttagtagagatggggtttcaccatgttggccaggctggtctcaaactgctgacctcaagtgatccgcccgcctccgcctcccaaagtgctgggattacaggtgtgagccaccgtgcccagcttaatttttaagtttattctgttgaacctattttgccatagataaaatatttttatgatttaataattcattgctccaaacttactaatgcattatatcaagagaggactttatgtattaattcattcacctgttagaattggaatactggccgggcacggtggctcatgcctgtaatcccagcactttgggaggcccaggcgggcagatcacgatgtcaggagatcgagaccaacctggctaacacagtgaaaccctgtctctgctaaaaatacaaaaaaattagccgggcgtggtggcaggcacctgtagtcccagctacttgggaggctgaggcaggagaatggtgtgaacccgggaggcagacctcgcagtgagtggagatcgcgccactgcactccagcctgggcgacagagcaagactccgtctctcaaaaaaaaaaaaagaatgggaatactaagggcatcagtggaatgtattcttgtttactggtgggtaatcatgtctccatgcatgtctgtgtgcagtcctgtagcacttagaaaatatattccctatgttgattacagacactcaacttctgccgagtgttgtagttaataaagcttaaaaaattctgggctgggtgtggtggctcatgcctgtaaacccaacactttgggaggccaaggtgagcggatcacctgaggttgggagttcaagaccagcctgaccaacatggagaaaccctgtctctactgaaaatacaaaattagcccagacgcggtggctcacgcctgtaattccagcactttgggaggccgaggagggtggatcagcctggccaacatggagaaaccccatctctactaaaaatacaaaaaattacccaggcatggtgatgcatgcctgtaattccagctactcgggaggctgaggttgcagtgagccgagatcgtgccattgcactccagcctgggcaacaagaaggaaactccatctcaaaaaaaaaaaaaaaattagtcgggcatggtggcacatgcctgtaatctcagctactcgggaggcagaggcaagagaatcgcttgaacctgggaggcggaggttgcggtgagccgagattgtgccattgtactgcagcctgggcaacaagagtgaaactcggtcaaaaaaaaaaaaaaaaagtccggacactttataattagatgagcatgtcaaaagagtctacaataggtttcagaaaatttctcataggaattttaaaataattcctaaaatctagggagtgagagaaattcagtagttttcaaaaggattggcactgtctgagttagagcccagctcagctctgttgcctcactggctgatttgcagtgttaggacttttattcgcactgaaaatcaagatcagttcaacttctacccttccactccacaggagctttctgtcctccctgagcctgccttaatttaggccacctgcagtgttaggacttctgtgtctgtccttatctgtgaaacaggctcctagagcctccttcatggggtcattgtgaggattaaatgagtcctgatgtgggcactgataacagagctcagtgcaaggattagctatttctgttgctgatggccttgctttgtaaaaatttcttttatggcaaggttaacaaatgttataagatgacagtttactgagatttttctttttttctccatggttccagaagaatattaattcagggtgtggaacatgcatattagctatctttgcaaatccctatcacttatttactgccttactttctactaaatctctcacatccttatcttttcttgaaaggtttttttttctttttcttttttttttttttttgggacagggttttgctgtgtcacccaggctggagtgtggaatgtgatggtatgatcatggttcactgcagcctggacctcctgggctcatacgatcttcttctctcagtctcacaagtagctaggaccacgggcacatgccaccgtgcccagctaattttttttattgtttgtagagacaggctggtctccaactcctgggttcaagtgatcctcctgccttagcctcccaaaatgttgggattatagatgtgagccacagtaacctgctcttaaaggctttcctttacctttgtagaataatcttgaactatgcctcattttgaaaactggtaagtttatgtcctttttttttttttgagacggagtcttgccctgtcacccaggctggagtgcagtgacatgatctcggctcactgcaacctccacctcctgggttcaaacaattctcctgcctcagcctccagagtagctggggttacaggcacctgccaccatgcccagctgatttttgtatttttagtagagacagggtttcaccatattggccagtctggtctcaaactcctgacctcgtgatctgcctgcctcggcctcccaaagtgctgggattacaggcgtgagccaccacgccctgcccatttatgttcatttttttagagaattctcctcctcccatttatgaagctagatttttttttaatttcaccaaaatttgttgacgtcccttgatttgctgatagggacaataattaaatattttccacttgtttttataaaaactgtaatggtgatttgtttaacagatgttgacttagcaccttctctcttttttttttttttttttttttttgagttggagtcttgctctgtcacccagctggagtgcagtggcacgatttcggctcactgcaacctccgcctcccaggttcaggcgcttctcctgcctcagcctcccaaatagttgggattacaggtgcatgccgccacgcctagctaatgttttttgtatcttagtagagatggtgtttcaccttgttgcccatgccgctcttgaactccttggcctcccaaagtgttaggattacaggcgtgagccactgtgcctggccccaatttagcaccttactgggtgctgaggctgtgagccatagtagaatgcatgtgatccagggccttgctgaattcatggtctaatagggagcctgacacgcaggcacagagcggagggcagtggctgtggctcccagggacaccaccctgtccagagttcagtggcagcttctcattaaaaaaagctttgagacctgaattggagtctgtctggcaggcaggtggggatggaggggaggagtgtatcctaggctgatgagatggtgtgtttttcatccggcaaccaactggtctccttcactgtctccagcaccccgcacaatactgtgtgccaggtgctcagtaattatttatcaagcgcataagagcacagcacatccagggacggaagttccaaagggctaggagagtggttagacctggaagccaaaaggtttacagtctggataaagagcttttaccttgaggccgggcacagtggcttatgcctgtaatcccaccactttgggaggccagggcgggcggatcacttgaggtcaggagtttgagaccagcctggccaacatggtgaaaccttgtctctactaaacatataaaaattaggcttggtggcgcacacctgtattctcagctactcattaggctgaggcacaaggatcacttgaatctgggaggcggaggttgcagtgacccaagatcaccctagcctgggtgacagtgtgagactcaaaaaaaaagaaaaaaatgaacttttacctcgagagctccaggaagccctgaaagagttttaaggagattgatctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcgagggtacggcaggccttatactttctcctccctgtccttggaaaactcctggctgtgtgtttgcacagttcactccctctctccgttcaggcatttgtcatgtatcccttcctccgagggtgtgctctgatctcattgatctctgctgttttaccccactcttgtcttcgtagcctgataatgctcttcccacttcttctaagctccatggacacaggcagtctggttcactgcagaccagcccctaaaacggtacacagtaaatgctgacgtagtgactcctgtgcctgtgagtggggagctctggaagataggtctggatggaggcaggcctttgggagttagcaacatttgggtgatgattgaagtcttggggagcagtggtcacttagagcagtggttctcaaagtgtgatcgtggacccctgggggctcctgagacagtttcaggaattcacttagtcagaactgttttcatcatcatatatatatatattttttttttgagatggagtctctctctgtcgcccaggctggagtgcagtggcgcgatctcggctcactgccagctccgcctcccgggttcacgcaattctgcctcggcctctccgagtagctgggactacaggcaccccccaccacgcccggctaattttttgtatttttagtagaggcggggtttcaccgtggtctcgatctcctgacctcgtgatccgcctgcctcggcctcccaaagcgctgggattacaagcgtgagccgccgtgtccggccttcataatcatattaagatgttatttgacttttcattgtgttgacatataaaaataaaataaaaattctatagaaatactgttcttggctgggcatggtagctcacacctgtaatcccagtgctttgggagggtgaggcaggaggatcacttgaggctgagattttgagaccagcctgggcaacatagtgagaccccatctctacaaaaaaatttgaaaattagccaggcatggtggtgcgtgcctgtggtcccatctactggggaggctgaggcaggaggattgatggagcctggcaggttgagattgcagtgagctatggttgcaccatggcactccagcctgggtgacagagtgaggccctatgtcttaaaaaacaacaacaacaacaaaaaacagctcttttctttttccagctgcatatctatgtgagactgaattttcctcttagacttcagctaaaactgtgtattgcatcaggctgagagcagacacgatgtgaagatccattgctcccattgaggcagacaaggtaaatgtaaaatgtaaaatatggcttatcaccagattatttttcttagaaaatagttattcttttttttttttttttccctgagacagagtctcactctgtcacccaggctggagtgcagtggtgcgatcttggctcactgcaagctccgcctcctgggttcacgccattctcctgcctcagcctcccgaatagctgggactacaggtgcctgccaccacgcctggctaatttttgtatttttagtagagacagggtttcaccgtgttaggcaggatgctctcgatcgcctgatctcgtgatctgcccgcctcggcctcccaaagtgctgggattacaggcatgagccactgcgcccggcctagaaagtagttgttctttataaaaatgttatgtatggtaacatgcagtgggcttattttcaaatgataaacatttttaggacatttcagttttaatttatagcacagtaaatattgatagatcaaaccctcataaacaaaagcccctggggtccttaatagttgaggatgtagagggggtctgagccgaaatatctgagcagcgctggtttagagaatgggccaggcccagggcacctgtggggaccagagaagttctcagctggagacaggcaccctgtccctgcccccatgtgcagtactgtaggattgtgccttttcctggggaggagaactcagagatttgtcagaggtgaagacccgttggtgtagcttgagaagaggcccttgtgttagggatgtgcagaggaagagaaacacttaaaggagtgaccagactttgggagactctcagcactagtgtcgcagaacccacagaaggtattctgagagcagagggaatggtccgaagttggagatggattcgtcagtggtagagattgctgagggccagtgagttccagtggggtgaggagagtcttgtaggaaagtagtcggagagagaagtgtggggctaggggaggctctgtctgcatggattttagatgggaatactgagagggcagcgcccataaaggggaagagaggagagatcttttgtaaaatgcgtattcagggccaaagatgtgccaaggagaggcaggtgatgggcagtgaataagagatgccaacttgccttggtgagaggaatgttacctatgcgacagtggaaaaggctgtgtgctgaaaaagatggcggacgagtctgctgtagggctctaggcattgctggtgcttccatgttgaaaagggtggtccaaacatttgaggagagagtaggaggaggtgagaagacaaaccagacagacatctgggaaaagagggttccaggcaggagaagccccaagtcagggctgtgcttggacttggaattgaaataagtcctggaaaattggttaatccccgcttggcatacatattatgtaaagtgtgttgggagaggtacttgaaggttttcctgttgaaataaattccctacaaccttagccttccagtccctctgcctgacactcccatggcagttggtgcacttgcgttttgccctgttgaagatgcctgtgccattagctcgcatttgttgggtatctttcttgcaccaggcaccatgctgggaactatgctattactgcgtggtcctcacatcagctctgataggtgctgttaatagctccatcttacagatgactggatctacagggagattagacagttggccgtggtgacagtgaacttagttcttgggtcattgctcctggagcctatgcattatagacctgctggtgtgagctctttctcctcattcatctgagaagacttctgtgtctgcatttgcctcttcctatgttagtaaaaggaacatttttccactggaaaacagttaccaacagttttgtcagtggctactctattataccttcaaacatgcctaaatcttatgtaactcaacacccagttaatcttgctatctattctagccactcttcttgtttttctctctttaaactccccaacaggcagtctgtttccattgcctccaccatctatcctatcctttctctggagatcttgttcctgttgtctcagttttattttcagcttcttcattttgctaataaaaacatctaaaatgttcattgtagtaaattaggggcttggcatggtggctcatgcctgtaatcttagcactttgggaggctgaggcaggagaatcacttgaggccaggagtttgagaccagcctgggcaacacagctagaccctgtctctatttttaaaaaaataaataaaattttataaaaaagggaaattaggaacatacagcaaaaatctataatctctcaatcaggaaataaccatgtaagattattatatttcttctagtgttttgtatctctcatgcatgtgtgtatagagatgtttttcctcggattgggggtcccactctgtgtgtgtgtgtatatatatatatatttttttttttttttttttgagacagagtctcacttattgcccaggctggagtgcagaggcgcgatctcggctcattgaaacctccacctccccagctcaggcgattctcctgcctcagcctcctgagtagctgggattacaggcatacaccaccatgcctggctaattttgtatttttagtagagacggggtttcaccatgttggtcaggctggtctcgaactcctgacctcaagtgatccgcccaccttggcctcccaaagtgctgagattacaggcatgagccaccacgcctggcctgtatatatagatttttaaaattgtgatttttctactttgtaattgtttccaaatgtcattcatcttggaaaacatgagtagtaattatgtagatatcagtggtatttcttgtacctgaatccacgtgctggacatcctggttctgccaactcagatttgaggtctggagcaagttactgaacgtctctaccttagttttcttgtcttccaggattgttgtgaggactgaatgacatgctacaaataaaattcttagcttcaagccaagcaagacctcaaagtgttagcttccagtaccgctactactgatggtgtttgactctgccttcattcctgaaatgcttctccattgactgggtgtggtggcttatgcctatgacacttatcactttgggaggctgaggtgggaagattgagaccagcctaggcaacatagtgagaccccatttttgcatgtgtgtgcgcttgctcactggctcgtgcacgtggccatgcacgctcgctctctctctctctctctctctcgtgtgcacatgcatgtcctctctcttgctctctctttttcttagctgggcctgatggtgtacacctgtagtcccagctatccaggaggctaaggtgggaggattgcttgaacccaggagttcgaggctgcagtgacctgattgtacgactgcactccagccctgtctctattaaaaaaaaacaagtccttctccaagctgatctgggcacttgatttctacccttgtggttctggcttagtaaaggtcttcagaaatgacacaatgttagtttcctgtggctgctgtagcaaatcatcacaagttggatggctcagaatgaattgattccctcagttctggaggacagaagtctgaaatcaaggtgttggcagggccccagtgcttctgaaggctccaagggaggacacttcctttcttctttctggcttctggtgggtgccagcagtgtggcttgtagaggagtcactctctacctctgttttacgtgggcttttctcagtgtctctactcaccttataaggacatagttattagattagggccaccctaattcagtatgacctcgttttaacttaactaatcatacctggaaagacgctccaaataaggtcacattcccaggttccaggtagacatgaattttggggggggggacactgttgaacctgctaaagttcctagagcttcatccttcgccccttgtgtttctagctctcttgccttccatgtcttcccattccccttgtggccagccttgtgaaatgaagtctctgttggaggttgaagaaacttgtaagataatttacatagaaaaaggggccggatgcagtggctcactcctgtaagctcagcactttgggaggccaagatgagaggatcacttgagcccaggagtttgaggctgcaatgagctatgattgtgccactgcactccaacctgtgacagagcaagaccccgcctctaaaacaaaacaaaatagaaaaggtaaagtgtccttggccaggtgtgatggctcacacctgtaatcccagcactttgggaggccacagcgggtggatcacttgaggccaggagtttgagaccagcctgaccaacatgtgaaaaccccgtctctgctaaaaacacaaaagtttagtggggtgtggtggcgtgcacctgtagacccagctacttgggagactgaggcatgagaatcacttgaactggagaggttgaggttgcagtgagctgagatcacaccactacactccagactggtaggcagagcaagactttgtctccaaaaaaaaaaaaccagaaaaagataaaatgtcttctaagcatgggcccccaactcctgggctgtggtctcttaggagccgggctgcacagcaggtgagaggtgggcaagcgagcattcccacctgagctccacctcctgtcagatcagcggcagtgttagattctcataggagcgtgaaccccgtcatgaactgcacacgcgagggatgtaggctgtgcactccttatgagaatctaatgcctgatgatctgaggtggaacagtttcatcccaaaaccatcccctctgtctgtggaaaaattgtccttcacaaaaccggtccctggcatcaaaaaggttggtgaccgctgctgtaaggattctggatgcttcacagaacgaagctcaggaggcactttttttttgtcttttttttttgagacagggtgtcactctttgtcacccaggctggactgcagtggcaccatctcagctcactgcaactccgcctcacaggctcaagcaattctcctgtctcagtctcccaagtaggtgggactacaggcgtgtgccagcatgcccagctaatttttgtactttttttttttttttttttttttttttagatggagtcttgctctgcttcccaggctggagtgcagtggtgcagtctcgtctcactgcaacctctgcctccaaggttcaagcagttctcctgcctcagcctcccgagtagctgggactacaggtgcacaccgccacgcccggctttctctgtactttggtagagacggggtttcaccgtgttgcccaggctggtctccaactcctgagcttaggcagtccgcccgcctcagcctcccaaagtgctaggattacagacacgcgtgagccaccacgcccggcctaatttttgtatttttagtagagacagggttttgccatgttgaccaggctgctcttgaattcctggcctcgtgatctgcctgcctcggcctcctagagtgctgggattacaggcgtgagccaccgcacctggccaggaggcgcgttgtgtttatgctttgctagtctttcttttgtgggaactgaagagtgttgtcctcggtagcttccacagggatggatcgaggctgctgccagcatttgttccactgactgtccttggggaccagtaacctagatcagaagtcaatgagaagacataaagaatgcctccaaagcagggaatctttccttcccctgtgaaagtgctgagtcccctagaggcaggtatgcgttccctcttgtatttagtccccacgctgcctgcctggatacattggtggttgtgacagctggggtgtgccacagggatcctgctccaccatggagaattgtccagtccagcagtctcggtgccaagtttatttaagatggagtcttgctctgtcgcccaggctggagtgcagtggcaccatcttggctcactgtaacctctgcctctggggttcaagcaattcttctgcctcagcctcctgagtagctgggattacaggtgacccgcccacctcggcctcccgaagtgctgggattgcaggtgtgagccactgcgtccagtctcggcgccaagtttaagaagagcatattgtcatggccttacatcagttatatgctcctgggtaacaaactaccccaaaatgaagcgacttaaaacagtaagtccttgttcatcatcatgtgggagtatggatgtgggcagggctcatctctgttcactgtgctggccacgctagcaagggcaattaacagttggcaggtaggctggcttgtgcttcccattgccctcacccacatgggctttcagccagggtgcctctgatctcctcagcctgcctctccaacagtctagctcaggcttcctcccatagtggctgaattccaaaagggcaggagcagagtttgacaggctacttgaggacatgtttagaagtcacagtgtcacctctgttgcattcccttgcttattgcaagttatgaggcctagcataggccaggagtgctgcctcatgcctgtaatcccagccctttgggaggccaaggtgggaggatggcttgaggccaggagtttgaaaccagcctggacaacatagtgagaccgcatctctaccgaaaatgaagaaaaaaaaaaaaacaaggcttagcacaggcttggagagtaggagatagactctggtccttaatggtgggacttgcagaaaccgtggccatttttcatcacagcctttcctatactgtgtgacctcaagaacttcctgctttaggatgcccagttaataatatggtatctgtgggatggagtgaactctttaacaaatatttaccaagtacttactttgagcaagacactgtgcttggtgatggttgagtaccgagaagttgcaactggtggttcattctctgtggggagatggcgaactggaagaagcgaagtttgggcctgtggtaggtgctgtgagctgttgggtggagagggcacttggtttagggtattgtttagggtatttagagtaaaggcctgaaggatgagaaggaaccaggtaggcaaggagcccctatgcttcaggtggagagggcagtgattgcagaggccctgcggaagggacagcaggcgaagctcagcagaggtcctgcggaagggacagcgggtgaagctcagcacacaggagcaaagctgtagggcagaggtaggggtggaagccaggccttggccacacggcctcaggcaggtgccagaggcccagtttgcccaggacagtcttgatttataccaggtgagggtcctcgtgcagatggtgcattctctagtttccaaactggcagagagcttggatgttttccttgatgcagtgggaagccgttgaaaaattttaagcctcaagtgacaaaaggtgaattttaaaagattgttgaggctgggtgcagtggttcatgcttatagtcctaacagtttgggaggttgagacaggaagattgcttgagcccaggagttcaagactctgtctctacttaaaagaaaaaattagctgggcattgtagcatacacttgtagttccagctactggggaggctgaggagggagcatcgcttcagcccaggagttggagtttgcagtgagctatgatcacacaactgtactcgagtctgggcaacagagcgagaccctgtcttaagaaaaaaaaaaaaagaaaaaagattgttcagattgctgaatgaaaaatggattgtcgggggcacagattgagacagaggtcattttaaggagactgttgatgagaaatggcgtggtttggctgaggatggagactaaggaaatgggaagaaatgggtggtagagtcagccaggttgctgatggaccgggtgtaggggagtagggaaaggaaggaggccaggatgatttctgtgtgtgctttgcacatgtagagggtggtgatgttgagcactgaggggaggcaaatctgttggctgtgcagagccatgccttgaatatctgaagctcaaaatgggtatagggcaactaagtgccaaccgccggctaacagcctgttggcctggagtccagtctggaagtcttggtctttctgtttttgtgatggtcggtggaggggttattaaaaggagaggtggggtgcccagctattagaggttagatcgaggagacacggagaggtgggatgtgacagtgtagggtgcagttgaggagtcaggtgaatgggggtggggaaagggttcccttaagtctcactctgttgccgtggctggagtgcagtagcgcgatctgggctcactgcaacctccgcctcctacgttcaagcaatactcctgcctcagcctcttgagtagctgagattatagatgtgtgccaccatgcctggctaatttttgtatttttaatagagacggggtttcaccatgttggtcacgctggtctctaactcctggccttaagtgatccacctgcctcggccttaatgttatccaaaatgctggggttacaggtgtgagccactgtacctggccaaaggttccttaaatttaaggactgcaggtactaggtggtcagcccttttggtttcacggtagggagtgaaagccagattggagtcaattgaaacataggagatggaagaggagaccacctgtgtagatacgacttaaagaaggttgctctagagggctcagagaaggagctcagtagttggagggtgatgtgggcaacagtggagagttctgtttttattttattttattgtttatttttttgagatggagtctctgtcgcccaggctggagtgcagtggtgaaatcttggctcactccacctcccaggttcaagcgattctcctgcctcagcctcccgagtagctgggatgacaggtgtgtgccaccacgcccagctaatttattttgcatttttagtagaggtggggtttcaccctgttggtcaggctggtcttgaactcctgacctcaggtaatccactcacctctgcctcccaaagtgctaaaatggctttttatatcagaaatgggttgaactggctcttggcagatgattattcttactgtaattccagcaacgctaacatgcgtaacagcgcataaggaagtgtctgctgagctcagaatattatgttttggaaaagacaaagtgcgattcagaaagctgagtttgatagggagggatttgatttttaaacaagacgggctgattatagtggcttataactataatccctgtaatctctggatttggggaggctgagttgcgaggatcccttgaggccaggaattttagaccagcctgggcacaatgtagtgagaccctgtctctacaaaaagtttaaaaaacaaaattagctgggcatggtgcctgtagtcctagctactgggatggctgaggcagaaggagtttgaggttacactgagttatgatatgccactgtactccagtctgggtgccagagtgagaccttgtctcaaaaaagcaaaaacaaaaccccacaaacaaaaacataagattgtctttgggcctggtgcggtggctcacgcctgtaatcctagcactttgggaggccatggcgggcagatcacttgaggtcaagagatcgagaccagcctggccaatatggtgaaaccccgtctctactaaaaacaaaaattagctgagcatggtggcgggtgcctataatcccagctactcaggaggctaaggcaggagaatctcttgaacccaggaggtggaggttgcagtgagcctagattgtaccactacactccagcctgggtgatggagtgagatgttgtctcaagaaaaaaaaagaaaagattgtttttgaatctgaagacataacaaagcagcattacaagttgtgttgtacaagtgtgttagcgtaggttgtccttgataaatggaatataaatagctctgaagtttttgtatatattgacctattacaaaatcagagactttctttcggggttgggagggcagtttgagggtagttgggtcatctggaagaagaggcagaaaagaggaaccagctacgtgatgaataactgtgataagacaaataggctcctctactgccacctccttgttttttcctgcttactatttctgtggctgtgattgttgggattcacgggaggaggaagcagggacagtaggaaaagctccagttcctgatggacctgtgttgctggtgctgcactgccttttctctgacttcatcccacccacctgagagacactaaggtgggggctgaggtccaccctgtaattaagctcttgggcatgaatggttagctgaaacaagactgtcaccttctagtgaaattctgttttttggattcttatagaagtcagtagtaagtgtctgagataatgaatggtcagataacaacataaaggagcagtggactgactagagcctctggtctttgtaagtttgcttcttttttgtaagtaacttattcttttttttttttttttttttttttttgagaaggtgtcttgctctgttgcccaggctggagtgcggtggtgtgatctcagctcactgcaagctccgcctcctgggttcatgccattctcctgcctcagcctcccaggtagctgggactacaggtgcccgccaccacaccggctaatttttttgtatttttttagtagagacggggtttcaccttgttagccaagatggtcttgatctcctgacctcgtggtccgtccacctcagcctcccaaagtgttgggattacaggcatgagtcaccacgcctggctgtaaataacttattctttatagaaattaacttcagaagattttttgagttcttaggcaaatacactaatggcatttgtttcatgattgttaggcctaaaactttttcactttttttcttttttgagatggagtctcactctgtcacccaggctggagtgcagttgcacaatctcggctcactgcaacctccgcctcctgggttcaagcaattctgcctcagcctcctgagtaactgggattacaggtgcccgccaccatgcctggctaatttttttgtatttttagtagagacggggtttcaccatcttggctaggctggtcttgaactcctgacctcgtgattcacctgcctcggcctcccaaagtgctggaattacaggcgtgagcaactgtgcccggctaactttttcacttttaaaaacgggaaaacatggccaggcacggtgtctcatgcttgtaatcccagcgctttgggaggctgaggcaggtcaattgccaggagtttgagaccagcctggccaacatggtaaaaccccatctctactaaaaaatacaaaaattagttggatgtggtggctcatgcctgtaatcccagctacgcgggaggctgaggcaggagaattgctcgaacccgggaggcagaggttgcagcgagctgagatcgcaccattgcactccagcctgggcaaaaagagcgaaactccgtctcaaaaaaaaacaaaaaaacaaaacacacactatatgaaggaacctttagatgcattattgaagaggtgaaagagaacttgaatagatagacataaatacagaacttgaatgcagtattcctatatgcatgtgcttgaatattttcaagatgtcacttgatttggagaagtaaatatttgaggggagttctaaagaaagaaaagggggaacgtttcctagtagattttttataagtattataggtaagtggaacaaagcagtctagatactgatctataaattaatgggaatttatgattaatgtagcatttacaatcagttgggaatggatggtttgtcatgtaaaaggtattggatcaactggcaatccagctgtaggtaaagagtttcttagtttgacaataaggctataagctatgaaaagatatctgcttaagcattcggaacatatctacagcaaaagatgcctgtttgggggcctctgaactatagttcaaaggcaggaaaattagaaaaatgttaggaatatatatgataaagggttattatttttagtataaaagcatttctaaaataattgttccagcaagtctatttttagaaatttatccaaaggaagaaataagagaatgcttattataaaattagttataaaagccaaatatttaagacagacaatgctcaaaaactcctagctagaatttttggtataaaagcaaaaaattgtcagtagccactaaaatataagctccatgagggtagagaacttcatgttttatttcctggtatatcctctgacagtgcctggtacatagtaggtctcaataaatatttgctgtatgaatgcctagtcatgcttgtccaacctgaggcctgtgggccgcattgcagcccaacacaaatttgtaaactttcttaaaatgttgttttttggtggagtttcgctcttgccaggctggggtgaagtggcctgatctcggctcactgcaacctctgcctcccaggttcaagcaattcttctgcctcagcctcccgagtagctgggattataggcgcctaccaccatgcttggctaatttttgtatttttaatagagatggggtttcgccatgttggccaggctggtctcgaactcctgacctcaggcgacctgcccacctcagcctcccaaagtgctgggattataggcgtgagccactgcacccggcctagaattgaggtttttttgtttgtttgttttgagatggagtctccctgtgtgccccaggttggagtgcagtggcgcgatctcagctcactgcaagctccgcctcccgggttgacgccattctcctgcctcagcctcctgagtacctgggactacaggcgcctgccaacacacccagctaattttttgtatttttagtagaaacggggtttcaccgtgttagccaagatggtctcgatctcctgacctcgtgatctgcccatttcggcctcccaaagtgctgggattacaggcgtgagccaccgcgcccggccacattgagatttttttttagcgattttttttttttttaagctcatcagctattactagttagtgtattttatgtgtggcccaagacagaattctccaatgtggcccagggaagccaaaagattggacacccctggatgaatctaaatgtccatcaatagattggttaaattaaggcagacttggaatggcatactgtgcagttgttaaaaagatttaaggtggccttcctttattggcatgaagagatgaccacaatacagtaaatggttgggcattttgaatatgtatagtttggggaatatggtatcatttgattgacttgtgaaaaattatgcacatatgtatcaaagtctggaagacatccctgtgaaacgtggtatctcatggggtgaatggaggaaaggaacatactgttttaagatactgttttctggctgggcgcagtggcgcacgcctgtaatctcagcactttgagagaccaaggcgggtggatcacctgaggtcaggagtttgagaccagcctgaccaagatggtgaaaccctgtctgtctactaaatagaaaaaattagctggccgtggtggtgcatgcctgtaatcccagctacttgggaggctgaggcaggagaatcagttgaacctcggaggcggaagttgcagtgagccaacgttgcgccattgtactccagcctgggcaacaagagtgaaactcaaaaaaaaaaaaaataaataaatactgttttcaaggccaggcgtggtctcaaaaaacaacaaccaaaaaacaaaactgttttctctttattttttggaaaattcgccaaagtcagtgacagaaaaaaggagttatttttcattttggaagaaatgtgaaagtggattatttacatttaaaagttttaaaagctttctcaagttagcatgactgaaatgagcacattacaggaatttgtttaaatctgcctttttaggtactgtagtctcctgtttcatagaccttgtagtcatgtttcttgctgtatcctgtcactggatatttttggatgctggtattgtgaacataacataactgtaatccggtagttctttttgagatggagtctcactctgttgcccaggttggagtgcggtggcacaatcttggctcactgcgacctctgcttcccgggttcaagcgattctcctgcctcagcctcctgagtagctgggactacaggtgcccgccaccacacctggccaatgttttgtatttttagtagagatggggtttcaccgtgttagccaggatggtctcgatctcctgaccttgtgatccgccctcctcggcctctcagagtgctgggattacaggcatgagccacaatgtgttgcctgttttttttttttggtttttttttgttttttttttgttttttgagatggagtctcactctgtcacccaggctggagttctgtggcgtgatctctgctcactgccacctctgcctcccgggttcatgccattctcctgcctcagcctcccgagttgctgggacttcaggtgcccgccaccacgcctggctaattttttgtatttttagtagagatgaggtttcaccatgttagccaggatggtctcgatctcctgaccttgtgatctgcccgcctcagcctcccaaagtgctgggattacaggcatgagccaccacgcctggcctggcctggtagtttttataacagatgttagatagcaatactcttcataactctgtacaaggcaatcaggcaaaaccaaaggccaagtaaaatgtaattggttaagctaattgtagctgatgaaacctttacgttttgtgaaagaggagatgtgcatcagcagctgtaagtgagcactctaagatgcagtgagtaaaaggtgttgggagatgagcaactaaaatataacctcttagttataaattgcagaacgaagaattttactcagagtacaaactagtggaaaaagtctttcgtatactgggtttttcagagttcttaggcaagattatatagtttgatttaaagacccaaaaatgtacttcctggggtgcaggaatgtcaggtttctgttaggtggaacatgctcctcatggcacagaattggctacatgaagttaacctacaggccaggtggtaatcggcaggatgggtcggccggagggaataacttgtgatgatagtgggagaaaccagtatcattgcggccgttttaactacctactgtgtactaggccctatgctatgagccagaagttgccacgctacagccatctctttctgtggcccagaagctaagaatagttttttcgtggggttttcttcttttttttttttttttttttttgagagagtcttgctcttgtcacccaggctggagtgcagtggcacgatcttggcacactgcaacctccgcctcccaagcaactctctgcctcagcctcctgaatagctgggattacaggtgcctgccaccacgcctggctaatttttttgtatatttagtagagacagggtttcatcatcttggccaggctgatcttgaactcctgacctcgtgatccacctgcctcagcctcccaaagtgctgggattacaggtgtgagccaccactcctggcaaattttttaaattttgtttttttgttttgtagagacagggtccaactatgttgcccaaactggatccacccgccttggccttccaaaattttaggattacaggcgtgagccagtgtgcctggcccagaccctcttgttttcagtcactgtgcaacaccacctcccacagaaacattgttctgtcctattctttaaaaaaatgttatcaattatgtgctgccatatactacactgagagtggggattcagtgcttaagcataggtaggttttctgaatttttccaacttaaatctcctttgaaatcttactgtgtgtgatatctgaaatttgggtgtttgctcactaaaagaaccttggaaggagaagatctcaaaatgagctatttgtggatgaagagtgagtcctgtgggtttttgttttttgtgttcttttatagttaacagagtagcagcatgtagaaggtggtggagcctgaacactaggtttagccatagaaaggcagttaggtctcctaagtagacgtttcagtaaagggctttgttgacgctttgcaatgtctggggtgtgtttgccccactcccaaacccctccagtggcagcagccacagtgggcaagggacggcagtgcttttctgaattggtcaggtttctgtgggagatgaggctctaaaatcagtcaaattatctcacatattactcaggttggctataaattgcataacttacatgattgggtgttgtcacatactttcttttctttgtttctctgtggccctcactgcttccatttctagccagcaccacctcacaacttgcccatctgagcctctgttactcatttgtttggttggaaaacctctacagcccatttgtagactgatggctgaagaggggcagtgaccaaggattgtgttcatctgatgaacagacgccagtgatgctgttcagcaccctgcaccacccgggatgaccccagtgtccacagtgctgagggtcagacacattcagcctgggtctagcactgtgctcttaggtagagggatgtggcctggcgtggggctgaatgaggtttggttttccctcttgtgtgtgtatggcagttatttgtgtggacttcagcaccactgcagttcaaattcagccaccttgcctcctccgtggtgttttctaagagtctccaaggtgtgatgcctacgtgtaataccttaccggggagccctcctcagcttccttacctttctgctgggtgtatttgttctgcttctgtacaaataaagtactggccaggtgtagtggattgtgcctgtagtcccaacactttgggaggtcaaggcagccgattgcttgagcccaggagctggagaccagcctaggcaacatgggggaaaccctgtctctacaaaaattacaaaaatcgggggcatcagagcacggcttgtagtcccagctactcgggatgctgaggtgggaggattgcttgagcccaggaggtcaagtctgcagtgagccgtaattgtgccgctccagcctgggcaactgaacgagaccctgtctcaaaaaaaaaaaaattaataaaaatgaagtactttacactaccgggtaatagacttaggaaactgattgtctcactcagtgtggggagaagttaatgggtggacttctcactcagactgttgtaatcatctcctaatttacctgacaagcctccgaagaggaggtcccaggagttacttagtggctcttcatcctccaattcatggtacatgggactgccacgttgctctgctaacatatacactttacttagttatttatttatttgacaaggttttactctgttacccaggcggagtgcagtggcgcaatcttggctcactgcaactttcatctccttggttcaagtgattgtcctgccttagcctcccaagtagctgggattacaggtgtgcgccaccacaccaggctttttttttgagatggagtctcactctgtcgcccaggctggcgtgcagtggtgcgatctcagctcactgcaacctccgacccccggggctcaagtgattctcttgcctcagcctcccgagtagctgggattacaggcgtgagccactgcgcccggcctcccttgaggtttaaagagtacaggccagttatcctgtaggacatccctcactttgggtctggtggctgcctcatggggggattcaggttttgcattttgagctgaataccccagagatgtgtcctggggcttctctggtgaatgcttccagtgctgtctgtgttgcttgaagggtccagtttgagctctaactggagcctcagcaccagctctgttttagccacagattgaagcctccttcagggttgcttccagctctgacctgtgtcttccttacatcctctcttgcccctccatcacttctcccccaccaccaacccccaaccccctgaggatataaaatctctgagatgtgtctgttctcaaggctgcttgccaatcctgcttcccttgagggatgcctttcaataagcagttactgagttcctgctgggtttttattattattattattattatttttgagacagtacacagggtcttgctctgtcactcaggctggagtgcagcggtgggatcataacttgctgtagccttgacctctgaggctcagtgatcctcctgcctcagctacagatgtgcaccaccatgtccagttaatttttaaaaaatttttttgtgtgtgtggagatgaggactctttatgttgcccagactgggctccaagtcctggcttctaacagtctccctgccttagcctcccacaatattgggattatgggcatgagccactgtgcgcagctgtgctgggttttgttctgagacacaaagattgggaagtcagttcccttttttttttttttttttgtgagacagagtctcgctctgtcgcccaggctggagtgcaagtggcagcatctcggcttactgcaacctctgcctcccgggttcaagggattctcttgtctcagcctcccaagtagctgggactacaggctcgtgccaccatgcccagctaatttttgtatttttagtagacatggagtttagccatgttggtcaggcgggtctcgaactcctgacctcaagcgatctgtccggctcggcctcccaaagtgtcagttcccatttttgatgagcgtgtagtgtgttacagcttactgcaaagtggaggggcagagcagtaggtgaggcttttggggtggatttagagctgagctgcagtctggtcggtttgtggggactcttcctccctctttttttttgagacagagtcttgctctgttgcccacaggctggtttgtggggactcttcctccctctttttttttttttttgttggagatggagtcttgctctgttgcccaggctggagtgcagtggcgtgatctcggctcgctgcaagctccgcctccaaggttgacaccgttctcctgcctcagcctcccaggtagctgggactacaggcgcccaccaccacgactggctaatttttttttgtttgtttgtttttatttatttattttttgactaattttttcaacttttattttagattcagggttgcatgtgcaggtttatttcctggttatattgcatgatgctcaagtttgggtatgagtaatcccatcacccaggtactaagcatagtacccaacagtcagttttccaactcttgccaccctctatcatgcccctgtctaatagtccccattgtctatttttgccatctttatgtccacaagtccctgatgtttagctcccacttataaatgagaacatgtggtattcagttttttgttgctgtgttaattcacttaggataatggcttccagctgcatccatgttgctgcaaaggacatgctttcattcctttttatggttgctattttttacttcttctttgtttactttttttttattatactttaagttctagggtacatgtgcacaacgtgcaggtttgttacatatgtatacatgtgccatgttggtgtgctgtacctattaactggtcatttacatttacattaagtatatctcctaatgctttccgtcccctctccccccaccccacaacaaaaactgaaaatggatcccttccttacaccttttttgtatttttagtagagaacaggggtttaccgtgttggcaaggatggtcgatctcgatctcctgacctcctgatttgcccgcctctcggcctcccaaagtgctgggattacaggcgtgagccaccgcgcccggcctgcctccctcttctttcccacccctctcccccaccccacttctccttcctctccccttttctctcctttagtttaccctgctccccctttctttacattttctttcctcccccactcctgccaatcagtctccgttggcgtctcatccctgagggcagattcatggcacctttatgtctccaaatgcctttaggccacgatacatagttcacattccctttattgaatttttttgtttgtttgaagagacaggatctccctctgttgcccaggctgctctcaaagtgctgggattacaggctcacatgagccaccacgcccagccctttgttgaatctttccatctaaacagtttaactatttatgtcctaggaagttagggtagccatttgaaaactaatccccgtcggggcgtggtggctcacgcctgtaagcccagcactttcggaggctcaggcgggtggatcacttgaggtcaggaattcgagaccagcctggccaacattgtgaaaccctgtctctactaataatataaaaattagccgggctttgtggtgcatgcctctaatcctggctacttgggaggctgagacaggagaattgattgaacctgagaggtggaggttgcagtgagctgagatcgcgctattgcattccagcctgggcaacaagtgaaactctgcctccaaaaaaaaaaaaaagaaaataaatacccataaattgaaggaaactgtattttatttttaaatagccacaattactaatgggttgtacagcttctcaaacttcagaatcagattggactccgtcccaccccaccccttgtttcctgttccatgttgatttcatgcagagcttgcttttttatcacagcagccactgcaaacagggctttattaggatgtgacgtcatcgggaagggtgtagctccatctgctgttggagcacgaaccccctcgagctgtggctcccttggtgtccagcagctgatgttctgctgtgcttcccttggctttaaaatgtctttcggtgtcctctgagatggctgcagtgtccctggcatcttgtttgttttgggagcttaggctttcatggcccacagtctgggctggactcatcactgtggtctggtgagtgggggtagtatgttcccatgagaaggggacccaccctctggaagtacctggacaagggtggaaggagggatctgtccctttttaagaatcaaaattaagtcttcggggtgctgcctgtcaccagaggggaggccataggatgcccaggaagaacccagggatgagggaccacaaaggggcctctccaacatgcagaatatggcttctatggtacaagtggaatttgtcattgaaaaaaaataaaatagttaaaaacggacttttagaagacagtctgtgtttttcttgacagatgcgacagatgaactgaaaacaaatgacttgtcagaataacaagtgactgcctttattggatgttccatgattctggccatggccttctctcctgtttttgacatagtaggcagataaggcagtggggatattcatgaatgcttttaaagaaaagaaaaaacaccagtgactgtgcagttgtgtttttattttgtgtgttttggggactgtaattgttctggattctccattatggatccatgtgtgctgctttgtggcatgtcctcagctagtgcagtgccagagggaagaattgcagtagcccctgtacccgtggccttgtcttttgaggtatggcaccataaaatatcacggtacagtacgagagagaccacattcccataacttttattacggtatgttgttatggtggttctgcttgattattagttattattgttaatttcttactgtgcctaatttataaataaaactttgttacaggattaagttcctatcatttgtataggaaaaaatacagcataaaggaaaaaatgtagtctatataaagtgtggtactatccacagtttatctggcatcccctgggggtcttggagcatgtccttctcagatatgggggtactgctataagtgcacatgtagagaagtttgttcccatgttaaagatatcgtcattgcttggcctacccatgttcccttctcaggtactccacccattgtccctttggcaagggcagctgcccacaggacttgctgtatcctccccagttccacagtgtaccagccacctggcctgcagacagtgagggagtgagttggtgcagaggagactctggagacagagacatggctgacatttgatgattgctgtgatttagaatcctaggctgcgttgaaccctgtacaagatgacagtgattggttaatagagagattcacagaggagcagagaaagcacactggaaggagagagagaggagccagccagccccaagagccatccgagactgggttcttggttcctctttccactttctcgtttccagtttagtttccttgggacctctcatattcctcctctccccacttcccagtgagaaccttggctagactgggtagacttttgaagtgggggtaaagtgaagtcaggagtagttttaattttccatttctagaattaatgatttcctaaaagatgtagttaataccaaatttcccattaaggcttctcattaatcagcaggattttgagacaggtgattggacagtgaatttaattacctggtgaaaatacctgaagtgattaaaatcagagtatgctctccatatacctgggctctcctgaatgtctttacggtattactgttttgtaggatacttccctcagaagagtgaacagtacaagagcctttttcttgggccttctgaattaataatattttttgttttaaatgaaatatcaactgttttcagaaattacattcttggttgtcccaacatatcaccaaactgttaattgctacattaggtgggattgtggagggggagagaggaacattaagaaattctaggccaggcgcagtggctcatgcctgtaatcccagcactttgggaggccaaggcgggcggatcacaaggtgaagagatggagactatcctggccaacatggtgaaaccctgtctctactgaaaatacaaaagttagctgggcgtcgtagcgcgtgcctgtagtcccagctactcgggaggctgaggcaggagaatcacctgaacccaggaggtggaggttgcagtgagctgagatcaggccactgcactccagcctggcgacagagcgagactctgtctcaaaaaaagaaagaaagaaattccgggccagtgcagtggcttatgcctgttatcccagcacttcaggagatcaaggtgggaggatcacttgagcccaggagttggagatctgcctgggcaacatagcgagaccccatctctaatttaaaaaaagaaagccctattcaggaggttgtggcaggaggatcacttgaggctgagagtttgaaaacagcctgggcaatgtagcgagaccagcccatctctgaaaatataaaagttagccaggtgtgatggcacatgcctttagtcctggctgctcaggagactgagatgggaggatacttgagcccaggaatttgaggctgcagtgagctatgatggtgccactgcactctagcctgggtcacagagcaagatcgccatctcttaaagaagaagaagaaagtccattgattaaaaaaatttgggaggctgctttacgccatgagtcctgagaacacagtggtgaaaaggtagagggccctgccctgagctccctgcttatcaccttccccagatcagtgctgtcaacttcactcttaggttaagaaggtcatagcatctagttctgtagacactattgcctcctcctctttgaaatagccaaagaagcaaacaccaggtgtctctctttccccaggttactctgatgtactttcctcactggaaaacagtgacttagtgttttttccttttatgggagtttttttttgttttttttttgagacggagtctcgctgtcacccaggctggagtgcagtggcgcgatctcggctcactgcaggctccgccccccggggttcatgccagccattctcccgcctcagcctcccgagtagctgggactacaggcgcctgccacctcgccctgctaattttttgtatttttagtagagatggggtttcactgtgttagccaggatggtcttgatctcctgaccttgtgatccgcccgcctcggcctcccaaagtgctgggattacaggcgtgagccaccgcgcccggccgggagttattgttttgcttgctttttaagtcattgctggttaacttggatggaatttgggttcttttttcttcttttcttttctttttttttttttttgacacagtgtcttgctgtgtcacccaggctggagtgcagtgggggcgatctcagctcactgcagcttccacctccccggttcaagtgattctcttgcctcagcctcccaagtaactgggattacaggtatccaccaccacactcagctgttttttttttttttgagatacggtcttgctctgttgcccaggctggagtgcagtggagctatctcggcccactgtaacctttgcctccagggttcaagcgattctcctgcctcagcctcccaagtagctgggattacaggtgactgccactgcgcctggctaatttttgtatttttagtagagacggggtttcaccatcttggccaggctggtcttgaactcctgacctcgtgatccacctgccttggactcccaaagtgctgggattacaggcgtgagccaccacgcccggatgtatttttagtagagatggggtttcaccatgttggccaggctgatcttgaactcctggcttcaggtgatccatccacctcggcttcccaaagtgcggggattacgggtgtgagccactgcactttttaattttttaaagacatgacgtcttactatattatccagtctggcctccaactcctgggcttaagcaatcctccttcctcagcctcgctagtaggtgggattacaggcatgagccaatgcgcccagcttaaaaacttacttaggaaggaatgtctgggactaacaggagatgtatctgtcttccttaaaacaggttttgtagtgagtccctcttgctgtgtatctgctgcttcattgtggtccccttcctctaccttttttttatgactgagcttttttgtactgtcagagtttaatttaagagaaggatagcagttggactgaacattccaggatggagacaataaagttaatttgtctctcacattcagaggtagaagtggcaggctttgtcagtgtttcagcaggtaagaaatcttgactagtaggaataagtcagaatctcagggactctttatacctgttcaccctgtccttgggaccccgctcagatttctccacaccagagtggccttctctggccaccttctaagagagacctccccatctcacctgtttccccttcttacgtagttttatgtttccttagcaatggatagcagttgatgtatcaaaataaagacttgcactgttcgcttaatgccttcctcgaccaacaagcaagttctagaacagcaagtgctgtgtcttgtttcctacggactcccctgagctgtggtgcctggcacatgattggagatgggcaggtcgttgttgagtgagtgaatgaagccatacaaatacgaacccagatattgaggccactttattgttaaatgttttatcaacaattgacacttctatcctattttcatgttgttatataatatgactatatatgtactcagactcccaagtaaatatttgtgcttactttactctgacctaaactggtgcctggcaccagagtaggctcacaaaatgcttttctcacagtgaccgcctaacaaacctagacattagctgaggtttatagagcactgtgtcattctaaatagcctgaagacatagtttctattattcctgtttccagttctctttctaaatcacagatgatttagaatatgggttataaaaacatttccaactcagggtactttctatattttgtgggttttgcaggaaataagctaagttttggaagcatgtcttttttcttgcttggtggggagatattttacctttaaaaattggctctcattctttgaggcaaaaatatgttcatgtttctaggatttctctttaagagactagtggtcagagttcggcagagaccaccaaagttgtctggggtgttcgtgcccatgtgtttggccctttctaggcttacttgactccctggggaggagtacctgggaatacagtcagtaagagctttaaattaggccaggctaaaaagtttgattttttccgtaggaggagtatttgaagacttctgagcggaggagtcgcatgtcagagctgtccttcagaaagataaatcaggcagtgctgttaagatggattgaagtggaaaagaggtgggatagagacacagattagtaacgggccaggcaaagatggtaagccatcaagaggctgaagcagtgggagtggagcacaggggcaggaggggaaagggatggaagggaggcttgagtctgtgctgcaggagagctgggagggactgccagcaggtttggaaaggaaaggggtgctgaggcttgctttacactggtggaatctgaaaggattgaaccctcagagcgctgcagtgcgtagagctttctaggaactggggtacattcagggaaagggaataaggagtggatcctcgacttgagagaagaaccacaaaagaaccagttgagggttcagaagggggcgtgactgggtgtggcagatgtggagctgggttggtgagagcaggatgaggggctgttgctggctcctgagtgtagggtaggcccgtaagttgcactccactcaggggctgagaacctgtgtgcatagcaaggcacacaagacattcacttttttttttttttcttaagagacagagtctcactgttgcccaggctgacatacagtggctcgctgctgccttcaactcctgggctcaaccagtcctcctgtcttagcctctggagtagctaggactacaggtatgcaccaccatgccaatttttttaaaaaatattttgaggccgggcgccgtggctcgagcctgtaatcctagcactttgggagactgaggcgggcgggtcgcgaggtcaggagatcgagaccatcctggctaacatcgtgaaacaccgtctctactaaaaatacaaaaaaaattagccaggcgtggtggcgggcgtctatagtcccagctacttgggaggctgaggcaggagaatggtgtgaacccgggaggcggagcttgcagtgagccgagatggcgccactgcattccagcctgggcgacagagcaagatgccgtctcaaaaaaaatttgagaggcaggatcttgctatgttgcctaggctggtctgaaactcctggcctcaagtgatcgccccctggtattacaggcgtgagccaccacgcctggctcctaacgtttggcatctctttttatatattcaaccacaatatgttgatttttttttttccagtaaagtgaatgtctctttatttattttttttgagacggagtttcgctcttgttgcccaggctggagtgcaatggcgctatcttggctcaccgcaatctctgcctcctgggttcaagcatttctcctgcctcagcctcccgagtagctgggattacaagcatgcgctaccatgcccggctgatttcgtatttttagtagacatggggtttctccgtgttggtcaggctggtctcaaactcctgacctcaagtgatccacccacctcagcctcccaaagtgctgggattataggcgtgagccgctgtgcccggccgaatgcctgtttaacagacattcagtctactgccaaaataaagtaaaggcttgtcctcatggtagcctgcaagactgtttgcatcttcatgtgaagttgtatggcttgcttttctgcatttgttctgtcctcctctaggtgtgagtagtgaggtttcctctttggccaatatttttttaaattaaatttaattaattagttaatttttgagacacagtcttgctgtgtcgcccaggctggagtgcagtggtatcccaggttcaagcgattctcctgcctcagcctcctgagtagctgggattacaggtgtgtgccaccatgccctgctaatttttttttttttttttctttgagatggagttttactcttgttgcccaggctggagtgcaatggtgcaatctcggctcactgcaacctccgcctcccgggttcaagcgattctcctgcctcagcctcccgagtagctggaattacaggcatgcaccaccacgcctggctaattttgtatttttagtagagatatggtttctccatgttggtcaggctggtctcaaactcccgacctcaggtgatccacacgtctcggcctcccaaagtgctgggaattgcaggcatgagcctccgcgcctggcgccttgctaatttttgtatttttagtagagacggggtttcaccatcttggtcaggctggtctcaaactcctgaccttgtgatccgcccgccttggcctcccaaagtgctgggattacaggcgtaagccaccgcgcctggccggccagtatgtttttgagaaaaatacatggtgccacgaagttgaaggcagccttcccctgaggattataaaatccaaacccaactgaagactagattgaattaacccctcatccccacacagtagtggctcagacaaagaggtgtacccaattctggttttattgaatatcatctgataattcaataaaaaattatgagatacacaaaaaagcgatttcttgttaagagagaaataaatggaagccaacttagagatgacccagatattggaactgccagagactttaaatgactgtgatggatgtggtaaaagattgagtgagaaaggtatacagcatgcattatatgtgaaaagatcgagaatttcaggaggcagaaactctagaaaaagttaaattgaaatgttagagattctttaaaaacattatagatgaataattttctcagtgagtttgtcagcagataggaaagaatcagtgaaactgaagataggtcaatagaaatccaaaatgaaacaagcagaagaaaataaaccagaacaaaaatagcatttaggctgggcgcggtggctcacccttgtaatcccagcactttggggaggccgaggtgggcagatcacctgaggtcgggagttcgagaccagcctgaccaacatggagaaaccccgtctctactaaaaataaaaaaaattagcagggtgtgatggcacatgcctggaatcccagctactcgagaggttgaggcaggagaatcgcttgaacctgggaggcggaggttgtggtgagccaagatcccgccattgcactccagcctgggcaacaagagagaaactccatctggaaaaaaaaaaaaaattagctgggtgtggtggcgggcacctgtaatcccagctactcaggctgaggcaggacaatcacttgaacctgggaggcggagattgcagtgagctgagattgtgccattgtacttcagcctatgtacagagcgagactccatctcaaacaaaaaaaaagtgttgagtagttgtgagactatagcaaactgtcaaatatacagataattggagccctaggaagaaaacggggcagaagaaatattcaaagagctaatggttgagaattttttcattagtaaaagacaacaaaccagaggtctgtgaagttcagaggactccaagcaccataaatataaacaaaaaaccctcaacacctaggcacattatagtcaaactgctgaaagtcaaagagaaagttttgaatgtagccagaaaaaaagtatttcatacaggccaggcatggtgggtcatacctgtaatcccagcactttgggagactgagtggcagactcacttgagcccaggagtttgagagcagcctgggcaacatagcgagacttcatctctacaaaaaaaaaattatccaggtgctctggcggtgcctgtggtctcagctactcaggagactgaagtgggaggatcgcttgagcctgggaggttgaggctgcagtgagccaagattgtgccactgcactgtagcctgggtgatagaatgagacctagtcccacaaaagacttcctcagacaaaagttgtggggtttgttgccagtagatctgccctgtgagatggaggaagttcttcaggcagaagtgtatcccatcacactgcagttatcttctggtgctatatctagtttaatataaatcagaccaggcaaatgaagagatatatacagcaaggcctagcagagtctcaagcacacatcctccaagccctctccccatggagtctctcctgacaaatcggggtcaatgagcttctaaccaggaagctcccctgagccttggtgttgagagtttttattggggctttgttacttgggcacaattgatagagcacaatctctagcccctctcccaccccagtcagaatggtttcaaaccccaaccgtctaatgtcatggtttgtctttctggtgaccagcctctatcttgagtcagctcatctcagcaaaaacatggaggctcatgaataacaaagacatgcctatcactccggaacatccaatagtttttgaagctccttctgaggaactgggaacaaagacccagaaggagtcttcaaaaaacatgtagaagtaaaatgctagacagttgtgttacaaagagtgaaagggaaggaatatcgtgacccttaacacagggattaggagtgctaacctgctgtgcagtcaaaattcttctatcacttgactcccaaaacatgaactactaatagcctgctattgactggaagccttaccgatagcagtcaaaagacagtttttatgttttatatattatatatttttgtgatcaagctagagaaaatattaagaaaatcataagggagagaaaaatgtatttactatttaatgagtggaagtggatccctcataaaggtcttccttctcattttcaggttgaggctgaggaggagaaagagatgggattggtcttgctgtcttggatggaggtggtggaaggggaggtaggagagacaggcatacttggtggaactttactgaaatacataatttctgacttctttctttttcgttttattttttctttttctttttttttttttttttgcctgggctggagtgcaatggctcagtcttggctcactgcagcctccgcctcctgggttcaagcggttttcctgcttcagcctcccaagtagctgggattacaggcgcccgccaccatgcccggctaattttttttatttttagtagagacagagtttcactgtgttggccagggtggtctggaacacctgatctcgtggtctgcccgctttggcctcccaaagtgctgggagtacaggcctgagccaccgcacccggcctgctttttcatttctctaaaaaagtttctgtatgatagcaaccttctgttgtatgctttagttttagttcctgtgccataaaagctctgtgtcctaaagaagtcaagtgcagtcttggggaatggggaccttctgccagattgcccagtgtccacgtgtttttggcactgcttctttctcatcgtttggcaccacgttggaagtactgacatctgtcaaggtgtgttctgttaattcctctggtgtggtgtctaatagctcttgaatttctctaagatccacatgttgaagtccttacccacccccctacccttttaaaagcatatgcacagtcttttcatgatttcctcgtctggctctcgtaaatcctgtgaggtcaggcgcagcatctggacgtcgtcctctccagcaggagttgattgtttcaggctcatggccttcacagctttttctgtaacaaccttggcatcttcagcaggataatccttccagacttaaacaatgttctgtctattgggattctcttccatagcattgacaattctttccatagagtactgtgtgttatgagccttaaaggtccttatgaccccctaatctagaggctgaaggagaggtgctgtgtttgggggtaagtagaccacttcattgccgtcagtattgaactcatggggttctgagtggccaggggccttgtccaatatctaaagaactttaaaaggcaatcccttactggcaaagtgtacttcctgactgcagacaaagaacatcgatggaaccagtccagaaaaagggattttgttgtcccagtcttgttccacaaccaagagactggcaactggtgtttatctcttccccttcaaggctcaggggttagcagctttgtagataagagcagtcctgatcataaacccggctgcatttgcacaaagcagtagagttggcctctccctgcctgccttcagtgctggggctcacttttcttccttactaataagtgtcctttgtggcagttttttccagaatagggcacttttgtctgcattaaaaacctattcaggaagattttcttttcctcaatgattttcttcatggcatctgggaaccctggtgcctcttggttggcagaaactgcttctcctgttatcttaacattttttaagccaaccctctttctaaactgatcaagccacccttttgctggcattaaattctctagctttaagtccttcactttcagctagaaccagtggctcattcctataatctgagcactttgggaggccaagggaggaggattgcttgagaccaggagttgaagaccagcctgggccacatagtgagaccctctctccataaagaaacaaaaaatttagtcacgtgcagtgtggcacatgcctgaatccttgctacttagggggctgaggcaagaggatggctgtgcctaggagttcaaggtttcagtgagctgttcaaggctgtcacccacttgggtgacagtgagactctgattgattgattgattgattttgagatggagtctcactttgtctcacagcctggagtgcagtggcatgatctctgctcactgcaacctccgtctcctgggttcaagcgatccttctgcctcagcctcccgagtagctgggattacaggtgccagccaccacgcctggctaatttttttgtttttagcagagatggagtttcaccacgttggcctggctggtttcgaactcctgagcttaggtgatccgcctgccttggcctcccaaactgctgagattacagacatgagccactgcacccggctaaatcttactccttctatgtgtattggcattcctctgtaaagaagagcttcgcttttcctctttttttttttaatttatatgttaccatgtgcttgtgtgttctttttttagatccagtaaggtatattccattaccattgttcgtcatgttgaccctcagattgtcctaaatttggccagcagacttccttcaagctggtgtgtttttgacatgttctttttagttttggagcccttcctttctgccatagcaagagggttcctgtgccagaccttgagggagtgatttctcagaggaaccctgaagctccttttaaagggaaccgtttttataaaaccaagatttgggctttgtgtgtggagaggtcgttgcttccagacctttcagttgacaagagataggagatatacgtgtgtgtgtgtgtgtgtgtgtgtgtgtgtgtgtgtgtgtgtgtgtgtatggacttacacacaaatgattctacagcggaataaatgtatagagaatttccattgtctccaaattcagattgaaccccagggggccattccttgctttcagatagtccgtgttgtgcctcccttctccagtgtgagccttgctccccaaataaccatatcttcgcttatttcgctctggcatacatatccatattaatattttaagcattattattattatttttattttattttattattattttttttgagacggagtctcgcactgtcacccaggctggagtgcagtggcacgatctcggctcactgcaagctccgcctcctgggttcacgccattctcctgcctcagcctcctgagtagctgggactacaggcgcccgccatcccacctggctaattttttgtatttttagtagagacggggtttcactgagttagctaggatggtctcaatctcctgacctcgtgatccgcccgccttggcctcccaaagtgctgggattacaggcgtgagccaccgcacccggcctactttaagcattattatgccaccaatatgacgcttaaatttcagaactctatttgcccttagaatgtacccccacgtttgtacagttagagtattctaaattaacgtgatgtctttagacctttttttggttggttggttgtgttttacaggtattgttatctttttattgatactgaactctaatttttgtttgaaagaaggcatttctagtttgtttttatcctgtttattagtatgatcatatatagttgaagattatgatacagagttgtcattaagttcagtattatttcacattctagttgttcagtgtgtttttgaattaaagaattatttggaagggagtttactttgtttcttacaagcccccaggcctttaggcaaaactcttggggctggatgttttccggaatatagactttttcagggttgagaaagatgcagtgagtatgttacatgtgcaccacacttacggcaaggctttaatcagataccccaaagtttgtagtaaacataagactgctcaccctgaatgtgagaaagtctgcctaatgccgtgtgtcctattctggtttgggtatctcagaattgtagataaccagtggtgcacttatgtgtttcccatcttaggattatgttgatagagaagaaatcatcccccacaagtatacctgtacttgattagaaatattaatgcagcttgtagagaaattctctaggtatgtctcaaggattcagtttctagattttgaaaaatgctgaaataaaagtataagtactaggatatgtgcaaagaagtcatattaatatttaatattgctaaattagctgtatagagtcagttgattttatcaagagccttgaaaaagtgcccatctttttcttttttttttttttggagacggagtctcactctgccatcgaggctggagtgcagtgatgcaatcttggctcactgcaacctccctgtctcaggatcaattgattgtcctgcctcagcctctcaagtagctgggactacaggtgcatgccaccgtgcccggctaatttttttattttttaaatttatttttattttattttaatttttttttgagatggagtcttgctctgtcacccaggctggagtgcagtgacgcaatctcagctcactgcaagctctgcctcccgaggtcacgccattctcctgcctcaccctcccaagtagctgggactacaggcacccgccaccacgcccagctaattttttgtatttttagtagagacggggtttcatcgagttagccaggatggtctcgatctcctgacctcgtgatccgcccgcctcggcctcccaaagtgctcggattacaggaatgagccaccgcacccggccagtaatttttgtatttttagtggagagggtttcaccatgttggccaggctggtctcgaactcatgacctcaggtgatccacccgcctcggcctcccaaagcactgggaggtgcgagcccagctcctgatgttctttaagggtagtgctactggtttagggttacattattgtgggactggtagtcctgtccttagtgtggggttctatgagctggatagtcagaaaaagagcatacatttgggtcatcttgtttttagccagaaatgggtccagacaactctccatgtgaatccaggctaaggtgatttgatagcacttttagcatccttactccaatcttgagtcatgatttgagccacagggcaatctaggcattaaaatagagcagctgggtgcggtgccttgtgcctgcaatcccagcaccgtggaaggccgacctgcaaggatcgtttgagcccaggagttaaagaccagcctgcgcagtatggcaagaccccatgtctacaaatatatatatattttttaattagctgggcatggtggcacacacctgtggtcccagctactcaggaggctgaggcaggaggatcaccttagcccaggaagtcgaagctgcagtgagccatgattgtgccactgtactccagactggctgacagagggtgaccctgtctcaaaaaaataattaataatgataaaatagagcagattatgtataattttttttagtagtatttctcttcctacctgtcccttgatctggaaagtacttgaaaagatttatatttagtggttgagataattgtgacagttgaagagttctcaactggggtcagtattgcctctcgggatgccaggtggctgttacagctggggaaaggagcactactggcatgctgccagatatcctcctggggacacacacacacccctgcctaaaatgttcattgtgctgaggttgagacccatgctttgaaacttgatttggtggcacttttcgggtatgctcataggaccctgccccggagcgaggcttcgcttcctgaagtctggggtagtttgcatcattcactgtttactcctgtgtgccttttcacacccaactttttttctgaggtgaaattcacataacataaaccattttaaagtgaatgattcggtgccgtttagtacatttacaatgtgttgcaaccaccgtctctagctaattccatgacattttcatcacctcaaaaggaaaccctgtacccattaaataattgtccactgcacacacatgtgcatgcacacgcagacacatgcagcccctggcaaccactgcattctgtctctttggatttgtgtgttccggatatttcatgtaaatggggttgtatatatgtggctttttgtgtatggcatctgtcacttagcatatttgtgaggtttgtctgtgttctagcagagacaggaccaggacttcttttttttttttttttgagatggagtctcactctgtcaccccgcccaggctggagtgcaggggtgcaaccttggctcactgcaagccctacctcctgggttcatggcattctcctgcctcagcctccagagtagctgggactacagacgcccgccaccatgcccggctaattttttgtatttttagtagagatggggtttcaccgtgttagccaggatggtctcaatctgctgaccttgtgatctgcccgccttggcctcccagagtgctgggattacaggcgtgagccaccgtgcctggcaatttttgtatttttaatagagacgaggtggccaggttggtcttgaactcctgacctcaggtgatccacccgcctcaccttcccaaagtgctgggattacaggcgtgagccaccacgctcggcctcctttatctttatagctgaataatattcaattgtttggatagaccacattttattcatccattcatgctcagtgggtatttgggctgtctccaccttctggctgctgagtactgctgctaagaacataatgtgtacatgcattgaatccctgctttcagttcttttgggaatatacctaggagtagaattgctgggttatggggtaattctgtgtttaattttttgaggaactgccaaactgttttccttccacactcatttttactgccggaaaagtacgtgcttgcttgtacataagcagcataattgcaaaacgaaactactttaagtaaatgaattagaattcacagttcaactgggagatatttcagtttgttgattcatctactgactccagactagatgtgtgcatgtgagtttgcagactcacaagacactgaattaataggcaggtggtgacctgtgaagcctccacaagtggtcttttcacatagtttaatttgagggagcgattacagaagcatctttaaatgttctgaaatcaggccaggctcagtggctcaggcctgtaatcccaacactttcggaggctgaaacaggcggattacctgaggtcaggagtttgagaccagcctggccaacatagtgaaaccccatctctactaataaataataaaaggcatggcgtgtgcctgtaatcccagctactcaggaggctgaggcaggaaaatcgctggaacctgggatgcagaggttgcagtgagccaagatcatgccactgcactccagccagggtgacagagtgagaatctgtctcaaaaaattaataaatgtggccatgtgcagtggctcacgcctgtaatcccagcactttgggaggccgaggtgggcagatcacgaggtcaggagatcgagaccatactgaccaatatggtgaaaacccgtctctactaaaaatataaaaattggctgggagtggtggcatgtgcctataatcgcagctactcaagaggctgaggcaggagaatcactcgaaccagtgagtcggaggttccagtgaactgagatgataccactgcactccagcctggtgacagagcgagactgctgtctcaaaaataaaaaaaatacaataaatgttctgaaatcagaagaaatctagaattggacatattttcattccaccagaagtatgtcaagaggagtcagaaacctctcttgtgatctctgtcaccattcaagccaccttcctgggcaccagggccaggcactggatgggaccgtgtcagcaggagagggacagagggagggattggaagtgtcccaacatagacttgccaggactcacaaagtagttatttagtggcttccttgagattcagatgaaatgctctccactgtcatgccaaacaggcaaagtctggattaaattaatcttcagaatttgttgaattgtattagtgttgtgtctgtgtgtgtgtgtgcgtgtgtgttttgagacagagtctcgcactgtcacccaggctggagtgcagcggcacgatctcggctcactgcaatctccgcctcctgtgttcaagcaattctcctgcctcagcttcctgagtagctgggactacaggtgcctgccactacgctcggcgaattttttgtatttttagtagagatgaggtttcaccatattggccaggctggtctcgaactctttaccttgtgatccgcccaacttggtctcccaaagtgctgggattacaggcaggagccacggtacctagcttttttttttttttcttttcgagacggtgtcttgctctatcacccaggctgaagtgtagtggcgtgatctccactcactacaacctccaccttctgggttcaagtgattctcctgcctctgcctcccaggtagctggggttacaggtgcctgccatcacgcctggctaatttttttaatttttagtagaaacgtttttttttttagttcgctgccaagaacataatgtgttcttaaaacacattaaaattaaaaacatttaatttttagttagccacgttggccagactggtctcgaactcttgacctcaggttatgcgcccacctcagcctcccaaagtgttgggattacagatgtgagccaccgcgcccagactgttgtgtgtttttgttttgagacagattcttgctctgtcacctaggctggaatgcagtggaatgatctcggttcactgcaacctccacctcccggatttaagcgattctcctgtctaagcctcctgagtaaccgggattacaggcttgtgacaccatgcctggctaactttttttttttgtatttttagtggagatggggtttcaccatgttgaccatgctggtctccaattcctgacctcaggtgatttgcctgcctcagcttcccaaagtgctgggattgcaggggttagccactgggcccggcctgcattagtttttaaattgttactgtaatttttctagtgataggattctaacctctgtgcccatacttttcagtttaattcaaggtattttccctggggcatttctaaggattcttaaagaagttgagatctgatttcttattttgttcccatgctgaaaaacaaaatatgacagtactgctaaataaagcaattttgggggagaaatagtaatagggaagggtcaaatttatgtgtcgttgcataaaatatagctactagcaaaatagaatattttattcacaacctgagtgcaatacaaatacagccttttctgtttgtttcagacaaatttacatgtattggagaccagaccagaagcccttctgaattaaggtaattttgatatatttgatcctcatcagttttagaaagacaatatataaatttcttcagagtttgtttttataaatagctggtgggttggttttttaaagagacagtgttttgccatgttgctcagactggattctaactcctggggtcaaggggttctctcacctcagcatcctgagtagctgaggctatagacatacgccagcatgcctggtcaataccctggtttttgttacagtttttttctatctcttttaagccaaagttggttttcaaaacaatttgatcctcaaaaaaagcttccatttagtgttgagcaagaaggtttagggtcccagtgatgaggatttaccttctgaatcagagtggtacatcgctagtttttttcgttagaaagcaggagagcccttttttcaaatcagatcttagttgaaataccaatatatggccgggtgcggtggctgatgcctgtaatcccagcactttgggaggtcaggttgggtggatcacgaggtcaggagatcgagaccatcctggctaacacggtgaaaccctgtctctactaaaaatacaaaaaattagccgggtgcggtggtgggcgcctgtagtcccagctactctggaggctgagtcaggagaatgatgtgaacccaggaggcggagcttgcagtgagccaagatcataccactgcactccagcctgtgggacagagcgagactccgtctcaaaaaaaaaaaaagaaaagaaaaaaaagtaaggtgaacatgattcaggaaaacaaaacaaaacaaaaacctttttgtttgaataaagtgggaataatgaagccatgttcgtagtgagtgagtctgggtgaggagggtacatggtttctttgtattattcttgcaactctttgaagtttgaaataattttaaattaaaaagcaaaattaaattgaatagcaattaggggctggaacaattggatattcttttttttcttttgagacagagtcttgctctgttgcccaggccgaagtgcagtggtgcaatctcagctctctgcaacctccccctcccaggttcaagccattctcctgtctcagcctcccaattagctgggattacaggcgctcaccaccacacccagctaatttttgtatttttagtagagacggggtttcaccatgttggtcaggctggtctcgaactcctgacctcaggtgatccacccgccttggcctcccaaagctgtgggattacaggcgtgagccaccacgcctggttagtcaattggatattcttacgcaaaaggagaacttgacatcatgtacagaaattaactcaggccaggcaaggtggctcacctgtaatcccagcattttgggaggccaaggtgggcagatcatcaggtctggagatcgagaccatcctggccaacatggtgaaaccccgtctctacgaaaatacaaaggaaaagatttagccacgtgtggtggcacgcccctgtagtccagctactcaggaggttgaggcaggggaatcgcttgaacccaggaggcagaggttgcagtgagctgagattgcaccgttgtgctccagcctggtgacagagtgagactccgtgtcaaaaaaacaaaaacaaaaacaaaaaggccaggcatggtggctcacgcctgtaatcccagcactttgggaggccaaggagggtggatcacgaggtcaagagatcgagaccatcctggctaacacgatgaaaccccgtctctactgaaaatacaaaaaattagccaggcgtggtgatgggcacctgaagtcccagctactcaggaggccaaggcaggagaatggcatgaacccaggaggcggagcttgcagtgagccaagatcacgctactgcactccagcctgggtgacagagtgagactccgtctcaaaaaaaaaaaaaaaaattaactcaatggatcatatacctaaatataaaacgtaaaattagaaaaaatgagattttgaattaagcaaacagtttttagatgtgagatcaaagatagaatgcgtaaaagaaaacatttataaattgaatttgttcaaaatttaaaacttctgctccttagaaaaaacagagaacgaaagacaaaccatagtctggcagaaaatattagcaaatgtcttttagatgacttgtatccagaataggtaagaactctcaaaactcaattttggctaggtactatggctaacacctgtaatcccagcactttgggaggaggattgcttgaagccagttgttcgataccatcctgggcaataaagtgagacccctgtctcttcaaaaaaaaaaaaaaaaaaaagttagcagtcgggcacggtggctcacacctgtaatcccagcactttgggaggcccaggcaggcggatcacctgaggttgggagttcgagaacaacctggccaacatggggaaaccccatctctactaaaaatacaaaaattagctaggtgtagtggcttatgcctataatcccggccatttgggagactgagacacaagaatcacttgaacctgggaggtggaggttgcagtgagtccaggttgtgcaactgcactccagcctgggtgataaagcgagactgtctccaaaaaaaaaatttagccaggcatcgtgttgtgtgtctgtagtaccagctacttgggaggctgaggtgggagaatcacttgagcccgggatgttgaggctgcagtgagtcacgatcacaccactgtactccagcctggacaacagagcgagaccctgtgtcaaaaaaaaaaaaaaaaaaaaaagcaatattaagaaaacaggtaacccaataaaaaagaggcaagtgacttgaacagacactttaccagaaactgtatagacagcaattgagtgcctcagaagctcagcagtcagcgagatgcagatggagactacagcccacgcccccattagaatggctgtgacacccacccagcgttgttgggcgtgaggagccgggactctccacattgcttataggatgttgggaatgtgacccagcataaccattttgaaaagagttggttttttttgttttttgagtttgttttttgtttttttgaaatagggtctcactctgtctcttagactggagtacaatggtgtgatcatagctgactgcatccatgacctcctgggctcaagtgatcctctggcctcagcttcctaagtagttgggactataggcacgcactaccatgtctggctttttttttttttttttttttctttttttaattcttgtaagacggggtctcagtatgttgcccaggctggtcttcaattcctgggctcaagtgatcctcctgccttgcctcggaaagtgctcagattatagtcatgagtcactgcacctggcctggcattttcttggaatgttcaacacacacctgtagtatgatccagccattccaccgctaggaatctgcccaagagaagtgaaagcagatgttctcataaagacttgtacatgtaacaacatgcacagatttcaaagtatcacatctatctgattaactccactgttacactggttgccactgctacatatatttttgatttctgcaaaagggcctactgcactgactggatggaaagtgtggcaggtgaggcaggaggtagttttctggacattacttaaaactttcagggcaacagttttacacctgctttcatagcaagtcatatttagtaagcatttactgtgtcagtcatggttctaaggggcttgcatggattctaatggaattgtcatagcatgagctgtggggactattactgtccccactttcagacaaaaaaatgtaggcagagagaagttaggaaacctactggaggccacctggtgagaagagatagagtctgggttagaacctggggcttccaactttcctgccatgaagcgtcactctgcttccagccagggctgtcagacatcattggtcctgcttaagtgggctggacctgcaaatgccaataaaaacacggaagtttttctaggaacagaattctaacccccaccgcccatttgctgttgggaaagcacatagtattcattgtagtttgcagcagtaaatgtaaaaacaaagattatttttatatactggagtgcagatggcatggcacacagcagtctttccctaaacctaaggatttccaggccccttataaaaggtgcttggaggccgggtgcagtggctcacgcctgtaatcccagcactttgggaggctgaggtgggcggatcatgaagtcaggagatcaagaccatcctggctaacacggtgaaaccccgtctctaataaaaatttaaaaaattagcagggcatagtggcaggcgcctgtagtcctggctacttgggaggctgaggcaggagaatggcatgaacccgggaggcggaggttgcactgagccgagatcgcaccactgcactccagcctgggcaacagagtgagactccatctcaaaaaaaaaaaaaaaaaaagtgcttggagtttagcctcctctgttgtgtgcgctgcatgattgttagtttctcaccacctttccctgttagacccgtcttctggatggatgccattcatttcatgagactccatcagttacatataaagtttggctttgaaatgatcaaagtgggacttccaatttggcctcaacatgtttgaagatgtgtatctattgaatgatttccaattgtcctagtatgtgctagattttgtgctccgccctaaaagcaaaaagaggccataggctaacagggttagaaaagggagagcagaatgggagatcagatgttttttgtgatgcatgagaaataataaggcttcgggagagtcagtagccacttctgggatttcagagttccaagggtcagaggtaagctcttagcagctgtgcctcactggctcacccctggctgttagacccctccctggagaattgccttctgagggctttgtgaccgcacaccatagttcctgcccttcccccagttgccagcgtctaatgggtgagtgagctcacttgtgactgggacatgaaggagatgattctggggagtctcttcacttagtccagaaatcctccctccattgtttgctttctctcctttttcccttgaagtttatttgttaaagacagactaaccgacctgcctggtcgtctgtcctggagtgtttcccaggccattgtgtagtaccgttgcctctgtggggtcattgaacatgtttccctgtcttctagttctagagctttggtcacattcactttttcgttaagattactttataggcacaggcaaaatcctaaggtaagatttttaaaattgttaccattgcaaaaaatagcacctcaaacaagaacagttgtgttatttttgcccatctgcctgctgctcaaatgttggcccattagcaaggtcatgtctaacagccatgcaaagcagcatcctccctgccctcgttggcacacttcacccgttcgcagtgactgtgtacgctcccagcctctgtaactccacgtgatttacctgtttgtcttctgtctccctcaaactagaatccagcctggttcatgctgctcagcaccatgctgaggctctacagtgcctgttgtgttggagggagggtctgcgcatgcgttgctctgcagctgcgttagtggtcgtgtcctttatcagttgcggtggtcccctgctccccttattcctcacagtattgttaggagcggtgcgtaagggaagcagggcctgaggactttttccgttgccctttgaattcccacagtcttagttttggagattgacctggacttgggaatgaaagaaaaatggaaaagtgagtgaaattggtttaaattcctcatgcaaactcctctctttcaaaatgctgcttcgtcttggaggtgagctgtgatccttgtgtgtttggtcaagttagcaaatttcctgccccggtgtaagacactggggccggtttggacttcggaagttgtccaaaccatccagagatgcagccatccagtgctgcacaggaggctcaggggtgtgcggctagctggtgaccaggtgactcaggactgccctgttgctgcttggtggtgggaccacatgtgtgcactttggtgagcatggtgcctgttgtccttgagattgttagtcaaaggtacacgtcatagtttaatcactgtgagactgacagagcactttcagattggttgtctgatttaattttcattttagctctgtgatatagataacaccattcccattttgaattaagcagattagagtaaaaaacaatttagtgaaagcattattctttgtatgttgcagaaccagaacttgaaattatttttcaatatctgtaccctattttgtcattggcaaacttgcagcctgaatgttgttattggtgactgtgtaatatggggtcctgagggcaccgctgaggtgcccctcctagactctcaggggtctggatgagaggcctgggctgctgcattgccatgaagggtagaggcactacacggagcacattgcattgcaaatatgaaatattctgactttaaaaatcttgctaacacttgactcacaaagatgttgttctaaagtaggggcagatcccttcacctgcttgcttttaagttattcaaatctctctcaaaaggatttccaaaactcagattctgaataaaagccaatggcagatatgggtcatcaggaagactagacatgaggccttagcagagcctgtcttagtggattagacgggcgggctcttggagtcagcacagccagagcttagccgtgacgtcggcaccggaggagaggagcccaggccagggaaacctggtggtgggtgttctggaaggtctgggggactgagggaagcgaagagaaaagcaagagcaattaaatgtgagtaagacttttaaaatttacatttattctttaattttcaaaggaagctgcatcaatattacgtttagtagaaaaacgtgactaatagttataataaaaatgctattctatctttctttaaagtgagtatatttttcttttttcttttcttttttttttttttttgagacaaggtctcactccatgtgctcaggctagagtgtagtggaacagtcatggctcactgtagcctcaatttcccaggctcaagtggattctcccacttcagcctcccaagtagctgggactacaggcgtgtgccactgcgccagctaatttttgcatttttagtagagaccaggtttttgccatgttgttgcccagcctggtcttgaactcctgagctcaagccatctgccagcctcagcctcccaaagtgctgggactacaggcatgagccaccgcgcccagacctattttaattataataaagcagctacaattactacatgtgaccgggtgcgtgtaatcccagtactttgggaggctgaggcaggcagatgacttgaggtcaggagttcaagaccagcctggccaacatggcgaaaccctgtctctactaaaaatacaaaaattagccaggtgtggtggtgcatgcctgtaatcccagctacttgggaagctgaggaaggagaatcgcttgaactcaggaggtggaggttgcagtgagccgagatcgcgccattgcactccatccagcctgggcctcagagctagactcagtctcaaataaaataactatatgcaaatttatattatttttgacttagtatatagtaagcgttttcccaaattattactgtcttccttattgttcttagcaatatgttacagttattccagtaactatttagagacaggatcttgctctgttgcccagattggagtgcagtggtgctatcatagctcactgcagccttgaactcctggactcaagcgatcctcccacctcagcctcccaagtaggtaggactacaggcacgttccacgatacccagcgaattgcatcaagtaactttttttttgagatggagcctcattctgtcacccaggctggagtgcagtggcacgatctctgctcactgcagcctccgcctcccaggttcaagccgttctcccacctaagcctcccgagtatgtgggattacaggcacgcatcaccacacctggctaatttttgtattttttagtagaaacggagtttcaccacgttggccaggctggtctcgaactcctaacctcaggtgatccacctgcctcagcctctcaaagtgctgggattataggcttgagccattgcacctggctgcatcaggtaactttaaaaagttaactttaggctgggtgtggtggctcatgcaatagattagagtctagcgctttgggaggccttggcaggaggatcacttgaagccaagagtttgagaccagcccgggcaacatagcaaggcctcgtctctaccaaaaatttcaaaaatagctgggtgtgatgggtggagtctgcttgtagtcctggctactctggaggctaaggtagaaggatggcttgaactgcagtgagctatgatcatgccactcactccaccctgggcaagagtgtgagaccctcacagaaattttttttaaaaaatgtaacattaaggctgggcgcggtggctcactcttgtaatcccagcacttcgggaggctgaggcgggcggatcacgaggtcaggagatggagaccacggtgaaaccccgtccctactaaaaatataaaaaattagctgggcgtggtggcgggcgcctgtagtcccagctactcggagaggctgaggcaggagagtggcgtgaacccgggaggtggagcttgcagtgagctgagatcgcgccactgcactccagcctgggcgacggagcaagactccatctcaaaaaaaaaaaaatgtaatattattttattgaaactgaaaagtataaagaaaaaaatgtttctttgttctaggaccccagattagcctctgttaactttgtatgcgtgtgttggtgtgtaggggggttagtaagcaaactatatttgaagaataatgagaagaataaaagctgctaacctgtttctctttctccaaaaacaacgccataacatctggtgtgtgtagaaaaaagatggcgggccgggcgcagtggctcacacctgtaatcccagcactttgggaggccgaggtgggcggatcacctgaggtcaggagttcaagaccagcctggccaacatgatgaaaccctgtctctactaaaaatacaaaaaattagccggttgtggtggcatgtgcctgtagtcccagctactcgggaggctgaggcaaaagaatcgcttgaaatcgggaggcggaggttgcagtgagccagcactgtgccactgcactctagtctcagcaacaagagcaaaactccatctcaaaaaaaaaagaaaaaagatggcttgccctggcattggcgtttgtccttcttgtacacacaaaagcatcatgctttgtacactgttcgtttttgtttcgttcactgtcttcacggtaaagatgaactaagagccactgagaaggctgtttatgggaaccagaaggttgtttgcttcccttaagttcgctcttcctggcacctggttcccttgcagcccatggggaatgtgatggtcacgttttctcgtctctcctgcctcatcccatcagccagttcactgctgtgcctgaactcctgtacagggtgtctggtgcatgtccacataacaaaaagatggtactgatcattgagtttatctccaaaaatttttttcaatttgattgtagaaaatacatttttaggcggggcatgatggctcatacctgtaatcccggcatttgggaggccgaggcgggcggatcacctgaggtcaggagttccttacagcctggccaacgtggtgaaaccccgtctctactaaaaatacaaaaactagccaagcgtggtagcatacgcctgtaattccagctactcgggaggctgaggcaaaagaatcacttgaacctgggaggcagaggttgcagtgagcagagattgcatcattgcactgcagcctgggcgataagagtgaaactccgtctcaaaaaagaaaagaaaagaaaatatatctttatcctggagactagagaatgtaatttttttaaaaaaattgaaatgcctgacaatagatttttcttatcacttctatgtgtggactgaagagggcctgaccaggaaatttatttttattgctaacaaaaattgtgtgtgtgtgtgtgtgtatgtgtgtatgtgtgtgtgtacacagcgttttgccatattgcccaggctggtcgcaaactgctggattcaagcagtcctcccgacttgacctcctaaagtgttgggattatagcccaccatgcccagccaggaatacgcctttttaaaaaaaattgacaaacgtaggttttgagtctctgaattgaaactcaaatgttggcacagcagagtgctataataatttctgctattaactatgaaaaagaagtccgtctggtttttttctctttgcatgtgactaaagatgaaagttagcgagttttggcattactacttctgaaattttgtgaggtcactaagttatattgagctcattttaaagatacttagatttttggtaaatttgtttctctagtctcaagcaatacagctgggtgattgttgtgtacatgttcttgtataatatgtgaaaagaacatctaattaaaagcagtatgtaagatttcaggagttatcccacctaatgatggaatttgggcctttacacacccacccaccaccctccagccacaagaaacatctctttttttctcgagacagagtttcgctgttgttgctcaggctggagtgcaatggcaagatctcggctcactgcaacctccacctcccaggttcaagcgattctcctgcctcagcctcccgagtagctgggattacaggcacacaccaccacgcctggctaatttttgtatttttagtagagatggggtttctccatgttaaccacgctggtctcaaactcctgacctcaggtgatccgttgtccgcagcctcccaaagtgctgggattacaggcgtcagccaccgcccccagccggaacatcatttttgaagcatctcagaacatgcgtttctctttcccgagatcccaggagtttgttgtttttagtcccgtactataaaaattagctttactttttagtgtttaaatgatcagaaactgtgtgtgttaactaaaacagtttaattcggggtacttcataacattaacttgttttcttcatgttgattttggaaggattaaagtagctttacagactaagaacaattctctattatgcgtgcggggtgctggtgaaataaaactacccccaactctgcaaaattgtgtgcataatataatttgatcatgtgtgaaatacaagtgagtagtgtcagggcatgcagaaagaatgcaaagcacaaggcatccagacagcttccatctgagacactgctcatcttgtcctggcactcttactgcttaacacattaacgtccacaaatcacagtcgctaggatttatatgtgaaaaccagggaaagaattaaccagtcttatcccttaagaataaactgcccttgaggtgtgaccttgtccatacctaattccggtgatgctccatgtgtgcagggaggcctgaggtatttttccttagtgaagctttcctcatgattaaaacatccgtttcaaataatgcctttagaaacaactatttggtcagaaatctttctgacaccgtgttgctgtgcagcctgcctccccagagagcagtggcagcaggatgcctggtctgcgtgctcgtgttacggggcatgccttgcaggcctttctggttctgtggaccgtagacatcaagtatctatactgtaggttattcgaattcctttaggcacactaggaaagttcagactggaaactgacggctgagcttcttaggtcatcggatagtttcccacagatgggttttaatctcaagaaaataactgctatcagttagattttgatgtatattgtattagccttttgacttacacaaaagttataatggtaaaattgatcctctgtgtaatttatgtaggaaattgaagtgcttgcataagccgtacttgcatgtgagagctaattgtaagggattaaagacattagcaactgtgtcctcagctttgttatacttgagtcatacttaacagccaagatcttcagtcatacattaacagctaagatcttggtcagaaatgcagcctccatttatgacattctcttgggaaaataagtctcttgtttaacaaggtgatttagtttttactttgatttcaggaatattgtctaacgtgagtagggcgagaaggcagggcggcttgtactgagcctaatttagcctgcacctataaggatcaaggtgttgtttctgagcctcctgggatcccagggctcacttgggtgggagagtgggttgtccctgagccaaaaaactgctggacacaccctgtgtgctcaggattgctgtgtgagcatcctgacagcttttgaccagtagcggttcatggttactgagatgaggtggctttgagattcttggttgccaggttgccactcacccccgttccctgaagtaacttcccctaggtcttcatgcgatagctatcctaagtgtcaggttttattttttttattttgagatggagtctcgctctgtcacccaggccggaatgcagtggtgtgattttggctcagtgcaacctctgcctcccaggttcaaatgattcttctacctcagcctcccaagtagttgggattacaggcgtgtgccaccatgcccagctaatttttgtatttttagtagagatcgggtttcaccatgttagccaggctggtcttgaactcctgacctcaagtgatccacccgccttggcctcccaaattgttgggattacaggcatgagccaccacacctggcctaaatgtcagtcttatgttcttggatttatagggagacctagatttttttatgaaaaatgcttaacagatttttctttttataacccaccagcatatgttgagtagtattttagacattgtaatattatgcaaagccaataaataatcataattatattttatttacctggccctacttagccattgtataagttctgatgaatgctgaagaaaagttctctggtttgtaatgagaccatagttctcagactttccttttttttttttttgagacggagtattgctgtgaagcccgggctggagtgcactggcgccatctcggctcactgcaagctctgcctcccaggttcacgccattctcctgcctcagcctcccaagtagctgggactacaggcgcctgccaccatgcctggctaatttttttgtatttttagtagagaaggggtttgaccgtgttagccaggatggtctcgatctcctgacctcgtgatctgcccgcctcggcctcccaaagtgctgggattacaggcttgagccaccacgcccaccttaaactttcaatttacttttctcacctgcttcattaaattatccaacagttgtttattgattgtgcttgtctttctgtttcagatctcacattcttgaaggtggcattgaagagcactaagatcggaagatgagtgagcttgaccagttacggcaggaggccgagcaacttaagaaccagattcgagtatgtagttgtgtgtgcttggttttattaatcatttgagtttcaggttagatgttacttgttttaggaaaaatggtttacaggatgacttgttctatgttttatatgaaattgaatcttagttggcccaggatgtactaattatagatctagatacttagcctagtacattgtttttgggattttgctttctgtatacaatttgttatttgaatatacaccagatgtctccgtagaatttataagtgtcttttgcattctttatcataaccttgaaaatttgtgataccctgggccactgatcagactgtgatatctacctccctcccctgaatattgggactattgacagcagaaaacttgcttaaaagtaagagtattaacaacaataaaaaaagtatttcaggtatatctgatgtattttttcctaattttgaaagatcttccctagcggtgatgattggaatctacagcttctgatagactgctagatggagcagatatatctaaatccaagatagaggccgggtgtggggggctcatgcctggaatcccagcagtttgggaggccaaggcgggtggatcacctgaggtcgggagttcgagaccagccagggcaacatagtgaaacccccatctctacaaaaaatataaaaattagctgggtgtggtggtgtgtgcctgtattcccagctactcaggaggctaaagtcagagaatcccttgaacccgggaggcagaggatccagtgagccgagattgtgccactgcactccaacctgggcgtcagagtgagaccctgaaaaataaaaaaaaaattgaagataaatttatttaccgtgtgtaaataaactgcactgtaaaaagaatacctttcacagaattctaaaacattaaattccagtctgtgactgatgtaggatgttaaattgcagagttcataaacttttatttgagagagagtttcactctgttgtgcccaggctggagtgcagtggcgcgatctcgtctcactgcaacctctttcaagcaattctcttgcctcataactttctgaaaagggaggagcagtaggtctaaatggaattcattctgctgctcctacttttgtgaagcagtacttctagtaaatattttatagagaaacatttaatgcaagtatgtgtttcctttctgaaactgctgatgtgaagagtaagagaaaaagaggcagacttctcaggaaaaaccacgtcttcagtatgtttttaggttttgtccatttgatgtaagagctttctcttactcttgtttgctctgtcaagctttagctgttcttcagagtgtcgctgtacaggaagctgatgacattcagtacatacctaaataacagtttataagctgggtatggtggtgcgcgcctgtagtctgagctacccaggaggatcacttgagcccaggaggttgaggctgtatagtaagctgtgattgcaccactgcactgcagcctaggtgacaaagtgacaccttctcaaaatacagtaaaataaaataaaaaacaacagtttatttttctgactccagtgcaaggatgaagtcaagtatttccttttaaacggccaattacatgtttagaaagcccaccaggatttggagagagaaacaccaacataattttaggcaacttgttcctgaacttgagaaaaaataatggaattctctgagatttacagccaaagagaaaacaaagtatcctctactgtaagaattttaaatcttaacatttaaaagatcttacataggtgaatagggaagacttagatttttttaatagtttgctctgatcagacttgtttaacatgtcccctccaccaaaattaatcaaatgtgttctgaaatatttagtttgatataaaattattctctgaaatatctatttaaataaaaccaaaaggtattcaaattttgcctgacttaatacttaagcttctgctgttcattttaagtcagcatggtttttggcaagtaaaaaagaaaagcaaagtgttgttatttaataataatctaactgggtttttgggggggttcagaacactctcagctctttaccacctgcttttgagactatatttcatcttatagaaatcagatttttttttttttttttttttttttctggagacagtctcgccctgttccccaggctggagtgcagtggcgcgatctcagctcactgcaagctcctcctcctgggttcacaccattctcctgcctcggcctcctgaggagctgggactataggcgcccgccaccacacccggctaattttttgtacttttagtagagatggggtttcaccgtgttagccaggatggtctcgatctcctgacctcgtgatccgcccacctcggcctcccaaagtgcggggattacaggcatgagccaccacgcccggcctagaaatcagaattttaaagtttaccctgaaaatgtcttaaatagtagggtgatttggcatatttgaagaaattttgtttttctgacagctataagttgttcacaaatagtggacttggatctattcatagcagatggaaagagcttgtatggcacaggtgaaagacacccaaatttaaaaaattaaggccaaaaggaactgttgcacctccttccgaggtttggaccctgtcacgttgtgaattccccagggccttcttgcacagggggctccctcttgggctggcacaaatgtcacgtgacattccccacatgctcttgttgccacataaaaaatgtaaaaagaggtcgggcgcggtggctgacgcctgtaatcccagcactttgggaggctgaggcatgtggatcacaaggtcaggagatcgataccatcctggctaacacggtgaaaccccgtctctactaaaagaaaaaaaatacaaaaaaaattagccaggtgtggtggtggtgggcgcctgtagtcccaactacttgggaggctgaggcagggaatggcgtgaacctgggaggcggagcttgcagtgaggcgagagcgcgccactgcacactccagcctgggagacagagcgagactccgtctcaaaaaaaaaaaaaaaaaaagtaaaaagagagacggccaggcaccgtggctcatgccgttaatcccagtactttgggataccaaggcaggaggattgcatgagcccaaaagcttgagaccagcctttgtaaggtagaaaggccctgtcttttgaaaaagaatgaaaagaaacgggtggaattaaccctaacaaggtttttttcatttttttgtttgtgtgttttgagacagggtctctgtcagtcattcaagctggagagcagtggtgcgatcacagctcactgcagcctcccgagtagctggaactacaggagcatgctgccacacctggctggtttttttcaattttgtagagacagagtccaccatgttgccccagctggtcttgaactcctagggctcaagggatcttcccgcctcagcctcccaaagtgctggcaggtgtgaaccaccatgcctggcccaacaaattttatctaaggcagtatatctaaaatattatttattatgcaatgtgtaattaatacattttaattgagatatttgacactgtttttgtcccaagtctcctggttccgtttgctgtgcgcagcagccacaggcaggtcatggcccccgcggtgggacgttcactaggagaggcgcctagctgctttgtctccgaagtaccaggaaccgcgctgtgttagttcctttgcacgagacagggacagcaaaagctgttgaagtccttttaccccaaatgggaaaggaagacttatttttaaaatgtagaacattttttcctgattgcccaaggaatacgtgcttgttaaagaatgcagagcatagtgaatcaaacaagaaattgtagatgattctaaaaggggctgttttctttcttagatttgtttttcagccaaaagacccttaaaggaccttgcatgctccttttgattattattgaggaaacacaggctctcagagggattctgattaaaacatggtgtgccttaaaatacacagagtagctgatggagtaaggaaagctccacaggatgcacaggcgtagatgtgttctggagcggcatgccagccagtgcaagggagcagggtccattcgtgcgagaggcagctgcaatggatgcccggtccaaaatgtccagcgactccatgctgagcagggcccaggctttaatttaggatgaaaccccaaagtaagtgtgttactgtgtcatttgacaaatccaaaaagaatgagaaatcaactgatgagtggcttggatatgttcatctctggtttaagtggacatcataatatgtatctacaggagtccattaaactggaaattaatctgaaagaacttgaagactttttcttctttgttaagcagttatagagcttgtttccattaaaagacttcttcctacagttttaaaagttgaaggtgtctgttctgcaaagtgctgcactcagttaaataagctggttattggctaaaataaagattgaattgaagttatctgtgtgttgtttttacagtagtttttccttcggtttaacagtagtatcaccacagtctgttacactgtaccttaagaaactcattttagtcattggacactaaccgggggaagttgcttaaatctcatgttttattttctccattttaaattttcttatgatgttttaaaatcaaaggctgtaacatcaacaagaatagtatttcaaaaacaaatattaaactcagtacttgccagtaaaattcattgacaaaaagacttctgctgctctaagtattcttcatcccccttactccaaatgttactgcttgcatagaaatactcgatttttttgtgtgtgtcttaattataagcagaatgaccaataaagagcttaactaaagatgaatttggaatgtataaatttggtatatttataataatctcagtatagttccttttttttttttttttttttttttaaacagagtctcgctctgttgcccgggctggagtgcagtggtgtgatctcagctcactgcaacctctgcctcccaggttcaagcgattctcctgcctcagcctccccaaatagttacgattacaggtgccggccaccatgcctggttaatttttgtgtttttagtagggatggggtttcaccatgttggccaggcttgtcttgaactcctgacctcaggtgatccacccacctcagccgcctgaggtgttgggattacaggcatgagccactgcgcctgaccaatatatttccatattatcagtttataatattcccacaagcttcctaaagtagaaatcatttgcagtgagcagtttgccccaaaagcctgaaccgctgggaactcgtcctccaccttccccatgtggggcacttggacgcacgcctgtaagggctgcacatgccatttgccattttgaaagtagatggtcagatgacagcatataaacacatttttcttactagaaagtgtcagctgggcatggtaactctcccctataatcccaacactttgggaggccaagggggaaggatcatttgagcccaggagttcaagaccagccacaggcaacatgacgagatccccatctctacaaaaaaaaaaaaaaaattagccgggcatagtaatgcatgcttgtagtcccagctattcaggaggctgacgtgggagggtcacctgagcccaggaggtcgaggctgcagtgagctgtgatgacatcactgcactccaggctgggcaacagagccagatcctgtcataaaaataaataaatacatagtttaaaaaaaaaaagaggccaggcggggtggctcacgcctgtaatcccagcactttgggaggctgagatgagcggatcacctgaggtcaggagttctagaccagcctggccaatatggtgaaacctcatctctactaaaaatactaaattagccggtgtggtggcacacgcctgtggtctcagctactcaagaggctgagacgggaagaatcacttgaacctgggaggcggaggctgcggtgagctgagatcgcgacacagcactcccgcctgggcaagacagagcgagactctgtctcaaaaaaaaaaaatagttgtgattaaaaaaaaaattataccaacactcaaactttaaacctgttagccattgtcttattttccttcatgttacgtacctttctatttctaaacgtacgttctcttttgagatttccaggtctattttctagtaactttgatcccttagtaatgaagacacttgagttagcattggtggatcccttcacagtgcctacctgcagccgcaggtcatttgtagatgagcaacgagaacagccaagaggctcatgtacatctgattgtctggctccaggtcccttgctcgttttccatagaatttatttatttttctttgttttcctttattttattttattattatttttgttttttttgagatggagtcttgctctgtttcccagactggagtgcagtggcgcagtctcggctccctgcaacctccgcctcccgggttcaagtgattctcctgcctcagcctcctgagtagctgggattacaggcgtgcgccaccacacccagctattttttgtatttttagtagagatggggtttcaccatgttggccaggctggtcttgaactcctgacctcaggtgatccacccacctcggcctcccaaagtgctgggattataggtgtcagccaccacacccagcctattttccttaaatttttaatttttatttttagtagagacaaggtctcactttgttgcccaggctggtcttgaactcatgggctcaagagatcctcctgcctcagcttcccaaagtgctaggattacagacgtgagaccgcgccctccatagaatttagaattaatgattgtttctcttgaaaacaaagtacttagttaatgcagtctgaagaaaagtttttttgggctgggtatctggtcctttttagacttttttttttttttttttttttttaatagaccttttctttgggccacagccttcctgaccctagatgggctttgtaaaaagagcaagtcgtgtgtgccagcctgtgcagcagtgagggcacaggcagcaccagggtcccgggtgtgtgggtgctgccccagcttgcagtgtggtctcctcggtgctggccacagctgtgggtccccaggaatattgtgctgcaggtcttagacagatttgggtactactggttctctgttcagcgtggcctggacagtccacagatggtagtagaccatggggtgttgagatgcaaggagactctgccgttctttcacattctgcttttgctcctgacagcttaggaaagctctctttgaaactttggtatgtgtggacctgagattgaatgtatctgaaaggttgctaatttctcactgtccttgcttcccaggacgccaggaaagcatgtgcagatgcaactctctctcaggtaagagcccactgagtcacgcagagccatctgcctgtgaggaggctagcacggcacccacacctggagcctcgggagggctctgcttgcattctctgttgcgcagtgaggatgccaagccactgcttttattaagaagtcattctgatggtaggcataggaaatagaggggcttattgagataaaaatgagatatctcaagccttgaataatcatctacctgttacagagggtaatagttgtaaaatattgttattgtcttaagatattttgaagctcctctcctcaacagaatctgcctcagaacttctatttctaatatccaatttgataatacctcaaaaagttaaacatagaattattgtatgactcagcagttctgccattaaatatatgcccaacaggattgaacactgcttttcaaacacacacatgtacatagcagcaccattcacaatagccaaaatgtagaaacaaccaaaatgtgcataaatgaatgagtggagaaacaaattgtggtgtctctgtgccctggagtattatcagccattaaatggacgtcagtacagtcagaggctgcaacgtggataaaccccataaatattacgatagtgagagaagccaaacaaatggctatgtattgtttagttctatttatatgaaatatctagaatagtaacattcactgagacagagtggactagtggccagcaggggtgttaggggagagagggagaggaagtgaacagggagtgactgctgaatcaatgtctggtctccttttggaagatggtttggaactagatggtggcagtggttttacaacaatgagtgtactaaatgccactgaactgtagactttaaagtgattaattggatgttacgtgaacttcaccttattaaaaaaatgaagtccatcccagcactttgggaggccgaggcaggtggatcacttgaggtcaggagttcgagaccagcctaaccaacatggtgaaaccctgtccctactaaaatacaaaaattagccaggcatggtggcacacacctgtaatcccagctactcagggggctgaggcaggagaattgcttggacccgggaggcagaggttgcagtgagcagagatcgcaccactgcactccagcctgggagacagagcgagactccatcttaaaaaaaaaaaaaaaaaaaaaagataataaaaataaagtccaaataattggacagaaatgtgaaagaaaaactatattcctacttctactgaagatgattaagttttttacattgtctaaatgctttaggggatgtgctttaattgaggttaaattgtaagttaaagaaaaaaaaattaggctacatagaattacctgaatttcaattctgagaagcactttggactgtccgtttttaaaacccactattgtaatccacttactccgtttgccaacctaaactcattaacatcagtgtctatatgtaggatgggctcagcaggtgtgtgtacagctggtgctccaagtgatggtcgtgcagaagcaggtgtcatgcaggcccacacatagcctgacataggaaccagctattaaattgtggtgtgggacatctgtgtggtgtcataagaagagttgcgagatctcaaagaactcagagacctaggaggagatggtcctggatggacagggagaggaggaaggaagcaggaagggaacagcaagtgcttcaaggctggccatgttcgtgtgcgtgcattggagggcagggcacacaggttcctgatgaccagccagactgagacttggtaagaggtacggaaggggttcagtgcagaatgccacagtggaagccactggagaactgtgggaagggctgggaagaggtaggcacagtgggcgagccaacagccttgacaaggatgggtgatgaggagaatcgtttaatcacagatgttgatttacagaaatgtttttattttcaagatcacaaacaacatcgacccagtgggaagaatccaaatgcgcacgaggaggacactgcgggggcacctggccaagatctacgccatgcactggggcacagactccaggtaggcgtgggcatgagcaggatgctgcttgttacattcaggggctgctctgttgtcctaggggaaaagtacctgaacccatttgctgtgctgtgcagtgaagaaattaggaagttgaatcagaactctgggcacgcaaggtgcagcgttcacaggtgcatattccctgtccagttttccacttacctgggctgaaagaacactgccatttcttcactgtctgaatcacattaatacaagttctgatttttctttctcccttctcctgtctctttcagtttctagacctctgtcttcccagttctactgcatcctacttatgtgaacttggggaagttacctctctgtgcctgtttctcagggctggttggccctcgccctcttgtgatgtcagtgccctggctcaggaaatcacagaacctgccccgaggatcctgagggattaagtgtattgagccttagaacagcattgtgctgtgtgtgctttgctgcggcagacacacgggaatgcgctgtgagctgctctcaccattctctcatctggcctgtctgccctgccttcctttggtttaccatcccaagagataattcccttcatgggctcctatttgttcttttcttttctctttttttttttttttttaaagacggagtctcactgtgttgcccagcctggagtgcggtggggcaatctcggctcactgcaagctccgcctcccgggttcacgccattctcctgcctcaccctccctagtagctgggactacaggcgcctgccaccacactggctaatttttttgtatttttagtagagatggggtttcaccatgttagccaggatggtctggatctcctgacttcacgatccacccgcctcggcctcccaaagtgatgggattacaggcgtgagccactacgcccagcctctttttttctttttttttttttttttttttttgagacagggtctcactcagtcatgctggagtgcagtggtgtgatcatatctcactgcagcctcgacgtcctaggctccagtaacccttcctactcagcctcccaagtggcataggccacaggcatgtgccaccatgcctggctaatattttttggttttttacagagacagggtctccctttgttgctgacactggtctcaaactcctggcccctaagtgatccttccacctcagcctcccaaagtgctgagattataggtgtgagccaccaccacttctagcctatttcttgtactttaaattatacccctttcttctccaccaggcatctcccttccgtgaccccacactctgatttagaggctattacaaagtcttatttggtgcctgttctatctaaataatttaataaagtactgtttgatttgtgtaactgtgacatgctcgttgaagcacctgacataacaatttttaacatgcccttctttgagtagtatttctttgtattccgttgttagcgtggaattttctgctaggctttttctttgttcgtgaaattgtccgctttagagcacaaacagctagagaacaaaagattctatctttagtttgttctatatagtatcccatacaattccccatgcaaatgagagctcgcatgatggttccaatgacagcaggagtcagaaagaataaaagtgggaagggggagggtggggaagtggggagatgatattctgagggtacagagttttagttaggaataaattttagaaatgtgccacacagcacggagagtagttcataataacgtgtgtttcaaaattgttagtaaagtagacttaagtgttcccaccacagagcaaattggaagtgatgggtatgttgattagcttgattgatttatttcacaatgtggatatatatcagaatatcacattgtactccgtaaatatacatataattacttgtcaaaaattcttttaaatattcaaaataaataagtaaccaggcacattggctcatgcctctcatcccagcactttgggaggccaaggcaggcgaatggcttgagcccaggagttcaagatcagcctaggtcacatggcgagaccccttctctacaaaaagtacaaaaataagttggttgttgtggtgcgcacctggagtcccagctacttaggaggccgaggtgggaggatcacttgaacccaggagtcagggaagcagagcttgcagtgattccagatcaccccactgtgtttcagcctgcacggcagagtgagaccctgtctctaaataaataagtaaataagtaagaatatactttgtgaattcaaagttattcctttaaaaaattaaaaagaattttttaaaaaatgttctggctggatgcagtggcgcacacctgtaatcccagcactttgggaggctgaggtgggcggatcacttgaggtcaggagttcgaaaccagcctcctggccaacatggcgaaaccccatctctgctaaaaatttaaaaattagctgggcatggtagctgtagtcccagctacttggaaggctgaggcacgtggaggttactgtgagccgaaattgcaccactgggtgacagagtgacactgactcaaaaaaaaaaaagaaaaaatgttgttactagtctatctatgttagaatttattgtcaaaagtagatggaaaacaaaacagtatgttacctctggggcctttcctccatgtgtgggaacactgatgtgcagattaggcaggttagtggagtagacagtgctgctgctgggcagtgttcaggtactcagagcactgcactgccaagtaatatgtctccttcaccagctgggctctggactgggtagtctggaagggatgagagtgacctgcaggcaggtgtgttcagggaccgaagagatgggtgtgtgaactgagcagtggaggtggggctgggggctcagggtgggtggggtgggcgccagatccttgcatgggaggctttatgttccgtctgtctcaaacacactttgtgccttgaaagccccaggattagaaggaagaaaagcaagggctgacaaaacaggaccaagtgcagaatcatggccaccctgtgagcaaggcagtcttcagtgaggcctgtgggaggctggggtgccacattggtccatgttcttggacagggtgctaggtgcatggcatttgttgtataattgcacagtcatgagaaaaccaaaatgatattatggagaacctctgcttttcagagccttctagagattgcttgttgtaaatagccgtttttttctggataggccagtgtttgcctctttaaggtccaaaagaggttttttggggggagggtgtgtgtgtgtgtgtgtgtgtatgtatgtgtgtgtatatatatacatgtatatctatatctccttgttccacaagcttttttttttttctttaagttctagggtacatgtgcacaatgtgcagatttgttacataggaatacatgtgccatgttggtttgctgcacctgttaacttgtcatttacataggtatttctcctaatgctgtccctcctcctgccccccaccacatgacagagtggggagggtatatattttctttaatcttcatatttcctgccttcataaacaaatgttattgcttgtttttcatgacttaaagctataatttatgaataccagtttttttgggtttttttttttgagacggagtctcgctctgtcacccagcctggactgcagtggtgcgatctcggctcactgcaagctctgcctcccaggttcacgccattctcctgcctcagcctcccgagtagctgggactataggcgcctgccaccacgcctggctaatttttttgtatttttagtagagacagggtttcaccatgttagccaggatggtctcgatctcctgacctcatgatctgcccacctcggcctcccaaagtgctgggattacaggcgtgagccactgcgtctggcctatgaataccattcctttaactgtgtttgtttgatttatggacactcggaaacagtagaaatgactactaatttgtctttctgtttttttgagacggagtctcactgtcgcccaggctagagtgcaatggtgctgtcttagctcactgcaagctctgcctcccaggttaacaccattctcctgcctcagcctcccgagtagctgggactacaggcacccgccaccacgcccggctaattttttttgtctttttagtagagacgggatttcaccgtgttagccagggtggtctcgatctcatgacctcgtgatccgctcgcctcggcctcccaaagtgctgggattacaggggtgagccactgtgcccggcctagtttgtctttcaaaactacatgaggctagacgcggtggctcacacctgtaaccccagcactttgggaggccaagtcaggtggatcgcttgacttcaggagttcgagaccagcctggctgacatggtgaaaccccatctctactaaaaatacaaaaattagccaggtgtggtggcgagtgcctgtagtttcagctgcactcaagaggctgaggtgggagaatcgcttgaacccaggagctggaggttgcagtgagccaagatcacaccactgcactccagcctgggcaacagagtgagactccatctcaaaaaaagaaaaaaaaaaaaaatatatatatatgtatatatatacccacaaacatgcgcattgcactcccgcctgggtgacggatggagactctgcctcaaaaaacaaaacaaaacacaaataaagctacatgagaggccaggcaccgtggttcacgcctataatcccagcactttgggaggctaaggcgggtggatcacctgaggtcaggagtttgagaccagcctgcccaatatggtgaaaccctgtctctgccaaaaatacaaaagttaactaggcttcatggtgggtgcctgtaatcccagctactcaggaggctgaggcaggataatcgcttgaacccaggaggcagaggttgcagtgagccaagattgcaccactgcactccaacctgggtgacagagtgagactctgtctcaaaaaaacaaacaaaaaagaaaactacatgcaaggcccacaatgattacttgttatgtatgtatgtattaatgtatcagatgtacatttgtaatatgtttatcaatatatttgtactaaaaggcaactttttttttttttttttttttttgagactgggtctcactctgtcgtccaggctagaatgcagtggtgcgatcctagcttactgaagccttgaactgctgtgctcaagcaatcctcctgcctcagcctcctgagtagctggtaccacaggtgcacatcactgtgcccagctaatttttaaaaaatattttttgtgggccgggcgcggtggctcaggcctgtaatcccagcactttgggaggctgaggtgggcggatcacgaggtcaggagatcgagaccatcctggctaactcaatgaaaccctgtctcaactaaaaatacaaaaaataagccaggcgcggtggcaggtgcctgtagtcccagctatttgggaggctgaggcaggagaatggcatgaacccaggaggcagagcttgcagttagccgagatcctccagcctgggtgacagagcgagactccatctcaaaaaatatatatatatatttttttgtggagacagggtctccctttgttgcccatgttggtttcaaactcctggacttaaccaatcctcttatctcagcctcccaaagtgctggggttacaggcatgagccaccaccctccctcctttgagtaaaatgaagggcattaggtgttttgatttttgacagctactttcagggtcctggagcctgttagcttgcttcctggcccttgcctctatgttctaggtgagtggcacctcagataattgatttttgagtaggtaaaggcactactaggcaacgtgaacccagctttccaacagctccctgacccgggactaggaggcatgtcttctctcaccttctggaggatcagtggacagcttacgtgtccctaatccctctggaagtcagcagttattaagctctctgaccgggagacctctgtaaaggtgatcctcctaatctaggaggatgagctgctttagatcagctctgatactcgacagaaagtctcagaagggctgggcagaaataaagctagagtgggaacatgataccattacgtagaaataattttaaatgtttaatatgttgatgacaacctggattgagaagtttgctttaagaattgcaactgaaggctgggtgcggtggcttacgcctgtaatcccagccgaggcaggcagattgagctcaggagttcgagaccagcatggcaaaaccctgtctctactaaaaatacaaaaaagtagccaggcatggtggtgcacacctgtaattccagctaatgggaaggctgacgcacgagaattgcttgcatctgggaggcagaggttgcagcgagctccagcctgggtgacagagtgagactctctctcaaaaaaaaaaaaaaaaaaaaaattgcatctgaaaaataataggatgggagcctgcacttagtttttagttctgtgataaattttgtaataaagtgcaggtgaaaaggtttttatttgttcttaaactcattgacacctgtatcaaaacatctagtttgatattaaaagtgtcagagttatcaacaaaacttgagagagcgttactccagctttaggtcagctttaagaagccacatatgttcacagctgaaatagttaaaacctgtgttttgaggcgctgtggcttatgtctgtaatcccaacactttgggaggccaaggtgggcggatcacttgaggccaggagttggagaccagcctgggtaacatggggaaaccccatctctactaaaaatacaaaaattagccaggtgtggtggcacgtacctgtaatcccagctacttgggaggctgaggcatgagaatcacttgaacccaggagatagaggttgcagtgagctgagatcacaccactgcactccagcctgggtgacagagcgagactctgtctcaaacaaacaaacaaacaaaaacaaacaaacaaaaaaccttgcgtttgatagaaactttaaaattaaaaatccttatactatcatttaccgtactgacagatatccctgcatcaaacagtggaaccttcttgctcttccttgaaaacagcattctgtgctacagggttccttaggacctctcataagcaactgtggttcccaggagttacctttcacccaccttacttgcctgctaaggtgaaattcttttgctccttattcatattctcctttgtagtatggagctccttttcaacatgtggattccgaactgagcacagttgccagagcaaggaaatagttatgaaaaaattcatggtcgggcgcagtggctcaacgcttgtaataccaaaacgttgggaggccgaggtgggcggatcacctgagggtcgggagttcgagaccagcctgattaacgtggagaaaccccgtctctactaaaaatacaaaattagctggctgtggtggcgcgtgtctgtaatcccagctactttggaggctgaggcaggaaaattgctcaaatctgggaagtggaggttgcggtgagccgacgcaccattgcactccagcctgggcaacaaaagcaaaactccatctcaaaaacaaaaaaaagaggccgggcgtggtggctcccgcctgtaatcccagcactttgggaggctgaggtgggcagatcacgaggtcaggagatcgagaccatcctggctaacatggtgagaccctgtctctgctaaaaatacaaaaagaattagctgggcgtgatggtgggcgcctgtagtcccagctactcgggagactggggcaggagaatggcatgaaccccggaggcggagcttgcagtgagccgagatggcgccactgcactgcagcctgggccacggagcgagactccgtctcaaaaaaaaaaaagaaaaaaagaaaaaattcgtgatagttactggtctctgctcccggaccatgcgcagtggtgctgttgtttaccaagcaggtgaggagggaacgcctcctttggtttctaggagaccttgattccaattttagctcagtctgggaaatttcatggggtattttgggtgagaaatgtttcatgaatttggaatgtctaaaagtggtttgttctttctgtttgttttttttttttttttttttttttttttttcagtcaggatctcgctctgttgcccaggctagagtgcagtggcgcaatcttggctcactgcaacccccgcctcctgggttcaagcagttttcccacctcagcctcctgagtagctaggattacaggcatgcactaccatacccagctatttttttgtgtttttgtagtggagacgggattttaccatgctagcatgaggccatgctggtctcaaactcctgtgatccacctaccttggcctcccaaagtgttgggattaaagacatgagcctctaatttgatttgtaatgaaaccaaacagaaacacttatgaaatgatgtcagcctgtctcagctgacaaagggaatgggtgccaggggtgatgtggcctgcattcggttggggccaggcatctccactctcaactgtggtctgtgacagtgtttttgttcatgctttgaagttggtctgacatttagagccttcctttcctttctttctttctttcttgaaacagagtctcactctgttgcccaggctggtgtccagtggcatgattgtggctcactgtaacctccgcttcctaggttcaagcgattcttctgcctcagcctcccgagtagctgggattacagagacgcactaccatgcccggctaatttttgtatttttaatagagacagggtttcgccatgctggccaggctggtcttgaactcctgacctcatgtgatctgcccacctcagcctcccaaagtgctgggattacaaacgtgagcaactgtgcccgaccagagattttttttcttataaataagtggctttgtctgaagcacatgtaacatgggagcacataagccaccagagtctgggttttagtctgttgctcttgtacactttctgtgttgtgcggtactgataggtttgcttttgtctgtccctccaggcttctcgtcagtgcctcgcaggatggtaaacttatcatctgggacagctacaccaccaacaaggtagggactggaggattcccttccttgaaaaaccaacccaggaaacagggttttaagctctggattcattttgttaaatcacgtaatacaggatagggaaggcagcagcggcaagctctgtttgttagtagtgaagttgcgcaggtgagatagaagctgagtcacgtgccacctgtcacggtctcttcctctggaccaggcacagttgtgctgttgtccgtcatctccttaccaagctggtgggagctaaggaccttctgtgtttctaggagacctcaattccagttttagcagagtctgggaagtttcatgttttatttatagagtgcagaagtatcacttttcattcagttacaagtttttagaagagatcatctgaaagacatcatactttaaagtgtaatttatgttattttcaagacttaatccaaagtgtattgttttgaataaaaagtattgtcattggtccaaacatgtatgtaaaagatgtaattcagtttattttactaaagaatactaaatgtgtataaatgattgcattaattacagcagatctaaaacagtgggagagatgtggcagggtagattgtaggaatgtccattttggttattccataaaaatcttttgttttcggctgggcgccgtggctcacacctgtaattccagcattttgggaggctgaagcaggtggatcacctgaggtcaggagtttgagaccagcctagccaacatggtgaaacctcgtctctactaaaaatacaaaaaattagccaggagtggtggcaggcgcctgtaatcccagctactcaggaggctgaagcaggagaattgcttgagcccaggaggcagaggttgcagtgagcctagatcacgccactgcactcaaacctgggcaacaagagcgaaactccatctcgaaaaaaaaattttttgttttcagatgagttcatagccatttgacaggataatgcagtgttttccttccaatacgtgtgggtttttttgtgtttttgagacggagcattgctcttaccgccctggctggagtgcagtggcgtgatctctgctcactgcagcctccacccccctggttcaagcgactctcctgcttcagcctccttgagtagctgggattacaggcgcccaccaccacacccagctaatttttgtattttagcacagacagggtttcaccaatttgaggccaggctggtctcgaattcctgacctcaggtgatccacccgccttagcctcccaaagtgctaggattacaggcatgagccaccgcacccggcctgtttgttttcttttgagacggagtctcgctctgttgcccaggctggagtgcagtggcgtgatctcagctcactgcaacctccgcctcccgggttcaagtgattctcctgccccagtcactcaagtagctgaaactacaggcatgcgccatcacgcccagctaattttggtatatttagtagagacatggggtttcaccatgttggctaagctggtcttgaactcctgacctcaggtgatctgcccgacttagcctcccaaagtgctgggattacaggcgtgagtgaccgcacccggcctaatgtggttttgatgagtgggcagcactactgttaagactccacctaatcataagttgtgacttcagtaaaactggactgtgtggattgaatttgaatcccatgtgcagcactggacttctcattaagtatgcttcacctgagtggccacatatgggaatcgctctctagataattttggctcttattttgttctgttacctcctttgcagtgaaagttggagatgagaaaatcctggtgtcagtgttgtttttgaacataaagttgtttgcatcatctgtctttctgtcattaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggtacctgtccttgttcataagcttcaagtgacacaagctgtttacctggggtacattatatgctttggatactcactttttatcaatcattttttaattaattaattaattattttttttgaggcggagtctcgctctgtcacccaggctggagtgcggtggcgtgatctcggctcactgcacgctccgcctcctgggtgttcacgccattcccctgcctcagcctcctgagtagctgggactacaggcgcccaccaccacgcccagctaatttcttttttgtatttttagtagagacagggtttcaccgtgttagccaggatggtctcgatctcctaacctcgtgatccacccacctcagcctcccaaagtgctgggattacaggtgtgagccaccacacccagcctttttttctttttttttttttttttttttaaagacagagtctcactatgtcacccaggctggagtgcagcagcgcattcttggctcactgcaacctctgattcctgggttcaagcgattctcctgcctcagcctcccaagtagctgggaccacaggtgtccgccaccacgcccagctaatttttgtatttttagtagaggcggggttttgctgtattggccaggctggtcttgaactcctgacattgtgatccgcctgccttagcctcccaaagtgctgggattataggcgtgagccgctgcgcccggccttatgaatcattaaatgagactggttcaaataaaagtcacagtaatggccagaagttttctgaaaatgaaactaaaaacaagcctgatatgcctttaccagtaagaaacctgtggatttgcgctggacatggtggctcatgcctgtaactgcaacactctgggaggccaaggtaggaggatagcttggagccaggggttcgagaccagctggggcaacaaagctagaccccttctctacaaaaaatgaaaaacagccacgcacagtggcacacaactatggtcccagctcctcaggaggatggctcaagcctgggtggttgaggctgcagggagctatgattgcaccactgcactccaggctgggcgaaagcgagaccctgtctctgcaaatgaggcataatagagccctgtggccgtaagtgctaggtagtctattatttcaccaagattttatttacttgtgacactaattcatcatgaaaggcatacatttgctgaaagaggatgtactattctaatattttacctctctggctgtattatttgttctcagacattttatgccccagtactttttgataacactccgcccacttcacatgcagccaaagaaatcagttcatggagtcactagtactacagttgacacccattaagcagtctgttaaataagttaattttggccagattacaagtttaaccttgtcctttgaaagataatgctgctgctgttgttgatttctgttctctgttcttttctgccttctgcttactttggagttgccttcttaattttccagctacctgaagtagatctgtaggccactggtttgcttccttttcaaatagaatcacttaaagttttaagtttccctctaagcatggctttagccacatcacacacatttgtttcatattgtcttttttttttttttttaagatggagtcctgctctgtcacccaggctgtagtacagtggtgcaatctcagctcactgaaacctcaaccccctgggttcaagcgattctcctgcctcagcctcccgagtagattacaggcgtgcaccaccacgcctggccaatttttgtatttttagtagagacggggttttgccatgttggtcaggctggtcttgaactcctgactgcaagtgatctgcctgcctcggcctcccaaagtgctggaattacaggcttgagccaccactcccagcctatattgtattttaattatcattcaatgtgaaatttttaatatccttgtgagtgcttatttgacttataggttatttagatgtataatttttacatatctgaagttttcttagttattgttgatttctaattagatgtcattgtgcttaaagacacacttggtatcatttcagtcctttgacatttgaggcttgtttttaatggagctgatggtctgtcatggtggccgcgctgtgtgcacatgggaatgatatgtgtttttgttgtatctcggcctgattttctacatacatgttaattagagcaagatttttggcatgttcaaatattctgtgtctttctatgaaatgctcatgcagggctgttaaaatgattatggattttctaactttcctgttaattctgtcaatctgtgcttcagatatcttgagctcttttagtagatgcctttacatttgttgtctctttgtgattaattgaccctgtgaccctgctctcatgatgaactgttctttctcactcataatgctctttgttgggaaccgctgctttttctgatactaatgtagtcagtcctgccttcatgggggtcctttcagcttaactgtgtctttgaaaatagtctgttacagacctcgcatcattgttgggtcttggttttttctgcccgcctttggaatatgcttttgcacatttatatttcttattgtaactctgctactttgccacctttttgtcccttcatttttgttttttggttgttcccttcctaccttcctttgagttacttgattacaggcatgagccaccacgcctggcctgggttacttgattttttaaagaaatctattttactttgtctgtgggctttgtaggtaaaccattttgcctgatgtcttagtggtgtctttagggattatagtgtacattcccaatgtctcgcggtcctctagttaacttggtcctagttgataggaaacgtaaggaactcacagccacacgggcctgctgtctgcccttgctcactcttgtggttttcatatgcatcacacctgtgtgtgttattagctccatgatgcattgttgtattctttactttaaacattcttaagaaattaggggtcttataatgtgaataaatatgaaaagcatgaaataggctgggcatggttggctcacgcctgtaatcccagcactttgggaggccgaggcaagcagatcacctgaggccaggagtttgagatcagcctagccaacatgacgaaaccccgtgtctactaaaaataaaaaaattagccaagcatggtggcatgcgcttgtagtcccagctgctcaggaggctgaagcaggagaattacttgaactgaagcggaggttgcagtgagctgagatcacgccactgcacctccagcctgggtaacagagtgagactccgtctcaaagagaaaagaatgaagtaaatctactctgccctccagagagatcttccatgtccagtgcccttcccgctctcctgcaaaggcgccttctgcgggcgtcctttcggccgggagccctacccggaacaagtcatggttaatgcagttctcaggtctgctgctagcaaagcacttagtgttcatttctctaagatttatattttgcctttattcttgaagggtatttttgctggatatctagaattatgggttgactctttttttaatttatttttcttttttttttttttttttaacaatctaaagatttggtttttagcagtttgcacgtaggtgcctcggtgtgattttctttgcatttattgcactttggcatcttgaatctataaatttgtctttcaccaaatttgggaagttttagaccatgtcttcaaatgcatcttctgtccttagtccctgcccctctgtgctgcaatacacacgcatctgtgctgtccccgaggctcagggggctggggtttgttcatcactttcccacttcttcagatttgttcctttttgttgttgttagcaccacttacttgcttttaacctttttatttccattcaagttcatgtacttgttacctctgataaactaaggctatccagcaggttctttatgtcagatattccttctgcagttgtagagtttctattgcttttatttagaaattttttattttcctgctgagattccctgtccttgtataatagcatgttttattttgcatccacaaggagagtttaatagctgcctttagagttcttgtctgctgatcccagcatctcatcttcctgaggttggtccttgtggatctctcctctggattctgagtgacattttgctatttttttagtacatgtagtaatttcaaattgtattctggacattgtaaatgttgtgtcatagagactttgtgtccggttacattctccagaactaactgatgtttagtgtcattgtatcaggcagtctatctctgtctttcttgtgtggcagcagcagaaacctctgttcagcttttctgcgctggctgggctgcatgcctgtgcacttcaggtgtcggatatctggtcagccgtgtgtgtagtttgggactccctttctgtggctttcttctttgtagttgttatcctttcgctttctggctgtggttgcccagtaatctgtctactggctcttgaagaccttggccacaggtcttgtgtgtgaggctgtagccctggggttgtcacagacagtcccctcctcagagaaagctccttaagaacaaaccatgtcctgcctttcttttctcccaggggagactcctccagtttctacctgctcctgttttcatgctttcaggtgtttcgttttgtagtttgtgcagtgcttatagttgtttctgtgagaaggtaatgcctacagataggagcccctggccatcgctgggagtccagccaggcagctcacactgaccctgtaaaccacacagctctgtctgacgcagcaccctttttggaaaggtgttctctatgttcagcagtcccttcccatgaccgtcagagtctgtgcatctgtttccattggtaatcaaaggttgctggatttaacactgactgtatttgtctttgaaaccaaagaaagaaaagccaaaaatactcaagaaaataaaaaaactggtattagtaggaatattttagaaattttatttccttcatatttcatgaaattttacttctaaggagttgtgttatttaaaaaaaacacacacacacatttggcctcttaagagtgtttgtgggctgggcgcggtggctcacgcctgtaatcccagcactttgggaggccgaggcaggcggatcacgaggtcaggagatcgagaccatcctggctaacacggtgaaaccccatctctactaaaaatacaaaaaattagccgggcgaggtggcgggcacctgtagtcccagctactcaaaaggctgaggcaggagaatggcgtgaaccccggggggcggagcctgcagtgagccgagatcgcgccaccgcactccaacctgggcgacagcgagactccgtctcaaaaaaaaaaaaaagagtgtttgtgagtctgggtgacatagggagacccgcctctacaaaaaatacaaaaactagttggatgtggtggcatgcacttgtagtcccagctactcgggatcctgaggcaggagaatcacttgaacccagcaggcaaggttgcagtgagctgagatcgctccactacactccagcctgggcaacaagagcgaaactccgtctccaaaaaaagcttatttccagccctctgatccagtctcagatttttatcaaagcagatccctaagggccaatgcagggagactcaacgcttgctcttagagctttgttctttgcatacctctcgggcagtggagacacggcggcccttgcctggatcattctgatcaagatggctacagatacataagcattgatcagaagtccagcctaaggccttcatgatacagcgtgcacagctgtcagtgacagagcccactgtggtggccaaaacttggcatttttaggcacggtgtcttcatatagtgagaagcagaacattttctatattcatgaaaatagcggatttttttctgacaggcctcacaagcttggacacagaaggggatatatgttgtctccccgtaaaccctgcttcaggagccacaacagggcagctggtgactgggatgtctgcttgaggctcactgttaccagccccagtatcttggctgcactggtgggcctcacagcctcacaccatcatggaggcactcatggtgcccgggcactcctctgtgcaaccctctgagcctcactttcacatcttcaagttacttcctcatctctttcattttccttcttactgaacttgaagaaaacacctctgctctccaagtgcatgcctcggtgcagggctgggcacctttccctccaggtctaggctgagcctgtccctcgccagcacggtcttgtttttgctccttggagccgatcctggggcggcacaggtgctcctgaaaccacctgtcggaggaggactagtgagggactgggcgtggtcatggctgacttcttggcatttgcccgcctgcctttcagtgtgtcctgtgcgcctcccttgggtggggtctccttgcccctgctcccaacagggatgttctccagggtgcaggtaggagaactaaacctttcaaagtgtgttcattgtagaaattttggaaagggggctgggcgcggtggctcatgcctataatcccagcactttgggaggctgaggcaggtggatcacctgatgttaggagtgcaagaccagcctgccaacatggcaaaaccccatctctactaaaaatacaaaaattagctggatgtggtggcaggtgcctgtagtcccagctacttgggaggctgaagcaggagaagtgctgaaccggggtggcggaggttgcagtgagcagaggccgcaccactgcactccagcctgggtggcagagcgagactccatctcaaaaaaaaaaaggaattttggaaaggaactttgaatcatcatcttttatgttgggagaccctataattccatccagaaatacagtattatacaatagttatgcagtagtattatacagtattatataactatagtattatactgtcgttctgtaactcaggagctgtagagagtttcatggtgtggtgcactaatttgttcctattgtgagacatttaggcagttcacagtttcccacaatttattataaacattgctgcagcaaacgccatccttgtagatggatggtttctcaagcccatcgtcccgttcttgggtaagtttcctcacagggctgcatctggccacgcttgtgtgtccttcttggctttgctgtctttgggtcggcagccatgctgggtagagcagtgtgtgcacccatgctgtgctcttcccagagcctggtgatctgctcctttctagactctggactcactctatccttgaggcacctctgctgacaccacatgcccaggagcccatctttctcctacgcttccactctctgccgtgcctctcttcaagccaccccctctctcctggactttaacagccttgtccctatagccagtggtccctatgagacacaggacagcccttcacacccactgcctatatgaccagaccactgcgaggtccccaggccgcgtttcagcctctccttgaggcacttggtgccacctttgtgcccttgcacctcctcactgggtgcacacttttgttcagggtctgttttccctgcccctctgcaggcttccagagggtggcagcacaggcccccgcaccaggggaggaggggcgtgttttcacctgaagtgtccccccacacatacccagggaatttgttcaaattcaataataacagaaatagtaactgtctccatttactgagaacttcttatgtgcacagacagctctgctcctcccatcagttccccagttacatggggaggctgggacttctaaaagaacttagaggaattttcactcttcctcagctgccatgctgacagtggagcccaggtatttctgatttcagagtctgcagtcttcaccactcgtggcctcttggccagaaggccctacgaggctttcctggaagaaggggttagacctggtctctgttcacagactgggcctcatggagtatgcttgcaccctgggcattgcaccacccatcctgctctccagccgcactggacacacctcaccccccaacctgaacatgcacagacacttagagtggcctctggttgggcagaaccatctaacataatacatatcttataagaaaaagttgaacatctcatgtaaattattggacactcctgaaaatgaaaacacagaatagttgtatgggtacttggagcatggttttcctattaaatgcgtgtgtctttcaaaccatcataaagtcacaaaattgtaagtcaggggccatgtgtggcttatacattcggtcattccccttgtccttcatagttcctgtcagctgatgcttgtccacatcattttatcagcgcttgagagctgtgattttagggttcagtctctggttcttggagtaagaagctgatggattctgtgtagcttcactacagcctgcacagggtgggacagagaggtcatctttgagacctatgaggtcatgttttttgtttttttgaggcagagtctcactctgttgcccaggctggagtgcaccgctgtgaactcggctcactgcaacctctgcctcctgggttcaagcgattctcctgcctcagcctctcgagtagctgggattacagacccagcacccaccaccacagctggctaatttttatatttttagtagagacggggtttcaccatgttggccaggctggtctcaaactcctgacctcagcctccccaagtgctgggattacagtcatgagccaccgcgtccagccaaggtcatgattctttcatgcagtaaacttgggagtgcctccgcctggtcccctgtgtgagatgcaggctgtgctgaggtctccatgactcttctttcctgcccttctgtgctcacattcaaacaggctaagtgctacaaggctcggtggcctggtctggatgggcatctgacggggtgggggtgcttccctgaagcaagggtgagtgtgaaccaggaagccagtggaggagggctcgggtggagacccgggagcatgacagtgagctgcggggcacgacagcaagctgcagggcactacagggggcgccaggtatgcagggctatcctcctctgagctggacttgggttcacctttgtggtccctagtgtccctgtggtgtggcctccaggaagtatttgaccacgcatactttcgtaggcacgtagttaatattttgagctctgtcatctatgcatatttttcttctgtcagagccagtttaataatgtttgttggccaggcatggtggctcacgcctgtaatcctagcactttgggaagccgaggtgggtggatcacaaggtcaagagatcaagaccatcctgaccaacatggtgaaaccccatctctactaaaaatacaaaaattagctgtgtgtggtggcgtgcacctgtagtcccagctacttgggaggctgaggcaggagaatcgcttgacctgggaggtggaggttgcggtgagccgagatcacatcactgcactccagcctggcgacagcacgagactctgtctcaaaaaatagtgataataatgtttgttaaataaatgctttgttttctctgtaatcttacactttctacattaaaaccccagtgggtttcttcttttggtgcattttatttttgttgtttgctgattcacgcagtgtcgcatgactccctggggtgtagttggggggaaggcttttcagtaaacactcaaatctaaacaggtatcccaagaatcaccagtgccactggaacccctgaatcttcagattagggccagtctgtcaccaatcctgggcacacactaactggtttgttgaccctatgcttttagttccacagtaaataccagaactgtgatcaatgtacaaaagaaataatggtcaacagaagtcattaacaacttgaactgccgggttcaaatgattctcctgcctcaccctcctgagtagctgggattacaggtgcccgccaccacgcttaatttttgtatttttagtagagaccagtcatcatgtgtggatattgcggactgattttttgttgttgcttttcctcattttggaagttgtttaggacggggcatcttggtgtgtcctgctctcgcctctgatgcttccttcccagtgggagtgggtgggaatactcagagacacagaattgtgcccacgctgatgtgggtgtcacagccactgtccccaagaaaacaaacccacccacacatattcacgagcacccccgtgtctgcagtgttgctgccatgccgcgttcctgttgccttcgttatcccttccatgacctgcaggcccttgccaccctgaccctgtggcctcgccgcctcctgccctggctgggccctctgtttggatcctccttctctgagtctactctcgtcctccctcctctcctggcttccatcttgtgaggcccctactttgtcctcttccttcccctagcactccctttctgatgtcctctttcagtgattctcattctctgtccctgctgagcgtgggctgtaggagagcaggaggtgtctgtctggttaaggctgcttcctgggcactggagtcagcgtgccctgaatgagtaaatagacgagggatccccagcctttgatgggtcaaacagtaaagcagatgaaagatgtgtatgtttcatgggtgtggtttctgcttctgcccccatcacggagctgtgggtctctgtgggacgtgctgtcctgcctggccaggctctcaccctcaccagcagtgcgtgtggaccttctgctgtgtgcacagatgggaataaaaggtcactagcatggtgctggtcttaccttagacgtagagcttccaccgggccaatgtgtttctctatgtatgaggctgggtgcaaggcctgctggattcagctcatcacttaggcctgttctttgccaggttacctgtcctgctgccgattcctggatgacaatcagatcgtcaccagctctggagacaccacgtggtaagtacctgacccggggcaggcagtgccttgagaacccacagcccctggcacattcctctgtgaacatggaggaaataaggttcttgacataatattaggccatctgtaatttaagtggccttaagatttaaaacacatagtagcaatgtgtgaattcattatactttttttttttttgagatggagttttgttcttgtcacccaggctggagtacaatggctcaatcttggctctgcgacatctgcctgccgggtttaaatgattctcctgcctcatcctcctgaatagctgggattacaggtgcccgccaccacgcctgactaatttttgtatttttagtagagaccaggtttcaccacattggccaggctggtcctgaactcctgacctcaggtgacctgcccacctcggcctcccaaagtgctgggattacaggcgtgagcctccgtgcctagcctcattatacttctaataaatttacaaagtttaattttcagcagctgagaactaaaatacacatttttttctttttttttttttttttgagatagagtctctctctgtctccaggctagagtggagtggcgtgatctcggctcattgcaacctctgcctcccagattcaagcaattctcccctctcagcctcccgagtagctgggaactacaggtgtgcgccaccacacccagctaatttttgtattttcagtagagacgggatttcaccacgttggccaggatggtctcttatccgttgacctcgtgatctgcctgcgtcagcctctgaaagtgctgggattacaggtgtgagcccccatgcctggccaacatagatattttaactacaatcaggctcaaagtacctgctcttcttttttttcccctctatatatttgtacctccttaggtgatgataggtgggagtagggtgggttttgattgtccctttctgatagcatcatgtcattgtgaacaatgagcacagactaaaaataacagacgtcacaattcaagtgattccatcagacttcatttttagtgttttcaccttacaggtaaacggaagcccacttaaatgctagaattttttcatttgtggcatcaaagtactaaattaaatgtccagatagttattttatgagagtcattttagacttcagctggccatgtgggtttttctggtcttctgaggcatgatttggtggcaggagctgtgcccagcccagggcacagacccctagtcacgcagttggtggggttcaccgagacatgggcccttaaccaacttgtcagcaaagcatctgtggtattataaggtgtcctcgttgtataaatttcatagatttacaaaagatttgtcacctagattgtcaatcttgagaagactttatttattagaagatatttttaaagtgcttctgttcattaatcatttttttcagactcttttacgtatcttgcttcccttctgcagtcagtccctcaggccctagagaggaggctccctgtgcagtgtctgttgagattggctgattggatttgcattgccaggcccagccaggctttcctctgaggctgacatgaacggacagtgctctctggtgttgccttccatgggtcgaggcacaggagaatagtatgttggtgggcgtgtggccctcacagctgtccttacacctgagccaggcttctgctctgtgcagggctctgtcagcgtctcaccttttgacagcttgttaagcagaaatgtgatagaataccaggtatggccgggcgcggtggctcatgcctgtaatcccagcactttgggaggccgaggcgggcggatcacctgaggtcaggagttcgagaccagtctgaccaatatggagaaaccccgtctctactaaaaatacaaacaaaattagccgggcatggtggcgcatgcctgtaatcccagctactggagaggctgaggcaggagaatcgcttgaactcgggaggcggaggttgtggtgagccaagatcgcgccattgcactccagcctgggcaacaagagtgaaattcggtctcaaaaaaaaaaaaaaaataccaggtgtgatcactgagaactcagctgctctcctgtttgtgattccaggaaagggcaggaggacctcagaattgctgtgagccatttgtttacctggcattggccttctcctgcctgccttttctgagaccctgtggaggggaggccaagggagggcacagagggagcagccacagatagagtcgcgtcccctccgccatccagggcctccacgtagcttcctgccaccccttccatgcccatccatgaccaaagagggggcacagcctcagtggtgctgcttgaaaagtgcccccagctccctgtttgctggcatttgagttgaggtagcgatcccgtcattctgaagcccaggccctgtgctcatctctgtataattttgcttgctttgctttgtttcccttccaaagttgtattacatttaaatttgtctttaaacaatttacgtttttaaagtaacagtgcagaggctcactgtggccctgggtggtttgaaggacagattgtctgtcacatgactagccacccaagaagttaaggctgatgtccccttgtcattcgctcctgctccagtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcgtgagtctgggtggaggtgtggggtcgggtcctctgccgtctctgctagccgttcagattgctaaattttaaacttttctggattagatgttctcctttctgatccttatacaacctcatgtacagatggggatacagaaaactcccgatgggaaacttctctgtgttgaccacttgtctcacagatactcacagggtgttgtatgccagtccccgttcccacctctacagctgagcagtggttgggatcctggaggggaaagacagtaagataactcaggccaccagtggttacagagccttactggtcaggggcacagctaaccagggaacctgccctcctctttagcacgcggatggctaggcagtgtttccagcccctggccttgtgaggagacttagaaggatgtatctgttggttggacagagctctgctgcagtcctgaccacagccttggtcagcccgcttccctccttcctccatgagattagccctgatggctggcagctacagcaacatgcacacctgtcagtgatgactactttctcactatcctttggaataaattctactctttggggacagtaatcacagtgtccaagatcacagtgtttgtgtgcctccccagtgcaaatcccctcccatcccagtcccctgtagttcctcccccatccccccacccttttttttttttttttgagacggagttttgctcttgttgcccaggctggggtgcaatggtgcaatcttggctcaccgcagcctccgccgcctcccggtttcaagcagttctcctgcttcagcctcttgagtagctgggattacaggcgcacgccgccacgcccagctaattttgtatttttagtatagatggggtttctctatgttggtcaggctggtctcaaactccccatctcaggtgatccacccgcgtcagcctcccaaagtgctgggattacaggcatgagccaccgcacccggcccagccctctgttcttaccagagcacagtcttgctggtctttgcctgctgtgttctctgcagccctaccattgagcaatccatattcccaatgtttctttctgagcgtttacatgatgtcttgatttgctttctctttccagttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtacgtggccatggggcctttctgtgtcttgtggacatttacgtggtatctttagagcaaacacagagtggttgcataagctgcagtgttttagtatcggtgggactgtggcatggcgtagcaggagtgacagtcgcaaactgatggcccagctctgaccctccaggcaagtggactccgaggagtaccagcagatcttcccacatgcgtcggggagggctctggggagagtcagtgggcaggagagggtcagctgtgcaggctccagggcccagccccgtgctttcccctctgaactctgcttcagggggaggagttccatgcagggacacctctgggtgccgttacagttaacatatcaaaggcaagcgtgttattgccaggtgtacaaaagatgagacttccttactaaaaatggtcatttgggcatttgaatttgagaactgttgacacttacagacttagattcatttgtctcagtacctgggaggacagaagggagcatggctccaggtcttggcccttaccggggcttcctgcttccggatgggtgccactcccacctcctggttaaacacatttctttttctccccagcctggggggaccagagtggagccatttccagccaagtctcacagtcacagtgctgttgaagggcggtggaagccagcccaggccttggcagagcacacgccggcccctgtactcagctgtgtggtggctgcaggaggtggaggagggtggctgaaatgggccttcggatccccctgggaggaagtggagcttctggctggtgatgatccaagccaaggttattgggagtgttgacagaaggccccctcatcacatgacagtgacagtgcagtgccagtggtctcagccaccatcgctactcctgtgttctgtgccttgtgctgggctctagggatcacagacaaaggaaaaacggctcatgcctctaagctcctgtgttacagattgctttgagattggggcggttttgattttttttttttttttttgagatggagtctcgctctgtcgcccaggctggagagcactggcacgatcttggctcactgcaagctccacctcctgggttccaatgattctcctaccctagcctcctgagtagctgggactacggcccgcaccaccacgccctgctggtttttgtatttttagtagaaatggggtttcaccatattggccaggctggtctcaaagtcctgacctcatgatctgcctgcctcggccttccaacgtgctgggattacaggcctaagccactgcgtctgatgatagttttgatttttttgatagtggcctttgcttctttttttaagttttataagtgagtgctgagaagtcaatgccaggggctctggatttatcgattgcgtgtgtgtgcgtgtctttgaattttaacaaggctggccatatgctgcaggttaattccccacgtggatgcaactttccctcccttcctggccgtgggagactctgggtcttgtcccatgagagatgcaccatccgtcctcgtcacaacatggcacacaggtgagatcgatgcctctgggctttggtgtgattctgctgttgtttgctcccaggtgtcttggctgggcatgacaaccgcgtcagctgcctgggcgtgactgacgatggcatggctgtggcgacagggtcctgggatagcttcctcaagatctggaactaacgccagtaggtaatgcagcagcccaaatgcccttctctgaggagaactgtgcgtgtttctcatagaacatttgaagttgtcattaacggtttctagataaatgttgatgtagcattgatttggaattgtgttgtgggaaacgtttacagaaagctgaagtcacgtgccctcagctgcagacactcatgcagtgatgggaagagcagtgacctggctgtgcgtctgcacttagattctctgcctcttttcacatttctttaaactctgtttaaaacagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatg

SEQ ID NO: 35656 - DNA, 4796 bp, Homo sapiens
cgcccctgctctcgcgccggcgtcggctgcgtctccggcgtttgaattgcgcttccgccatctttccagcctcagtcggacgggcgcggagacgcttctggaaggtatcgcgacccggcgggcccggcacggccgggcggggacaggggtggcggcggcgggataggggtcggagccggggccagggccggggcgggtggcggacccaggggcagcgggcggctgagtaggtgggtggtgcgggcccggccgggccggggcaggagacgggcgtggggtcggcgctagcccccgcgaacccccgtttcatcctccgctctcatccccgtcccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtccagttcaaagtaggtaaccctgcggggcgggaggcggccgagcccgaccgcgtgcgactcgcgggtccctcctcctggggccacgatggctgtaatggggccccgcatccacattctttgttttaagtgagcctgtggtggttaaagttccgtgactctgggatcttgagaggtgaagtgtttagggtttacttccaaaatgtgtttttcaacagcttgtattggttggtgatggtggtactggaaaaacgaccttcgtgaaacgtcatttgactggtgaatttgagaagaagtatgtaggtatgtgctggaaaaccttgcttgtggaaatatgtgagaaatgggtaagttcatccactcaatcgcatcgtttccgtttcagccaccttgggtgttgaggttcatcccctagtgttccacaccaacagaggacctattaagttcaatgtatgggacacagccggccaggagaaattcggtggactgagagatggctattatatccaaggtaggcatttgtaacttgctgaacggtttttgagaggttttgtgtacttcagtcttcaaggttatagaaaatcaggtctgttccaacaaatagtgtcatttttgggttaaaaaaagacaagtggacttcggggagttgaccaccattttggtggcagagaaaattttattaaagttgtgtcatttgcatgctgtgtcatgctaggcatgctttagaaaaaactatgacttacactgggacttataagtcatatttaaaacaataataggctgttaacagcagtttcagtatttggaaacttaggttcatgtatgtattttggtgtggtgatcaatgaatgtttttactgtattagaaaacaataaacaccagatactagaccagaggagataggagatcttaacaagtgttatacaagactagctgatttcttgttaaattgtttgtactaagttgtgcagagtatttttctcaaatagtttgatttaaaaattgcaaggaaaatgttcattgtaccaaaaagaggaatcaagaaaatactcatctctcttggaacctcacgttgccgataacacattatctggaatcattccatgccttttgctttccttgagcatgtacaaataaacacaagaatttcccccaaaagaatcctttaaccaaaaagttgtggtttcttgccttgctaactgtaccatagttattcctgcaggtgaatatataggctttatctgggttatttatttatttaatttttttttgagacagggtttcgctctgttgcccaacctggagtgcagcttccgcctcctaagctcaagccatcctcttacctcagcatcctgagtagcttggactataggcacgtgccactatgcctgactaatttttgtatttttttgtagagatggggattcaccatgttgcccatgctggtctggaactcatgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatctcatttagcattaattacttcagatacttttttgggatgaggggagtattaatggtgaagtatatcagggagatttgatagggtcagctcatctctcttaggaggaattgtgtattaacatttttagaattgacagagaccttgaaagtgaggggagagatacaggtgactcgttgaggtctaagactataactagttgaatcctagtctctggttcttagcattcttcacttgtgcagtaaactgagtgtactaattcccacaaatgtttcttcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcaggtgtgtaaaattaaaacttcctgagttatttctcttagcggagattatatgtaagaccatgaaattaaccagtgtctattatatatggaaatgatttttttttccccaagacggagtcttcctctgtcccccatgctggagtgcagtgtcgcaatcttggctcactgcgacctccgcctcccgggttcaagcagttttgtctcagctcccctagtagctggattacaggtgtgtaccaccacgcctggctaatttttgtacttttttttctagtagagacggggtttccaccatgttggtcaggctgatctccaactcctgacctcaagtgatccacttgccttggcctcctaaagggctgggattacaggcatgagccactgtgcccggccggaaataattttgtcttttttatactactgtttttaaagaatgatagagattgggtttcactgttggcccggttggtcagctgaaatgtttgtgtatttatatatttgttgttcgagacagggtcttgctctgttgcccaggcaggagtgcagtggcatgaacatagctcactgtagccctgaactcctgggctcaagcaatcctcccacctcagccttctgagtagctgggctcacaggcactcaccaccatgcccacctaatttgtttttttgtggagttggggtcttgctctgttgcccaggcctgatcgtgtactattggcctcaggcaatcccacctcagcccccgaaagtgctgggattacaggcatgagccaccatgccttgccaagaatcttaacattttcttatcttgcaatgtcctagaaaaatcgtcatcttaataatgaattttaaaaagtaattttacctttcttttaaacagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaag

SEQ ID NO: 35657 - DNA, 32111 bp, Homo sapiens
gcgcgcgtgagctgagccggtgggtgagcggcggccacggcatcctgtgctgtgggggctacgaggaaaggtaagtacggtgatgcccagccccttcaccactgcctcatctttattcgctttctttctgtccccggtcttgttcttggcgcggcaggggactgcctcactcggtgccgctgtctctgctggcgcccgggtcccaggcctgatgctgctggagatcccgggaccctctgtgtgcagcctgggatggaggccgccgcccgtcttaccgcgcgctctgggaagggggctggtccggtggaactctgtcccgttgggtactgttctgtgcctggtttgctgcgtcctggtcctccatctctaggtcacgccactcaccgagtctctggcaccagagggtcattttttgcctccggaaggtcggagggcatttggatagtgttattgtaagagttccttgccgcctccactcaccatcctgcttgtatctgccagctccgccccaaggccacatcccgacagtagggtgcatctgccaaggtcgtgttcactcacctaaagggtgcagaaacaaggggggagagaacgagtgacgacactaggtgatatctatgattttaaagaaaagctgaatgtttagagcttccatatttggctacgtacttcagttagcgacggaaaatagtttttaaagctttattggggaattaatttttgttacgttttttgttgcttctagccccatatcctactgatttttagcatgctgcggtcagaaataaacttaattccctatagctgccgcgattaagcgtagagtggcttgcagtttcaaaagctgcttttgcatcaaggcccaagctccgtgggtctcctgctaaaacttttgagcctgtgatctgaattcctaagtgtataaaattctagaatagtgtcttcgagaattgagttgcgttcattttctggtgtggaccatgaagtcaacgttaatgaattgggaataaggtggcttctagttgttttttgttctagtagcttattcagcttggaggcagagaaccttggaatctctgttaaattagtctgccatagaatggaacttgacacaagacaaatgcaagtttgacctcactcagtagatttaattaaccaaataccaaacgacagtaatcactgaagaatttatatagtataatccaaatgagggaccagatataacctctaagttgtatttgtcaagaaaatgagtttgccaagacctaatctgaggttttactgtgattggggggtgggggggttccaataggattcttttgagaatcacaagtaggaaagccatgagctcacaaaaatgtattgagtatgcctgagtgaatagtactcaatatagctttgaaaccaactcattgtcactctcaatgtaatcattgtttgttttcattcatccagtgatgtgtcaagaagtacttattgatagcacttaatatccattagagcagtattgggatctatatattggtgttattttttaaaatttatttattttagagttgagggtctcagtatgttgaccaggtggagccttgaactcccatgctcaagcagtcctcctgcctcagcctcccaagtagctgagactagaggtatataacaccacaccctagtacattggtgttaacacagattttctgtaacgtaggtataccagggatattgaaaggacagaggtgtagccaaggatagccactggaaatgctagctaggccacaaggccctagattctcactctctgaactcttaagtatggatgttgctgatgcagtaatttatgtattagagttaagacagctgaaataacacttttgcctgttcctggctgattgccagatccagtaaacggaattggaagttggagaacacaggcaggcaggaaccacattgctgccaagtaccgcccaattaattcagtaagatgtattaatccagtaaaatgtattggtatcaaaaaagtgcaagacaatgtattagggacaatataggggtaataatttgtattagaatgatatgtagacattcttccagaaatgtcgattctaaaggggagctaaggagacaacttaaggtaacctatggtcattgtttttgagtggttcagacgagttttatagaagtttagattggatcataccctttttgtccaaaaagagaaaaagataacagatcacttccagctagagtgatcatagtaggtaggtcttctaggatcttaaatttatttatagacatctggcactgaaggaagtttgagctaaaataactaccaaattctcaacagtgtcacgcatgttacacatgcacagcaaaattacaactagaaaccaaggctcctatccctacatttcaaatagcatttctctcacaattgattatgtattaaggcttgtcaacgaaaaggaaacttttttctctcagaatttctagaacttttttctttaaaaagttttttattctgtagccagaaaaatttaaagtttgtgctgggttgctttggttatagaactaatgaagcttgagtaatagtttcagacattctcagggtttttcttctgcagccagattttacacttctattatctcagctgtcttataaatgtattccctccatcacacaatataattagaatgtattgatgaacagatgtaacttcatcactagagagacgttaaataaattatgtgttggtatcatgacttttatcaaatcatgaaggatgccatcacttttatgtgatagtccattggtatagtactaaagtttgtaagtaaagaatgtcagatagataacaagataacttcattttcgagatctcataacctgggccttagtatagttaaattgctatcagtctgttccctgtaatctccaattgaagtagacagttaaacaatgagatcctgcttttgctgcgttatggagaaataaatgccttttctggtgaatatccatccagctcagagaactggaattttactaccacacccatttctcccaattgttaacattgagcaatgggtctttggtcaaccataataactgttggatcactcagtgttaacgttcttgtgaagttgaatttaaacatctaaatttccctgaaacaatttaagtattctgtgaccaatggcactttaccaaaattgaaagtttgggccatgtattgctcgcaatactggtccaatggatacactatggacactaaggacaaaaacttccttgaaagctctaagttcttacctgaagggtggggtagggagaagtgataagaatttagagcttttaaggacatttttggatggatcgaagaaaccaattcttaagactcattattattaaaatcacacttaacccagttaggcttttctctttataaattactggaacgattcatgaaaacaactttatagaagaccattattggtgacatactaatactacaaaaggatgatagctactggatatattttctgttctaatcttttggtttgtgtctaacatgctgtccaataaaaatataatacaagccacatatgtaattttaaattttcaggtgaaaatctaaaacaggtgaaagtaattttaataatgtttaatctaatacatataaaataccattctttcaatatgaaatgtaacacttataccaatcgcaattcacactagccacatttcaagtgcttagtagtcacatgtggctagtggctactgtactgggcagtacaggcctagattttttttttttcccaagaaaaaaatattagatgttacccttcgtggaagagggacagaattttagagagagaaactcatttgagaaatgggaggtggggaaattcagttttcacaaccattggtttactttctagatcacatgataaaagctcatacagctaagtcttttgtttatgtgtatcatatttttcctaatattatgttgtccattatgtccatagtatatccattggaccagtattgtgatcagtatgtatggcccaatggatacacaaagatctttccagctggaagtgatctgtacctattcctctaaactttttttttactttttggacaaaagtatccaatttaaacttttttttttctttttctttttttgagacagggtcttgttccctcaccaaggctggagtgtggtggcatgatcatgactcactgtaacctcgtgtctccggggctcaggcgatcctcccacttcagcttccccggtagctgggactatagctgcgccaccacacccagctaattttttgtatttttggtggagatgggattgcctaggctggtcttgaacaccagcattccatccgccttggccctccaaagtgctgggattacaggcttgagccactgctgctggcccagtctaaacttttataaagtgttgaagtgggtgaggaaaatgagaagggccattaactttgtatcatttggtttcaatttggttgaaaagacaaagatgcttcagaaatgaagtgtactggctggtcatggtagctcacacctgtaatcccgacactttgggaggccgagacgggagaatcacttgaggtcaggagtttgagaccaacctggacaacatggtgaaaccctgtatctactaaaaatacaaaaattattcgggcgtggtagaccatgcctgtaatcccagctattgaggaggctgaggcaggagaatcacttgaacccaggaggtggaggttgcagtgagccaagatcacaccactgcactccatcctgggcaacagagacagactcagtctcaacaaaagaaaacgaagtgcactaaagtagattttcaaatgctgtgtatgaagttattttttactgttcctttcacatcttcccacgtaagatatcctttgtcttagatgtcctttgtttctgcttgaacatacatgctccataccaaaaaccatatggttttagataaatctagtacagtttttggtatggatggtgttttttgtttttagtgtctatattcataaaacaagagggctttgttaaagtttctaatagccaggagttgttatatatgtgggcacaaaggacgttttgtttttttttaagtagaacttctttaaagtgcagatttttcattcctccctgcagaaagataaagaagtaaagatggaccattggctttgtccatctgggtccttgatgaccgttgtaggcagtttcatcaatagtaaggaagccaggtttcagggtagcattggacagtgaggaagcagaggcagcagggtagaaactgtgggtgagggaaagggaggagcaagcatgaaggaacagcacagtctgggaaagactgtgggtagtggagacctgagaagcactgattgacagaatggaggagcctgtttaagggatgagattgaaagtttattcaggagaggggaaggaaggagaaatgggtgagtgataaagctaaatcacttggcttctactctttggaattctggtatccttgtatcaagatattaagcctgaaacataaatgtagttttccctctaaatcacagagtaaaccaatctattacatttctgtatgctacatgtctcaaaacttggtacagtatcctttccaggaccagattatgttagagtgcataagtatttattcatattgtaatatttggggttggcaagaattgttagggtattatgctatattttattttgagaatgtaatcatttgtaaaattttcctaaagataaagtccccttaggcataaggaaaatcctttgttgcagtgactcttgattttacttgattctgcaagcctctgtcactatacatattgttgggatatatcccaaaacatcaacaacatataattctgttttttgtttccaaagttttgtttatctaaagaattatttgtttataggctgggtatggtggcttacgactgtaatcccagcactttgggaggccagggctggaggatcgcttgagaccagtctgggcaacatagtgagactctacaacatttttttttttttaatttgctgtgcatggtggtacacacttgtattcccagctacttgggaggctgaagtgggaggatggtctgagccccagaggaccagactgcagtgagctatcatcacaccactatatctagcctgggtgacagagtaagaccctgtctcaaaaaaagaattgtttatagtttgagatagaagtttcattttgccctgaagtaaaggcatactcactttaatgttgtatttatagagccgctaaatctcggattttctgtttactctttaactgatttgattgatcagttgaattattggagggtcagccagagtgttgttcacccagagcaatattttacaagtggtgcacacagaaagctaataaacatgagagtgtgctgttcatacaaattagacagtacagcaggatacagtattaaagttcactttcacaccaatcttaccagcccaccccattcctgtctcttctcccatgaaccttgaggttaccactgtttacacatgggtatttgtctttgcacaccatttatgtgcatgttatattttatacaaataaaaacaagctggggagattgtttaattttgttttgctttttatgtaaatgagatcttgacgttgttttgaaccttgctttttttgttcacttgacatatcttggtgaattttccatttcactgcagatagatgcatctcgttctttttttttttttacattcttttttttgaggaagggtctcgctctgtcactgaagtgcagtggtgagatctcagctcactgcagcctctgcctcccgggttccagtacttctcgtgcctcagcctcctgagtagctgggactacaggcgtgtgccaccacacccagctaagttttgtatttttagtagagacagggtttcaccgtatttcccagggtggtctcgaactcctgacctcaagtgatcctcccgcctcggcctcccaaagtgctgggattacaggcatgagccaccatgcctggctgctttttttattttttttgagataggatctctgtcacccacgctggagtgcagtggtacaatctcagctaactgcaacctccacctggtgggttcaagctatcctcccacctcagcctcctgagtagctgagactacaggtgtatgccaccatgcccagctaatttttgtatttttagtagagacagtgtttcgctatcacccaggcttgtcttaaactcccggatgcaagtgatccgcctgcattagcctcccaaagtcttgggattacaggcgtgaaccaccacccccggcctcatgtcattcttttttttttttttttttttttttgagacggagtctcactctgtagcccaggctggagtgtagaggtgctatctcggctcactgcaagctctgcctcctgggttcacgccattctcctgccacagcctcccaagtagctgggactacaggcacccaccaccacgcccggctaattttttgtatttgtagtagagacggggttttaccgtgttagccaggatgatctcgatctcctgaccttgtgatccacccgcctcggcctcccagtgtgctgggattacaagcatgagccactgcgcccggcccattctttttaacctttgtgtatttttccataatcgagatttaatatattttaccaattctctgtttttatttgttttccgattttttaatcattgtgaactgtcatcattgaacatcttaatacaagtatctttgtctgtaaatgtgggtattttgatgggattgaatgaaacaatgttgagaaacatagccaagttctaacattgataggaatagagtaataagtaccatcttctacccatttctctatgggtttcatggtcttgctttcacattgcttcttctgatggattttcctaagtcttaaccttcacgtcatcagtaacagtaccttatttgagactggggcacttgggaatgactgccccccaacccccgcccccattatctccttaggtacttttctgtttgtcttactgtgttgtcgtatttactctagaacactttccactctctactgatatgtcctcctctgccatttcaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgtactctgcagcttctttgcaggttttttgtcacatttttcagtcaagtgttccagctttgtgcttgttcattagagtcacctgtgactacagagattctgaaagtttgaatcagggcctgggaatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactggtaaaaatttctcactgtaataattgaagagtctgatattccaccatacttattttatggatgaagtaatatttgggataatataaaagacttgcatagatatgtatatcaaattaatagtttaactcggatgtgagcttttaatttcttatttagttattaagcatactgcctcctgaattaactgcttttcattttcttcaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttgggtaaggtaccacctctcaggggtctagtgtgggtaatgacattctttataaaggctaattcttttcttttctggctcagttatgagtaaagttatattgaactattaatacatcttctgaaagctaaccatggaattactacctctaaaatttcattaaatgcctgatttcatacatttttaattgaataacagttggtgcctcattctacaaagcatcatttttgcataaaagtaccaagtactgcaagacccaacttgaactgcattatcttgctaccagaagaacatagcatggggggatttctcatctcttctcatctctactgcttttaatttttaaaaactatctgtgccctactgacctggcacaagccaagtctttgatgggctaataaacggcacattggatccctataaagtttatgatttcccgaggtgtccttcaccctctttattttcattctcagatatttgtttaattaaaaaacaaaaatcaaaccaactttgtcttttagaaaattgtaacttaatgtctgagtatgagttactgtttcagtaacagcagggccatagtcaggttctttggctctctcggtagacatcttttgtcctgaaaaatggatttggtagaatcccagttgattatttctaattggggatctgagaatgtcttttttggtccttccaaagccttccttttgaagaaaatgcaggtcaattttgtaaaaatattcttctcagtgagcactgttggtgcaacttcctgattgtattcaagagatttgtgtggaaagttgtgccacacatagcaatttctaaaaatattttgccttgatgggtagcattttgatcataagacgttgtaggatttgctttggaagatgctgcagaatagatgtattttttcattgggttatctactgactgaagggtacaatgttttatttttcaacattgacagaaataataaagatattttgctatgtagaatgagcactgtcacatagcatttgaaagtagatagatatgcatcacagagttagttttctattaggttgctttcctttgggagaccatcctcactttcagttttaatctaataactgtactaacattccaggctgaaaatagaaatgcagatcaggtacggtggctcacgcctgtaatcccagcaccttgggaggctgaggcggttggatcacgaggtcaggagatcgagaccatcctggctaacactgtgaaaccccatctctactaaaaatacaaaaaaaattagccgggcgtggtggcgcgtgcctgtagtcccagctacttgggaggctgaggcaggagaatggcgtgaacccgggaggtggagcttgtagtgagccgagatcacgccactgcactccagcctgggcaacagagccatctcaaaaaaaaaaaaaaaaaaaagaaaatagaaatgcagagggtattctaagtcttcatgtcatgcccattaatattgtgcacgtccaacccacattttggtctgcacatattttttcacagaattaactctaaaataatgaaaggcccttaggtttggtatcatttagggtagatggtactataatgaggatgttctggctccttgcaggtagggagaaagctctgctggcacttttcagttgaaagtattcctttttgtgatcagtggatattaaaagtttgtcacatatgcagattctgtatttgattagaataagatgataaaatcatgttttttatggaatgtatgaatagactgtttgcttctcccaaattttgttggtaatgacaaatatccctactttatacagtaacatacggttgggagcaagaatcccacatgaaacttttaaaaaacttatttactgtggcatttcaaaacattgttttggtggggtaatgtataccagctgggaacaacaggttccctcttttttccatctgtctatatggcacataattattaagagataagtcattgttcatgcctttagttgcaaaaattcacgactttttgaaatctttaataataatagctaaaagaacacaggaagcattttaaaacaattcaatatacaagtttcaggtattttttcttattaagaatgttgacaaataggcgattttatgtatccttaaaatgaagatttgttttgaggtagtggttcttaatattaaaaaagttctctggctgggcgcaatggctcatgcctgtaatcccagcactttgggaggccgaggcaggcagtttatgaggtcaagagatcaagaccatcctggccaatatggtgaaatcccatctctactaaaaatacaaacattagctgggcctggtggcgcgtgcctgtagtcccagctacttgggaggctgaggcaggagaattgcttgaacctgggaggcagaggttgcagtgagccaagatcgcaccactgcactccagcctggcaacaaagtgagactccgtctcaaaaaaaaaaaaaaaaaaattccttgatatatttactatagaagtgaactagagcagttcattatccttttggggatcacaggcccagaccctttgggagtctaatgaaagctaaggacttttcctcagaaaagtgcacacttacatatacaattttgggctaggcgcaatggctcatggctgtaatcccagcactttgagaggctgaagcaggaggattgcttgagctcaggagttcgagaccagcctgggcaatatagggagaccctctctctacaacaaattaaaaaatcagctaggcatggtggcatgtgcctgtagtcccagctactaaggaggttgagatgagaggatcccttcagccgggaagggcaaggctacagtgagctgtaattgtaccactgccctccagcctgggtgacagagcaagaccctatctcaaaaaataataataacaaaataagaaaattttgcacactgaaaatttcaggaatattagtcacccttctggagcccatttattgatccaaattcttaaacaactgaagggtttgctttatgctccttgaaatgtagaggtatgtgctacctcctaaaagaaataacatgaggtgcactaatgcactgtgtctgtcctagaataaaggcttatttagtggcgtccatagggttctcccctgtcacaggactatgacaccattagcttcataaatttacacaggcatttaaagatgataatttagagccttatgcctaaaataggatgtgcccacttccagtgtacttacacaactgcctgcaggcttggtgctcagcaagataagaatggcttttacattttcagaggcttgttaaaaaaaaaatacacacacacacacaccataccatatgttgcccacaaagtcaaaaatatttactatctgtcccttttttaaaaaagaagtttgccttgtaaactatatttctgtttaagtaaaaaacaataaatttttttcttaagtttgccaacccctaggttaaaccatttgagttgtttgcattgaatagaatgctcttcagtcaacttaattaagaaaagcccaccttgaacagtcatatgtctttttttatctgggcgatccttctcttcaggctatttataatagtttaaaaataccttttgggggtaggaggggttctggttgccctttttccttgccctttatttctgaactgtacagtggcactattggtagccagtaccatttgagcacaaactgcattccattataaataatgtagaacttttcaatattggtatagcttcatctgtgaatagtgttaaaattctacaggactaaagttacaacaacaaaaattgtccttatgtctatgtagatagaagaggatatttaagagataactacttttttttctgagacgaagtcttgctctgtcacctgggctggagtgcagtggcgcgatctcaactcattgcaaccgccgcctcccaggttcaagagattctcctgcctcagcctcctgaatagctgagattacaggcatgcgccaccatgcccggctaatttttgtgtttttagtagagactgggtttcaccatgttggccaggctggtctcgaattcctcacctcccgccaggtgatctgcccgcctcggcctcccaaagtgctgagattataggcgtgagccaccgtaccaggccagagataacttcttactggtttacctttcctgttaacattttagagcaagattacacattctctgaaggaaaatgctagttacttacaggatttaagtaatagttgtatctaacacctgatctgtatcaaaatgagtctcttttcttagagtcactagtacttttcaattctgatcactttcctatgttgtattcatgaaatgaacacaagctggggaaagacattatttgctaccaagtgacaatcttttcaatcctgcaaataatagagcataggactataccaagatttctcttctgttggaagttttgacttcaacttcatattccaaactgggctgcttacttgggtgacattacataggatgactttgcccctatagttaagtgattgcacctttaaacagaagttttcatatcatggacatatttttaaatccataagatgacagatctggaagaaagacacttataaagcttcataaagccactgattctttagctttgtggttttgctttataatctacatactaaccctttcagcttattaacattcttataatcagatatacattcttaccacatcatttcctcagagttctctgttttcatgtaaaaatccaattcaacacagtatttaaaagctgctagccattttttagacaagcatcttcctgtctttttatctgttttttaaaaataatcttgccttgagatataaatgatcccagaacttttctgatatctttgtatttttatcaaaagtgttactttttctaaaatcagctaaatttttgaagtctgatgtaactattttgaatttttagaaaaccatgattatttaccaagaattggagtttctcttctgtaagcaataaagaaaaataaagttcagccacatcttcgctagagaaaataaaaatgaaaacaaggaaaaacaaagttttacatgttgtttgatgcaaagagtggagaacttggataggaatggatattcactcctgaattctaaccataggctgaaatctacctccaaagagataggctgagtttgcttttggatccaagtgcaccagccatgactgtgttgaccttattcacgtggcttattacagaccagtaatggaccatttttttcagttgctggcctggcagttttgttttggagacaattttttatttctgtgcattagccctgggcacacacctggctaagtccagagttctgtgtctttttaaccttttgctggatttctctgcattttctacagaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttaggtaggtccctactgtctgggggaaaaagccttgtggagctggcaccttgaaacgtaactgttttgtcttgtagaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctgggtaaggggcaagatgtcagcctggcagggaccgtggtcttgagtcaaagaaacaaatgggtcacacagtaaaggaaaggaagcttatcttaaatagttcaattcagtgctaagctgattccctttattaattttaaatttgtatattatgtatttttaaatttgtttaatttttgttttctgaagtctggaagtctggtatcttctacatttttagcattttacatatattttaccattttttctttatgtcatccctcatagagacaatttttggagtagatttcatttaaaagaatacattgggctgggtgccgatagctcacgcctataagcactttgggatgctgaggcaggaggattgcctgggcccaggagtttgagaccaatctgggcaacatagggacaccctgtctctaccaaaaaaaaaaaaaaaaatttaaattagccaagcatggtggcacacacctgtcctagatactcaggaggctaaggtgggaggatcacttaagcccaggaggttgaggcagctgcgagccatgattgcactgctgcacaccagccttggggacagagcgagctctgtccaaaaaaaaaaaaaaaaaaaaaaaagaggctatgaggctacatacttccaacagtgcaaagcaaggggctttgagatgtttcttgacatggtcccagtaaagtgttggacctaaaattcaaaccaaattagatttctttataactggtgagaagtcttaataaaatagttttccttaataaaatttaactatttcagtatgtctgcttactgaagtttggaaatgaaaatttcccatttgttttctctggcacatgagtttatcagcctgctttgcaagtgctttaaggcaaataaatgttaatttgattgctttttgttgatttgatagcttgtatgcttgggccacctgttagtaattttcttttacttgtaacacttgcctgctgctgaatactaggcagtgagtcttattgagttgatgatccagggtgtttttatttgtgaaattcctctgttgtacatggttacagtttaagacaagaattgtattaatataaatgaatataaatggtactttctccattttaatcctggaaattaggcaaccttctgggttaaagcaagcgttctccgccactgactaacagtgagtgtataatggatctgtttccccacagatagccagctgtctgcattaattacaggactgcatgcatttctggtgaagagacttttatttctgtgtcaggcttgttctcattcctaagactaaagtggcactctctctcaatgcttgacacttagccaagaaccaaacatatccttcacccaattaagaacacatgtattaaacagtcagcacagatggagaggcatcctgcttcttgctctggctgagacccaacaccttcctgatttatttggaattaatgataaatacaaagcaaagagtaggctattggtgatctaaacaaaatggtgtgtaaataaatctcagctccgacctaggcactcacttgctgcccagaatgattcttcggtgctgtgtatgattatgtgcataaaaatctgttgagagctctgttgcctcacaaggcagatgattcaacgtaatgggtatttctgctgcctgagactgcataagctgaagcactggctgggaagcaatgtctttataaggcatctttccccagaggcatgagggtggacagcactgagggggtcatgagtcggcttagagaagtgaggagtttttgttactgtgtgttcttgattcaatttggagttcaggtataaatcatcatagctcttagttaaaatctgtctcaatgaatccgctatccatgagagaaaggttaacactgtctctgccacaaggaaaatatgaaatactgagatctaccctgcctatagcaaaactagatcaagagcctacctaaagctgtatacaggccagctagggccaaaactggtgcttaggataaatacagcattccaagcagagctataggaaaataggttttgtcattaaaaataaagttttggacaggcacagtggcttatgcctataatcctagcattttgggaggccgaggcagaaaggttgcttgagtccgggaattcgcgaccagccagggcaacaaagccagaccccgtctttacaaaaaaaatattaaaaattagccaggagtggtaatacttgtcagtagtcctagctacttgggaggccgaagcaggaggattgcttgagccccagagtccaagactgcattgagctatgattgcattgcactccagcctgggccacacagaacaaggacctgactataaattaaaaaaaaaaaaaattgtatcttcctgtttccctccttatatatatatgtgcatgttgctattaggctatttgagtccagtcaccatttttaccttttaccccaaggaggggaggagagcacttatgtaagaatctagtcttaaagtataagttgtcttgttatgtttcttatttatgttacatagtcctgaaaccttgtttagaagagacactttagtatctgagaaaggcttgtttgccttacgttctccatctcaacctattatggctttgagtgtgtgtgtgtgtgtgtgtgtgtgtgtgtgtgtacacaggatcccaaagccttatgactcgttaagctgtctgactgaatttttgacactcaataaaaaatgaagcttcaaaatgctcaactctcaaaatagtacagtagttttgtttttgtttctttaaactgtgcttaaagtatggaaagactgaacaatctcaaaggtcagcagtaatgatgttattcttaaaggggccctgtgggtcttttttataaaagcagtgtcatatcctttttatgtaatcaatatgttgcaggaacaataatttcttaccattaatgtggtgtcttttactttttaaaatatcttcatgtctgttatcttaatttggtttatacaggaacgcagattgaaaaagaattttattttctgcagttaacgccacattttttcagcttaaaaaactaaatttcacttttctatattcttatatagagactagataactgctgcttgtgtagctcgatgtcataacagatgggtagttccaaattcaatttggttgtaatctaagggtttttttttttgtatacctttgtcaagttattattgacataaagtgaactgtatgtatttaagtgcataattgatgagttttgacgtatgtatttaccagtgaaaccaccactgcaatcacgataatgagcatatccattacccccccaacatttcctcatgtcccttggtaatccttctcattctcgccattcccccgtccctaggcaatcactcatctgttttctgtgactctaagttagtttgcattttctagaattttacgtaaatggggatgaacaatacctgtcactcttggtagatttctgcgttgactgaaaaaaaacagaatgtgaccttcaaagtggtggcattctattgcttgaatccaagtgtccattatgtgaggtagaaggcctttgatttctatctttttaatgagatcctaatgtttaataaaagtagcaataactgacatttgttgaaagccaactatgtgccaggcattgttctaagcacttagatatattttctcatttaaaccttacaacaatcctatgaagccggcaccattgctagctccattttacagataaaagagaccaagacacaggccaaacagctagaaaatggtagagttcaaactcaggcagtatgggacttgagagccaccactgccttccagatgtaactagaaaattcaagccttctagtagccttaataccaatagtgaagcataacagtgagttacatagttcaggagccagagttccatgtgaacttggagctgactctgagatctgatgcctggagctgtagcccaaaactaaatgtctttgtactgctgcagttttacctgtgtcatcaattatttcttccttgcatggttttatctttattggaaattgatttcccaccccacacattttcatgttttctgaaagtcttttaagatttgacctaaatttttgttttctagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggtgggtgagatgaaggattctgaacagggactcagtttctctttttgtggcttattctgtctttcccctttagccttatatagcatatcttatatatatatatgctatatagcatatcactgtatatgctatataagtattggccagattcagaatccaaggtctgtcactgtttttctgtgaccttgatcaaggtgccttgggcattctgtttagtatgataataccttctgtcatataatgtattttgccatttcattggtagcttcatattgtaagaatggggggaaatcccattatttaaaatatcccatgaccaatagtcagacattgagtaataacagtgatactaaagaactctcacagaaggcagttactgacaacatagactatctatagctaaacacataatcactggtcacatctcctgttagtgtgactttagcatgactaaggctaccaggtagatcatcatgggcttgatgggatagtttgtcattaagcagtgtcagtgttctgtcaggaagactcagttattttagattgaagcataggaaattgctcatgttttaccatttcttggctagaaatggttttaaccatacagacacacatgcatacatacatacatacatacatacatgtacaagtgtgtttaatgaataataaatgtttacctaaactagatactttactttcttctggcaaattcagagaccaacttaatagtctcttcttattctttcctgtttaggaaacaatggaagatatagataagaatgctgatggtttcattgatctagaagagtatattggtaagtctctgcttttagtgtttttcttagaaaagctgagaagctttgaaaggtgtatttgctggctgggcacagtggctcatgcctgtaatcccaacactgggaggccgaggcgggcagatcacctgaggtcaggagtccaagtccagcctggccaacatggggaaaccccgtctctactaaaaatacaaaaaaattagttgggtgtggtggcgggcgcctgtaatcccagctactcaggaggctgaggcagaagaatcgcttgaacccaggaggcggaggttgcagtgagccgagaacacgccattgcactccagcctgggcaacaagagtgaaactgtctcaaaaaaagaaagaaagaaagatgtatttgcccatagaaacaatttactccaagggtcaattctcactagctcattagctgtcaccagatcattaaccagaccagtgtgatagtgggttgtgataaagtatccgtagccacattgcccaatcaaaatataaatgtgagccccatatgtaattttaacttttctaatagccacattaaaaagtaaaaagaaacagatgaaatttcagtagttatttaacctaatattctaaaactctataatttccacttaatgtaaattattgagggtttttttttaatacttaaagcacatcccagccacatttcaagtgcttaataagcacctgtggctaccatcctcaacagcacagatatagtgtatcctgcatgctctatggaactgatggtaaagagttgcagggggctgggcacggtggctcacgcctgtaatcccagcactttgggaggccgaggcgggcggatcacaaggtcaggagatcgagaccatcctggctaacacagtgaaaccctgtctctactaaaaatacaaaaaattagccgggtgtagtggcaggcgcctgtagtcccagctactggggacgctgaggcaggagaatggcatgaacccaggaggcagagcttgcagtaagctgagatcatgccactgcactccagccggggctacagagcgagactccgtctcaaacaaacaaacaaaaaaaagagttgcagggagcccagactgacatagggaaacccagggaaaggagatagggaatagattaaaagatggataaataaatgacggggagttgctgatccctcttgtagccattcctttttactgtgttctgttcatattttctctctgattctctgactactttccttttgttttttaagtttctcccttttgacatttccctttttagttgtctaaatttttttaaaaaaattgttttggatgtcacaccttcaaggctaatttctcccaagtaaagctctgttttattatcatcagactaattttaagatattctcattgctttaaaaaaaaaaagctgtctttcttaccaagtagttgagcaaattgtttcccaattactgtgacagaaattaaaatgagtaaaggagctgggtgtggtggcatacccggttacttgggaggctgaggcaggaggatcacttgagtccaagagtctggactatagtcacaagttcatcatcaatatggtgacctcctgggagcagaggatcaccaggttgcctaaggaggagtgaaccggcccgggacagaatcagagcaggtcaaaactgtgctgattagtagtgaggttgtgcctgtggatagcaattgtactccaacctgagcaacatagcgagactccatctctttagaaaagtgagtaaagatggaaagtataagactgttactacaaatgtcattgttacaaatactttgtttagaaagatattagatattttaatatttcacatacttattgtcatttgtaataacttattctagcacaccattggttttgtgtttcagataagcccgtttgtttttagacctctgatagttacctgaaatgtttatttgaagcctgaaaggaagacttaatccttacctctatcacctgtcattaaactgtatggagcaagtcactgctttacttagatgttgtcttatcatacctgttgtttacatgctagagttattccaattgaattactccttgactgtttacctcccttttcttaggttcagtggcatactttgaactttttaaagaaggatgagcaatggaagataggatggatgttttcctaaactgattttttttttttttggagaagtttatcaggacagtggataagtgcctaggtgcatttactgagcccacgttgatgttactagggttttctacttttaaatgatttatctttttattcttggcttttgccattttattgccattgctaaaactgaggaactcatttgaacctcccaaggagaggaatttttataactgttaactacatcacttatcaagcattgaggccaaataaggagatatttctgtctccctgtgtatcatatagattcaagggcagaggagttatattttgaagctaccaaaactatcttgtgcatgtgtgctttttttttttttttttacaagtcagtaactaatgcaaacacttttacatctgggatgctgggctttgtaaatctaaaattctcccaaacagtatctttcagcttctagtgccctgttgaaggagatcatgaagaaacaaagttcttcgcctcataaatttagcattaaaaagaagccccatcagtgcctgtggaaacatagggaaagaaaaaaaaaaacacccaaagttgtgctgataattatttttatttttaaaatttattatagagcattgcagacgtacacaacttatttgtttatttatttatgttttttttgagacagtcttgctctgtcacccaggctggagtgcagtggcgtgatctccactcactacaatctctgcctcccaggttcaggcgattcttgtgcctcagcctcctgagtagttgggattacaggcatgcaccaccacacctggctaatttttgtatttttaatagaggcggggtttcaccatgttggccagggtgatcttgaactcctggcctcaagtgatctgaccaccttagcctcccaaagtgctgggattacaagtgtgagccactgcacctgcccccaaattagaatagtataatgaatccccatgtacctatgcctaacctcaacaacaatcaacttacagccagttttttctcagccacatccacttccttgcttccttcttactttgaagtaaatcccaatcattatgtcatttcatctgtaaacattgaggtatatatgtctaaaatatatatgtgtttctaaaaacatttttttaaagataatgtcaacccaagaaaattaataataccttcaaatcatcaaatagactgagtcttttaaaaatagaaattcggccgagcatggtggctcatgcctgtaatcccaacactttgggaggctgaggtgggcggatcacaaggtcaggagttagacaccagcctgaccaacctggtgaaaccccgtctctactaaaaatataaaaattagccaggtgtggtggcatgtgcctgtgtaatcccagctactcaggaggctgaggcaggagaatcgcttgaacccaggaggcggaggttgcagtgagccgagatcgcgccactgcactccagcctgggcgacagagcaagactctgtctcaaaaaaataaagtaaaataaataaaaatagaaattcaaatagtttatcatggtcacctagctttaaaatgcgcttacgttgtagtgtattgtgtattctagcttcctttaaaaccatatcttttaagcatgtgtctatttcctaattcagaactttccaatctgtatcctgtgagtaagtcttcttggctttcaggacagctagggcaggaacctgatccagtggaccgtacaaactacattttctgaatgtgctgtagcatgggaaaaaattggcaagtcctgctgtgaggaatttctcttgtgagtttaagacagaggagtacttctacccttaaccctcaaggtcaggaaaatggcagcactgactaaataattacctttgcttagaacttgcaggaactatttagatttctctttaggtgttttcccataccttacatgcaatgcaggtacacttaacttagatgtcgtataactcaagcattttcagacttgttcacttaaataactcctgaaagaatttgaccaacagcattcccttatgtgttttaaagttggcatctgaaatatttaattaagaaatttaaacagttgtaaagaatagtctctgttgggccggatgccgtagctcattcctgtaatcccagaactttgggaggctgaggcaggtgaatcacttgagcccaggagtttgagaacaacctggacaacatggcgcaaccctgtctctacaaaaaatacaaaaaaaaagaaaaaattagccaggcatggtggcgtgtgcctgtagtcccagcaactcaggaggatcacttgagcctgagggtttgaggttgcagtgcaccgttattgtaccactgcactccagcctgggcaacagagcaagaccctgtctcagaagaaaaaagaataatctctgttggtgataagcattgacattttgaaagtaattcggaaagaaatctataaaatttaaatacaagataccatagcaacttcttacctgccgtctttcatatgaataatttggacacgacaactttaaaaagataatcaagaaatttaaattcagtctgggtattagatgataccaaggaattgattttgtaaaatatgaaagtggcattgtgggtatataagaaaatatccgtaattttttacatttcataatagttaaaaaggaaatgtttctttggtacttttttttttttagttatggcgtttggttagcaacaatgtgaccatcacttaattgcccttttttttgtttaaatttatagggatttggggatatttatactacttatcagtcaccacatgatattgtcttaaaaaaataaatgaataaactgttaaccaacttggacattttacacgcatcctgtttcttcttcttcttcttttttaaaaagacaagagtctcattctgttgcccatgttggtgtgcagtggcacaatcacagcagcctcgatctccaaggtggggagatcaagtgatcctctcacctcagctgggaccacagaagagcaccaccacacccagctgattttttttattattattcttatagacatgggtctccctacattgcccaggctggtctggaaatcctgggctcaagagctctacctgccttggcctcccaaagtgctgggattacagacatcagccacccgacctcctgtttcttttttttctttttctttttgagacagggtctcactctgtcacctaggctggagtgcagtggcatgatcatggttcattgcagcctcgatctgctaggctcaagccatcctcctgcctcagcctcccgagtagctgggactgtaggtgcatgctgccatgcctggctaatttttgtatttcttgtagggattttgccatgttgtccaggctgatctcaaactcacaagtcagccttctatttgttagattcatttgcagtttacttcctcaacagaattatattctgacatattttatcttgaagccttagtcactttgacattcttatttgcaagaacattgtgtatgtaaattgaaatatggaaaatggtgttctgtgatatggctcttaagtgtttttagagtcttctgtgttaagttactattacaattattaatacacaattgaacaaaataacatttattacagacgttttatgtttatatatttttaaatgcatttctttgacacatttttattcaaatagtttcatatccatggatgacaattacttatccctagagtgaaatgggattcagcaccaattcctaatttttattttttagaggaagtactaacagaccttgtttacattagtaaataagttgatggaagatttgtcatagcaatattgcttagttcttggaactccttttgagttacatgccagaaatcatgtaatctatcatcaaaaattatgggttttgtttgtttcaaggtggagtctctctctctcacccaggctgtagtacacaggcacggtctcggctcattgcaacctctgcctctggggttcaagcgattctcctgcctcagcctccccagtagctggagattacaggtgtgggccagcacgcccggctaattttattttttatttttagtagagacggggtttcaccatgttggccatgctggtctcaaactcctgacctcaagtgatccacccgcctcagcctcccaaagtgctgggattacaggcatgagccactgcacccagcccaaaaattatgtttaatgatcccttagctaaaactcaattaggccatttttcaaggtttttttttttaaagcaaagaatttaaaaccttttgacatgcaaacgaatttattcattttttttcaggcatttgcattctcaagactgacactagtatttctttttctttttttttttttttttttttgagacggagtcttgctctgtcgcccaggctagagtgcagtgatatgatctcggctcactgcaacctctgcctcctgggttcaagtgattcttttgcctcagcctctcgagtagctgggattacaggcacgcaccaccatgctcagctaatttttgtatttttagtagagatggggttttgccattttggccaggctggtctcaaattcctgacctcaggtgatctggtctcaaactccgacctcaggtgatctgcctgcctaggcctcccaaagtgctggaattacaggtgtgagccaccacgcccatccagacactagtatttctaattgtttctttttcattatcttggagctttttacactctagtttcaaaatggttgaaaatatgcctttcttttataaagtgggacaagggcagttgtgaaaggggggagatgggaaaaaagccttgatggccagaggtacattcttatgaagatcaatttttggaaaaatctatatgtggaactgagtatctggaatttgattctctcttgactgacctttctcagtgtactccttgacagtgttcctgtttccccaggggcgtgcttgtcccaactgaaggccactggtataatggactctttgtagtaattggctacacctttctaaaacaagtggtcccgtttaattagctaccttagggtgaaatgaaatgtagggaacgagtctaagtctttcttgatggtagctctctcctcttatttctgcatttattaaggtataagaactctttgctctcatgtgacttaaaatcagcagctggaaatattcttgttgcaagataagtgattaagcctcaggaaaataccttgctttctaaggtctgtctggcctaaaatacccttgtagctgctgttgggttccaaacaaatggatgaggaaaaagggttaggccagattagcatgaggcagttttggggaaaagacaaacccttcttttgtatgtatgtctgtgtacccaggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggtaagtctggcgaggcccacacgctctatccttgattgaagtatgcttctaggggatcacctgaacagtttctgttaaggtgcatagagcatttaaggtcttaattagtctaagtcagccaagtatctgaatctggcgattaaaacctttcagggcagcactagctatctgatctcattttagaaatccttttgcccagtgctgatagcattgtaggaaatttggcttcagaaaagagcctttgtgtgtagcctgtgcccagcatgcatcatcaggtatttttagatccccaggaatttttttttttctttgttacttcatttgttcctttacctattacaggcccattctgtctactcaaagctggttgtttccttcttaaatcaaataggcttttttaaattgggtcctttgtatgggctataaatcagcttttctctggagcctgttcaaattgtccttgatcaattaattatctgaggtattttgttaaaagtattgttgtccctaagcccagtcacctgcttcagagattactcctgccctgcttggagtaagctgaaaatcggtctaaagatggagattttcagtgttctgagtatatttttgtctaagctaatcttcaatttcaaattcagttttttattttagagcctttttaagtgttgatctgctttaagttcttgctcaaagtcactttagtagccaggtgttgtgtcctgagatgtatgagaaaaggaaatgcatgtagtcatccctatctaggagatgttccatattttcctctaaaaggagagttttctcctcatgaaacaaacctttatctctagcattgagttgttgtgttatattctttccacccttccacttttaactttcttgataaaagaaatgtttaattggcctggcacgatggctcacgcctgtaatcccagcactttgggaggccaaggcaggcggatcacctgagattgggtgttcaagaccagcctgacaaacatggagaaaccccatctctactaaaaatacaaaattacctgggcgtggtggcgcatgcctgtaatcccagctactcgggaggctgaggcagaaaaatcacttaaatcactttaacacgggaggcggaggttgcggtgagctgagatcgcgccattgcactccagcctgggcaacaagagcgaaactccgtctcaaaaaaaaaaaaaaaaaaaaacaaggaatgtgtaattgctgttttcttccctcttcgtatgtatgtagggggaatgagggctgagtagttcacacttaatttagtagaaatgagaatcttaacttctgattaaccccaattcttctataacagtgtttctgaatttttaatgggaaatatgttcttcttcaattcattgctatctctactttcaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattc

SEQ ID NO: 35658 - DNA, 32111 bp, Homo sapiens; identical to SEQ ID NO: 35657

SEQ ID NO: 35659 - DNA, 32111 bp, Homo sapiens; identical to SEQ ID NO: 35657

SEQ ID NO: 35660 - DNA, 13127 bp, Homo sapiens
aagcggaggctccgagctctaggccggccggcggtggcggcggcgaggccgggactcgggcttagggcctgctgtggaggcagcggcggacgccgagctaagcagtgggtatcgggcacattcctttcccagaagggagggttgcagcgccgcggggccgaggcttatggggcgacgggatggtgctgaggtgcaggaggcgggggccgagcggggttcccgccagagcccggccctgggcctgacagggaggggccccgcgcggggccgagaggaaagctggctccggggtgggatggactgggcagggttgagggcacgagaaggcgtggtgtgaggcctggacttgggagtggggtggggccatcgggacggagggcggggtggggtttgctgtaagggtgggtcaaggccagggaagtagcacttgttcgctggccgcccctggaggctagaagctccggcgccgagagtgggcatggcgacttggtctcagccggactcgggtatccgggcagggtgggaccagcctcaggctatgggccctgcacctacttgatttttaagggactttgtccggttcctcgaacttaattggctcctgggaggttttagtaataaattgcgtgagaacgggagggtagcgtaagcaggaattctgggtcgcaattgtgtttactctgaccagagagagggagtgtgagtgtgtgtgtgtgcgcacgttcgtgtgtgtacgtatagctcgctctccccctgtagaatgaagttggtagatgggtcacaacgcaggagaggagaggcggtatgtcttggtttgtgacattaatggaagctcaaaagtggagaccagaaacagatttacttcctctgcactgggcagtctggctagagaacgtggccatatccttctgctttggctcagaaggtcatatgaatgaaaataaaacctgcctatgcaaattctggacggaatagtcctgcgtagtagggcccccaccatccctctcctttttttctttccttttcttttctttcttttttttctttttttgagacggagttttgctcttgttgcccaggctggagtgcagtggcgcgatatcggcccaccacaacctccgtttcctgggttcaagcgattctcctgtctcagcctcccgagtagctgggattacaggcatgcgccaccacgcccggctaatttttgtatttttagttgagatggggtttctccatgttgttcaggctggtctcaaactcccgacctcgggtgatccgccctcctcggcctcccgaagtgctgggattacaggcgtcggcccttttccttttttttcttttgtaagttgtgaggataggaaagggaaatcagatttcaaagttcagaaaacaaaaggcattcttcttctgggtgaagtggtggcctgaacattgtccttttgtccttccacactctcactgtttaataatcttgcctttttgaactgagaaaagacaactgttatgggtggttttctcccgaggggtgaaaatccagctttacttttaagacaggaaatgggcttctcatgtgaaaatagaagctgggtaatgcgcctgtagtgggggaggagggctggtaaataaaacaaaggtgtaagatattttggatgacctggttattgtctgcttattcaaaccaagctacattttaggatattgcacatttaatattcagtaactgagatcattcgtgatcagtagctttctttgatagttcttctatgatcggttgctatattttgggttttttttctgagagtgtaagtagtcctttcttcctgtaaaagtggcctttaggccaggcacagtggctcacgcctgtgatcccagcactttggggggccgaggcgggcagatcacctgaggtcaggagcttgagaccagcctggccaacatagtgaaaccccatctctactaaaaatacaaaaattagcagggcgtggtggcaggcgcctgtaatcccagatacttgggaggctgaggcaggagaatcgcttgaatgcagaaggtggaggttgcagtgagcacagatcacgccactgcactctagcctgggcgacagagtgagactctgtctcaaaaaaaaaaaaagtgaaagtgtcctttgaatgtgttttctaccttctactgtgaaggttttcctaccctgatcatgatgtgaaaagtatggaatcttatcctgttgcttttgtgattcccatttcaggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggttagtggacctgtggtgggtgtgtggggcctggggcttgggggtgggctggtcccaaaggattgtggtcagaacactgagccctgtaaagagccagacaggtttcagcagggcctcaggcactgttcttgggtagggatgggctgaactttctgactttaggattgggggctgggagcatttccctgtgttgaaccattgacctacctctaaatgtactgtcagggcagtgggaggttcctacacatgccagggtgtttactgcttggatttcagcgtgactgctggaggcctggggtgggggaggagtcatgttgtgatgggctttgatgcagtgtacatctgttgctaagacacaaatactttttggactcttgttttgtacctccccccacatcagaacacagacataccctgaagttctcctttgtggcgaggcctgttgttgtattgtcctgataattcagacctcctgggcctgagccaaagggtagatttggatagttattcttggccaggagagggccaaggcttccaatctttgcaaaaggcccactgcagggagtagggaagagaagtctgggagctagaaagagaaactgcattctgctgcccaagtcaacttgctttgagctgtcagaagagatccttagctcttgtcacatggctgacatactgttctgggcagaaagcgatgcagttctttgcctttcaagatgtgaatggctgctgctgcccctgcctcaccaacataagattgctttgagctctgggtttgtatggctctcgcttgccatccagccttaagtagccgggaaagaggcccactgcactcccctggccattagggaaggagaaagcccgattgggtttttggaggtggcatgtgaaggaatgtaaaaagttttacagatgttacagaaatgggcttctctgcctgccaggtcagaccacgttttccctccttccctgctctgtagtcttttcctgagcttagttctctgactgttagtgactgtcaaagagtatggcttgttctaggccagtggtcctcaactgggggtgattttgtccccgagggtgcaggtggcaatatcgtgaaacagttttggttgtcacatcttggggcggggttgctactggcacctagtgggtaggggccaaggatgctggttaacatcttgaatggcacagaacaccttcaaacaacagatttgtctgaccccaagtgtcagtagtgcagggattgagacactcggctctgtgctcaaatggctcatactggacctgctttgagagagactaggattatctgagcgcaggagccaggaacatttcttacctttcagggcctgttaatttagcttcttacagggccacttggaacttcacctctcttctgcttcccctttccttcaagtgggctctaatcttggcacagtgttctgaagtgtgcttcccagtctctgctctatgctcctcccccagggtagctcccccaggggtgggtgtaactgggtttgctcctggaaaccctgcagggtagctgcatatctgttcctgctgggatgggatgggatattttggatattattgggtgggttggggccgaatgggatgggactttgaccctgctttcctctgtttcttggccctcgtgaaggttgtgcttttcctcatctcaggcctttataactccctttgggaggtggggtgggtcagcattaggggcccaggctgggtatgggggaagggaggattattatgtgtctagaacaacatttcctcagcaactcagggataaaaatacccaggtccagagcatgtgacaggcactgctggaaccggtattatccctggggtggcagtactcccccgctgccaggcctgctctatggacagccatagcctaggctgttgtcagggataggattccccttgagattggcattctgcccagagcaggggggtggcctgtttacagctctttccaggctaggagctgactgtgaccagagagaacatactgtctctctgacctgaccttaggctccaggggagcagcagtggggagggagctaaatttcccctcgagaaaccaatccagggagtctgaattgtgatactgagtctgtgaggggcttctttcctgcttggatgagatatgggccaggaatcaggcagagaatgctcttgaataaagccggggtgaaaggggaggggggacatttgtggccaggagaatgcagagcacctgtctccctaagtatggggcttcagggttgtgtctcccctcctcttgcttggggctaggcttggccagcactgtgacattgctgcacgtgggcaaaatggccttccccttttctctagtctggcctattttggggtgacaaaacttacggcttatggtgggcctgggtgccctgggttcctgcccagcctggctcgtgatccctggccttgagaactggccactgccttcctgaggaatgggataactctttccacttccagcaaataatttagattcccagagaatctgcgggagaagtgtctgcccagtcctgagtgggctggatgagcaagatgcgacaggagggaggagagtggcaccccttcccccagggctctcactgcgccaccccagctgactgactgggctgggtggggctgcccgcccctgggcgcatctcctcaaggagacggaggcggcccagggatgggctggttccttgcggcagcttctccagctgccctgatgcagagattggctcccgtctgcagctaggtaacaggcggtgggaggggattggctccttccgcatctccagcggagacttgggggaggagattggctctcggcgcagcctaggtaacgacagtgggaggggattggctctttgcgcagcccagctgctgacctgggggaggggattggctctctgcagcctcagcagtgacctgcggggtgggagggggtggggattggctccctgctgcagcctaggtaacaagtttggggggcgtgggggggaggagcgggaggataggcccaggagggagcttgctttcctctgcagcttgagcacggagcatggggtgggagtcccatctcactgcagcctctgcggtgagctcagggtgggggcagctgggcgcctgagtggaactggggttgtgaggtgggagggggctgctcaaggatggaggaagggggctggctgggccgcccaggcagcagcacgggcggggcaccctcctcaggcccctcggagctagcaaggggccacccttccagcctggtgtgctccctgaaagccaagagctccttgcagccccctgtccggcttcccggcaccggctgccctggggctcatctcgcagaccatgacccgcctggaccgcagctctcacagtggtgggggccatgccaaaggcagccggccccttaactctttgctggctggtcaccgggtggcccagcccgcctctgctcctgggtccagggcttctgttcaggttggtgtatgtggggagactaaagtagtacgtctgggaggtcttagggtcagggggggttaatgggagaagaataccgacttagaggtagggaggagggtctgatctaaggaaattgctttctggaaagtgtatgtctgcattttaacccctggatggaaggcaacactttagggtttcttcaggcttgtagggagggctcgactacaggggggtgccatgtataggaagcccaaatagctctatttattggggttatatgctgttagtgggggtggcagttggtgcagcaactgttcacgagccaccagggtagagcgggagggaagcatttttggtgcccaaggtggcagttgtagctgagcagtgatggggtttatgtccttgagggggttgactgatggggatttggtgagtcctggggtatggtgagggaatgagagcactggtgtaggggacacagtgaggctggcccgagcagggggtggggtgcacccctggggatcatctgactgcctgagcctccctggaatggaggcagcagctaggatcagctgagagggaattctggcggggatgagtcttgaggtgagcctgggcttgaggagttgtgggtgttcagccttactcttgctgccagctggggaatggggaatggctataggaagggctggagacagcatggcgttgtcattggttgcatcaggtggttggaaatgcagggattttcctctctagcccaccccacccctttatgcaaatgaaatggtaccacaggctgatgcaagcctggccactgctaagtaattctgcatgacaattcgctcttgcttgccatggccagcttcctccaaaccaagttttaaggggtccaatccccaaagctagaggtgtctcctgatgttccccttctttcttatgtaggggggaggcggccctgccttttgtctgggtgtgtcttggtccagatcctaatcctttgcacccttatggtgatagtcacactaatggttttgctagtggctctttttttttgtgggaaggggatagtgtctggaagtagatgaatgaacacttgctggtgcagggaccagggggtaaaggctggcaggtgaagagctgggaggggccccacccaggactaactggggtgacactaggagggaactctgaggggcaggacaaggaagggaccttgggatcttagagctaaagtcatgtgatctgtctttcaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtaccatcgcccctgctcactgggctctcttcttgtccctactaccctgacacaaaccaggctggagttcttccagaaacttcctttagagaagacaggtggtgtgtggggtggacctgaatttctgttttgggttggggtctgtaagtcacagtggctgagccttggaaggggggagtggaaagcagcagatgcagaatggccaggccgtggcaacagacagtgcaagggaggcagagcatgtagcatcttcctgcttgcttcaggactctttcactctcttctgttgtttctgggagtttgggactcggggccagccattagcctgggaatgggagggagactgcagggcttcagccattctgggaaagaagcttcagccccaggcagccaaggcccaggtcaatcagacttacagttcctgttgccacaggtgcctagtggggaggaccagacggccctgtccctggaagagtgccttaggctgctggaagccacctgcccctttggggagaatgctgaggtgagcaggactccagtgagagtccaccaagtgagcagggcagcctgtacctggtgtgtccctccatggctgaggggccagctgttggttctggccttattctggctgctgggggtaaatgcagaggaaggaagaacagaaacaggtccaggtggtaatctctgggaggaaagcacaaggtttttccttcccccttgttaaagcctctgtgttttgccctagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggtaggattgtcggaaccgggcacaaacctattggattttgcacagattgtcttagcactcagttgcttttccatctccaaggagagaaagtgtaatactttccctgaatcatagagaagtggggacaatgagaagaaacctgtccaggtgtgtccttggggcaatgggagctggagacaggtagggtttgggttaaataaaactcaggactcagccttccaaatcagggcctgcctcctgggtgtgccttcttcctttccttcaggcagataggcacttggctgaatgcttccaaggttgtgcgttaataatagctgacattcacatggtgcttcacagccatcgttcgctcacttggccctcacagtcatctagtcagcctttatctcaaaggtgaggaaattgaagctcagaggttaaatgatgtgcccatcgtcacacagcaagtggtgcagctaggttttctgacttaagtctgggtgttcttttcactgtgctgattttgcagtaacaaggtagtgttttcttcctctccctccaagatgggggagtctggccaaacatgaggaaaagctgatcagtcctatattagggtggagcctacatggaagaacccatctctgccaggcctggtggacgaagctgggtcaggagctgacactgtgggctttggtttatagtattttgcctttacacccatgcagctgtgcctctgttgggtgcctgcagtgtgtgagccccaggggagggagtcagttcctagtgaacagtggtgctcttctcccctcccaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattctt
